United States Patent 7,365,185 (GENOMIC PLANT SEQUENCES AND USES THEREOF) - sequence listing, part 28

SEQ ID NO: 58917 - DNA, 107015 bp, Oryza sativa
  unsure (1)..(107015): unsure at all n locations
atatcgttctgtagtttccctcaacttttatacatgtgtttttagtgactcaagcaaaggttgaaaaataaattatgataaaagaacattaaaattaactttaaattcacattttagttgtggctgataagctgacgaataaacgatggtagtttatactttatagtagcatgtgcttgcaacttttcgttaggaattctaccaatatattatatcctctatttcttaaaacaactgaaatggctaaaaatgtgtttcccattttagaattttcatcgatcaagcaaatgttgaaaaataaattatgataaaagaacatcaaaattaactttaaattcacattttagttgtggttgataagctgaagaataaacgatggtagtttatagctgcatgtgtttgcaacttttcgttaggaattctaccaatatattatatcctctatttcttaaaacaactgaaatggctaaaaatgtgtttcccattttagaattttcatcgaaattctaacatttgaaatattgtatctatatattccaggcacttaatttcgcggtccaaaacacaccgcataatataattatttttttcaccggatgcataatataattattgcacttttgacttttatgtcatatgattgttttcttttagcccgtagcaacgcacatacattccggtagtcttctcaacaacagtaaaatacctgttttttcgtgtataactagaattctttgtaatcttggtggcgtgcaggcatttataaatccgtatctgctgtactcgaatgaattaattaggcgggactttcgctctcttcgcaaaaaggttctctgcgacataccctctgctttctagacacgcgtggccctgaacatcgatgtacacagtacactgcgttccaatgcgtacgaacacctgttgcaaatggcaataatactggctccacacggtgatccactctaacgtgaaacaatacttcaatctcagaacatgggaagtcaacaaatgcagatggaatgtacgcgccatatgatgtggactttggaattggtatggaattcatccgatgcaacttggatccaacaagcactcaactcggttaattaccaacgggatatcagaatatgcatgcagatgatggctaatcaccagcaatggacgcatggttcattgtatcaggatgacgactcctaaatccggcaagtcaaaaaaatataatagtaactacttgaactacatatgcataattgcaggtatgcatgtctctcttccatgttttgatgtttaatctgcatttgctttgctgtttcactgagtcaatgaaagaatgtgtctctgtcaggatctgtaattaattggtatcaactgaaggttcatccagaagaaatcaaatgaggatttgtgcgaatgcgattgcatcatagatgacatagcagtaccaaggtcagagtttatttttatgccttgtcatatctaggcgcacaccatgccaattcatgatttcttacttagtacattgcaccttgcatcatcacgttgatgatatgttaatggttagcgacgaacatatctattctaggcatggttgtatctagtaaacgattattgttttctatcttgctatataaatgcaggaaaccaaatttgcagaaactgaaggttcaccaggttttggcaatgcgtcgtggatgacatgaaaccagttacagctgcagtttcagttatgtcaaagatgcttcatttatattagtgtttcttgaattgtgagccatatactttttctccttgctaatcttgtgtggatatgaaacaccggaacttctctgcgcctacttgtttatatctttcgtgagaaaaaccatttgcctgaattttcagagagaagcttgtttgctgcaactactcgattccaacccaaagtacaggctgtggaagcagaacaccatcgtccttgtcttacttttccttgaactcatcctcaagccagccaacttcccagtattttcaggttttcaaagagcaattcgagacgaaataaatttcacacttaattttcgttatactactattcttaaccgattaacatgtgcacaagtcgaacctgaactagcccgtttccttctactacttttcagtagaaaatacccttgaaccccttttgtttcagaccaggatgtgcccaggtcaagagaaaaaacttaactacccagctgttgctgtgtctgcaactctgaatgcaatcaagacatcaagatcagaagataccgtgctgcttttgaaggtgatttactgagttctgacttgattagcagtcgactacgtactgacttagctatccagtgggaaggaagtcaacacacgggaaggactagtagtagtgacctcgccactgatccaatttgcagcttctttttttcagagttattcggtttacttgccggagtagacgactttaggaagctagcttgtgcagtacttctcaagttgtcgctgaaaagccttacctgatgaaagagagaagatgagataacaagttgcttctgagattgaagtcttgtttcaggttagctaagagtgctgattaagtgtgtaaggttgacagctctcttcaaccaagctgagtttccagaaaaagaacccaatgaggcaaggatctatggaccatttgaaacttggcaggacattttgcaagtatagcacatgccctaatatttttgtatctgatctatttattaattttagatagagaaaggaccaaggatatgctaagagaaaatgttggggctgtttggttatttgccaaattcaaccctaccaaaaaggttggctctgccagaacatttgccacttgtttggtttgctaccacaaatttggcgatacctttttttttccgttactagtctaactaatcttgccagcaatccaagcaatcatctttgccaaaaaaataatttgcaatagccaaatcttgccaatggttgccattgtaaaaatgttagcaatactaaaaatggaagagaatcaagtaggcccattaaggctgcgttcttttgtagggttccctactcccctctcgtttttcatgcacacgttttttaaactgcttaacggtatgtttttttaaaaaaaaattataggaaagttgctttaaaaaattatattaatctattttttaagttagttttagttaatacttaattaatcatgtgctattgtactccgttttccgtgctggaagagaatagaaggttttcaactagcacaacgaacacagcctaagccctgctacttcatcaaattattgctgtgaattatttgctctatgctacttctcaagaaaaaaaaccagcacttattctaagtcatttgttaagtttatcttaaaatattgtattattcctataatcaagtagataatcaagtaaaaatttaggtctcatcttttcgcttatacttatacttatacttatcggccaaaatttaaatttaagctgattttaaggtctttttaatcaaagtttattttttagcctaaaaacacgtatataaaaattttatttacaaattaatttacgtttacaaatatgccgtttcgcttattcaaaacaatgccttttttgaatgggctctaacgcccctggccgaaggatttatttattgatattcttatctttttcttaaccgtaagtctgtaaccagcccaataattatgggccgttgtttgggctttgggccggatcatgatattgcagttatcggatttgtacccgaaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggtaatttccttccgccagtctctcctctcacgatgtttaattgcgcgcatctctgtttcttcggtctagttatgtcgtttagggtttatgaccaagagcagatggtgaaaaatccggagttcttggtcactcggcgtgccattccatatcttttatgcgtaataagaccttttttttatgtttttgtttcccaaattttgctgtctggaaataatttcttgaaagggttggctttgatcgtttgctcgtgcaggaatcctgtccttcggtgaagaacattcttgtgctggattccgaagggaagcgcgtggcggtgaagtactacagcgatgactggccctctttgtcctcgaagcaagctttcgagaagtcggtctttgctaaaacccagaaaacgagcgctagaacagaaggtgattaaaatatacttttattctagttctgttctggaagaatcaaaacaatgtttgtttcttttttttcaaaaaaaaaaggtgctctgtgctacttgtgtagagaacaactgccttatccctgagaacatcaattagcaatttagcatctcacaatatggcattgttgattattgtaagactcctgtggaatattctagaggcatacacatatcttccagttcgagcatcattccattgtttggctcatcttctgtaaacctgtggtttgcttgttatgagatgttaattggtcgatttctgaattttggcagagttatcaccagattttgctgtggaatactaaccttatattatagaataacaggttatctgttttttactgctcatgaattccgttgcatttcttaaaattgactgaaagattcaagtttcggaaaaatgaatttttgttccaacaaatgaaatgatctcgatgcctgtgtcatctgaaatgccttatttttggttgatcattcattttgggggattttagaataattgcattgcacatgagtgtaaaatttgcatggtaggttgtttagttcaagtcatccaactatattcatccagtgatttctttcttttctttcccaatttgcagctgagatagtaatgtttgacagttacttcgttgtatacaagttcatccaagatctacacttttttgtaactggaggtgatgaagagaatgagctcattttagcatctgttcttcagggcttctctgaagctattgattaccttctcaggtgtggacatttcctgtgccgtacactcctatcttttttaacatccattataaatgcttgtcagtactgtatactattttaacaactctctttcttgttttcagaaacaaagtgcacagaagggctgcgcttgaaaacttggatcttatcttcttatgccttgacgaagttgttgatggagggtaattactatgtttgcattgcaatatgctaacctttgctttccatcaattgaacaagcccagttttgataactatcacatttttacgttcatatcaaaggcaacagacaaggtcttgggcttgtattgctgaaatgtgaggttaggcactagttggttaatgtaaagaaactacactctggccttgtttaggtgatgagaattgagccagaattttacacaaaatcagcattgacagctatcagttatctataatatttttatagttcattgttgggtatgctcagttcacagccaaccaattttcagataaacatttgcacaaatgctatgctaatgtagaacatctacaatcaggcatattaaacatttgacaacctgtagttattgattgacgctactaattgtttcttcacaatcgggttttgcaggattgttctggaaacagatgcaaaggcgattcttgaaaaggtatcaggtcatggattggaaggatccgggtctctcactgagcaggtatggcaagccgtcgcatcaccttaagtgcaattgcacaatgagatgcaatcatggtgtcgtaattgccaccaaaccaacatgagaaaattcccaagtgaattaattcttttttgtacatgcagaagttaagcagtgccctagcaacggcaagagaacactttgcgagatctattttcagctgatggcgtgtcatccttcaggttgacgatgagcaagcctcagatagtgtctctgttagcagatcagtactcccagtttgcaatgtcctttgaacatttgccacgggttagtggtaggtgcagcttaactggcgatcattgtcatcctaagaaggttgtggtcggcacacttgttactcttgtggtttcatgtcgatcttggctgtaatcgagcacagtaaccatgtagcaacatgtttctgctcaaagacgagccagtttccaaattgtcttcagtatacagccgccatgttttgacgtagtactacatacatttacttcggcctggtttggaatttgaatggtattctttatagctaagttgcttaataatgtttgactaatttcagaatacttgctatcaaaaccgaccaatcatcgaaagtaaccaaaattcgcattacaattctatcacctgttggtatgtttcatctcatgtcaaggtaaacaaaaagagacaaaagtaatcaagcaaagcgaccagaatcacgccggcaaactgctgccaatcctgctcacatactggcacagctggtccctcagcgcggccgcgccgacgtcggcgacatcgctgaactgctgccggtagccgtcgtcgtggttgtgcgacggcggcatgccgcccctcgccgcgtcctcgaggtcgatcatgatgttggtgagcaggcagcagacgtagatgatcctcggcagccggtgcttgtccggcctccacagctctcccttgagaacctgccacctctccttcagcttggccagagcaccctgcaccaccatgatcgtcgcggcgtgccgcttgttgaagtcggctttcgccggagatagatccttctcacggtatggagtcatcagccagggaaggagagggtagcttgcatccccaagaatgtagtctctgaccactgacccagctggctctcctggaagctccgtttgtccgtccagcctcgcgcctttctcgcagagcctgtagaatcctgaggtgcgcaggatgcacgagtcattcaagctgccaggccagccactgacaacgtctctgaaccgcatgtcggcatcgacgatggcctgcaggaccatgctgttcctgttctcgccgtcgagccagacattgctgttaggctgagctgaagagcacatgaggatgtgcgttgtgtctatggcgccgcagcagttggggaggccctgaatcttttcaaacttagatttgacggttgccatctcctcaggagtaggccacttaagatgattggcagcgcgctcctccaaggcctcaataaacttccaagtgatgtttgagatagctgagtggttcatcccgaagcggttccctatgctcaaaagcgactcaccggtggtcaatcttaacagagcaacacctacttgatcttccacgcctagaattgccttgtctccaaacctgaaatttctgaaactttgtgtctttcttgtgaagtccccactaatcagagagcaaaggtagtcaaaggtcttcctcgacatcttgaagacggactcaaagttttggcagtctttggaaaattgtcctgtggacataagacatagtcaaagatcgcagtggcgttagtcgagcatatcataaattatttggcagggaacttgaaagcataaaagggaaaattcagatatattgaaattcaaagaattcgattcgttctcctcatattgaaattagaagggcagaggaagaaacggggtaaaccttatgatagcaaatttaacagaagagattcaaatctaatagaacatggtccacaagtgtcgagaacagaaaatgaacaatactagcaatatcatgaatgaactgagcatattatatgagaaaaggtttagctgttttggcaatacagtgaatatcgattcaaaatttagaagaatcatcagtagaagggacactgcccttgttaaatagatgactagaatgctatcattcctgtatctaccttcttaaatcactcacacttgatgctcaggtttgtactaattgttcaaaatgtcactcttgtcaaaatttgaaaattctaacaatgtcacttgtcataaaggataggtaggcattcaaaaccaatgttttccagtgtttcagatcatttcagcaatcagggaagctcagaataaatatcactaacgacttcaagaattcaaaaatatattgtctatgtttttgtaagaacatgtatgatcaaaataagaatacagcagccagacaaatagctatacaaatctactttatttgttcaagctaaattgtacttgtatgggctgcttcacccaatgatctctgaaagactcacttgaacaccatacagagaggcctaatgaatctatactcctggatgatctatcacattgaattataaaacagtatttgctgtggtaccaggtactataagattcaagaaacttatcgtgggaatccatttctcggaacacatcattcaaccgacctacctttgagccacactaatcattttctggatttgccagtcaatctattggaacccaatcccctcacgtgtttcctttaaaaaaaaatattaacagccaatcggatgatgaaattggggaaactacctgtgaacagatgagctaattacttaaaaaaaacgcatatgctacactttacaattctggactgaacaggcaaagcaattcgatggcaagtacagactaattgttctccgggagatgttgttttccccttagcaaaatgaagttacttcataagttgcaaagagaaaagaagttagttcttgcaatgtcaaggcatgaacagtcaaccaacctattctgaattagattgacacaatgggcaaaagccaacagcacccgtaaatttctagccccaaaataccattgcaccaaaggcttcatagatctggattggagaaggaaacaacaaaaccacagatggcacaaccaattcttctcccaaacacggtctactcgatcgatacccatcagagcaacggcattcacaagcttttccttgctcataccctcggagcaatcgacatccatggtggtctccaatccagaacatcccccccgcccgagatggttcgctgcctcggagcaccgtacaatcccaccacctccaaaacaaagcccaccgaaacagcggatttgcaacagtaaccaccctgattaaggagcactgcacgggcggattaagcgaccgcatcgaacagataccgcgcaggcacgaacagtgcaaattcaacggcgggtctccctgatctaaccccgcggaatccgcccgcgaacaatcccaagcgcgcgagggggttaagcacgcattactcgccgccgacgagggttacggtgcgcgggcgcgaggtttacagcgagccaaggaaccagggaacgggcatggacatggttaaggacgaggagcacagtgctcgcaaacagggaagagacgaacgaacgaacggcaagacgtatacctgctgcaagcctgcgggcgaagccgtcccaccaatccccgccgggcgccggcgccggcatcgcctgccccgccgccggcaacgccttctccggctgccgcttccgccgcttggctcccctcagtggtgccatgacgagacgagacgagagcgacgcgaacgcgaaccccggaaggaggagaagagatcaagaaaagaaaaaaaaaacgagcaaaccaaccaaagcaaaactcacccccaatggcttagacttgaaaagacccagttgttttagtgcctaaacaaaagcagccgcagcagcagctgttgcccagactattctgcttccgttatttttcaggcccagaggcatgcaagaatccaacaagttttttttttttttttacaaaatgtgaactcatgtgcttgtgcaatctgcacacagcctagcctctggtttttttttttgtgtgtgaggaatgtgagatgagatgagatggcatgcagatgcaacacagggcttggagaattggaaagacttgggcaggatggatgggttaggtcaaatggaatgctctttgttatctacctatgtgttattaggtggtctcctcagggctgtagtgtaaagaaaaaaaaagaaagagaggagattcttttgtttgataagcttgcaaattagttgagaaaaattcaaggtaaaaaatacctttattgaggagtgtttgggtaacctgcccaagggatttgtataactgactgatgttttttggggatctctgttgctgttcctggtgatagaactgatgatgctctgctgtttcatgtgatctgcagggcttggacaatgcttacaaggtagctctatactgctatatatgggtttctttacacatttctcttcctttctcgttgttttcacgctcggtcagtttaatttaggccgggtttagttcccaattttttcttcaaactttcaactttttcatcccatcaaaactttcctacacacataaacttttaacttttttcttcaaactttcaattttagtcaaacttctaattttgacgtggaactaaacacaccttaaggaggggatggtaaattggatttttttttaccccctgaataagaacatcagcattttgattgatcaacagatgttttggtttagcttgcattggtttcactagatgtacaaacacaagtgatgtgaaaatgtactgaagcatatttatagtatatgttgtacttaattaattcacgccatggtgtaatgcaagtatgcaaatattaaacaccgacgtacctgatgtcttatgaactacgaaaatgaaccaacaaccttgatttggtcacgtgtagatcggctggtgtagctatctgccacgtttacataagaacccttttttttggggtaattttgcaatgaaatatgccatttggtttgttctaattatttggttaatggattcacacccaacttctggagaaaaattcaagggtaaaaaaggaaacaaaaccttgtagaaacggtcccgggaatagtacatcacctcgaaaacgttttctggtccctttcttaggccccactaatgaacatatccaaatccaccggaaatgtctcatgcttaacttttttgctaggcatgaaccctctgctaatcttgattgtgcctaactaatagcacagattgcaatatatatgatctttacacgtcatatttaagtgccatacatatcttaaaaccggctccaaaatcaacataagtaaccaaacattttaaaaagaccataaataatctaaacataataacgataccaagacacagtattttcttataaggtttatttgaaaaaggacgtgtacagtacaatacattgatagtatataatactagtataaataaggttacattaggaatctatcatcccaattgcattaattacaagactcctatctgatctagcataattacaacgtatcatgttatccacgaccatcgatcggataggacgccgaccaatcatccctcgtctatgttattatcgttatacgattacaaccgatggtgcctctctatttaagagaaactatacgagagagttcgaccctaattatatcttacatttattataactccaaattttaaaacacaattgactttgtacacattcaacacatactctaacagaagaaatcactcacatgtgtggtctgctgagctattttaaatagatttaactaattaatgatttgattatatagacaacatatacagtgatacggataatgttaaatgttcagtagaccgtatgttaatcaacgttgttgacatcatggcattgtttatgcacctttgacctttatcttccaattcctcaggaagatcggagtataagacattttagtcataaatatttattagctgtgtgcccaacaacagagaaccatttcagttatataaaaaaatgaatcatgtgcgattcttcatttcttctagtatcaatttgtaaatcaaaataatgaatcactacgaaaaacaattgttcataatttcttatgcacagtatattcacttctaattgttttaatcagggtcaagcgactcaagcctggttaacacctatgctacagtctcttgatgtcgtgtgtgtttgaaacttatttcggttctctcttatgtcatttatgactagattcagatgcagcacatcgtgtctgggcatggttcccgtatctccagcctcaccgtatgcccaggcgacaatattttttttgaaaagactacagataccaatattatttatgaatagattcacacttcgagctttaattgtcagcttgttatcaatcacaaaattttaactgaaacttagctttagccatgttttttttagacattggatggtttggaaggaaagaaatgtgcgtgtgtttcagaaccagcggcactcgacaagtttcatgtttggttcaattaaaaaagaagtggcgatttggaaggaggttggggttttcagaaatatataagagagtaatttctcggtgtattttttttttttttggaggttgctcatgtgacaactttcatttacttcgacagcttcgtattgaagtcaaaactttatatatttgtacatatttctcagtcttaagtaaatttggttggcctatcatggccggcctatcattagccatgttttagaccgctaatagtacaatccataaaatatctttaattgtcttgtttatttctatacgttcttatcagctatagctcaactgatcgaaacttatctattatgtcccgtgagagaaacgtctatgggtcttcctgctagttctacaaagtggtgggctagacgatctggattcgaagcctcaatccttctaattattgaatattagatcattccctaattaacattcacgtttttccatttcgtcccgtgtcaatcttgttctgcttgtaagactacctatattaccacttcggtcagtacgtgccaattttgattgacagatgagaatcgggatcaacgagctagccacttagccagcaggataacattggaacaagtagcaggtttcaatgttctcaaatgaaaaaagtagcaggtttcagaaagtttggcaaggtatcaacaagacaacaagttcacaataagcttcacaggggtttcaacgatttttcaagtcgaagttctacaattctacgttgcagcaaagttccagagaaaaaacattcagatccacagctgccagtctgcccagttgacgctgtgcctcgtagtgcggcttgcccaccggccaccggccacgaggcccacgccgtcgctatggggctcgatcggctaggtggcgaaccgccacggtgttgggacaccgtcggtggccgccaccaaactggacggccaatctagacttcgcccgccgatcactcggcaaaacggggcggggtccgatcgccgagtctggctcgccgcggcgctcgcatcgcatgccctcgtcgacgggacaaacgctactggttggtcgccggtccgtgcggtggtcgtaccacggaatctttgggtattcccggcccccacgatgatttgttacggaatgatatacggttctctgatattcccgtcgtccgtcgacgattaggcgctaaactggcccggcaaaaaaaaaagaaggaataggtgctaagcaagctgattggcgatagaaaaaaaaatatgactgtctatggatcatttgatagaaaacccctcaaaaatcttgcaaattttagaccacccgattgctttaagattcgtgcaggcaatcaaaccctaaaaatcctctcttctctcccgattcctcacgcgccggcgctcctcagcgctccccccccccggccggccccctctcctctcatttgcctcaagtcggcggcggcgagctgtccgttgtcttccccgtcgccggcggcgggacgctactgcaggccggcttcgtcctaccccttcttgcccgcttggccaccaccgacagtcttcagccccgcggcttcaggaagagccacttcctgcctcaccgcccgcctgatccgccacctcccacggccatccctctaaagccggcgaactcccccctcttccccctccccctcccccacccccaccccaccccaggaccctaattcgttggccctctactggagtttgggttcgccggcgccagagaagaagaggtggccgccggagttagagaagaagagcacgaatcgtaaagcatatccagtgatctaaaatttgcaaaatttgagataagattttctgtcgacagagttttagcaattccaaaaaaaaatcccaaaacattagctgtggatacgtatgtctacgtgatgagagttagtggcagaaagtattgtccaacttatataattatgcagaggactattaaaaactgccgtaaatttttaaagtgatctttcaaatctgactacagtatagttataatatagttttacataactacaatatatatatatatatatataaaagtataagtattaaaaaatatatgtaactttgtagtttgtactaagttatatagatattacaatgtaattacactatacttacactgagttcgatgtaactcagtgtaagtatagtgtaattacattatggttacattgagttatattagaaagttttttgaaaaaagcttgcgacagtttttagcaattccgattatgcaacattgaataactatgatatttgattatgttgatatggtacatatgcctctaaaatatttttaattgtatcgtggctttgtttgccttacaaataaaatgcctttacaattaatatatgtggtcagttttttttttcatgtctattgcattgcaccgagtgcttagtgagtttccccgtcacactatcaaacaggaaggatgcagctttgtgtatctttgacgcggcggcacagttatctttataaatgagggcaacatatactatgcacataggccctcacgtgtacacacgtgcacaccaactaaaaaatgtcaccaaaaaatctagaaaaaatcatacacatacttttaattgtattacacctagggttaaaatcttaacatcaaattcattatattttagccgtaacaaaaaaacaaaaaatctgacagttttaaagttgcaattttgtcagaattttatcttttttgttattctctatgtagaatgaatttgaagatacgactttacacgtagatgtaatactattgaaagtacatgtatgaattttcctagaattttttgtgataatttttagttggtgtacacgatgtgtacacgcgagggcttgtgtgcataggatacgctcccataaatgagaagtgtacaatttatctatttttttaattgatatattaatggcgtgaagtattaatacatatcaattcactaaaacaatactaccacgtgaaagtatacaaattagcgaacaatttccacttccacacatggctacaaaattgaataaatggatgggttgttgcaataggcattattgcccaaaaagagcattttatctcttgtctcgcacgtgaaggtttcttttatttcttggtgggttctacgatgcgctagcaacaaaaggtataaataaaaaatagaagtctttcttgtgacataaagtcaaagggatatggatcactgacataagaaaactacacgttagagacacatgtccctctgatgtatgttagagaaacctcgtcaatcggaggatagaggcgaattgatgtatgggtgaagtggcaatgataaagaatttgggttcaaaagaaaaaaagtatttggtatatacccagttacatttatacatgtaaaactttatacatcatcttggtgttggtgctacaaccaaagaaaggtaccaatagcctgtacccccaccaaaagagtacatattggtacatcttcttaagggcatataccaacaatcccaaaccccatctttgctgtacgatggggtagataggtacacaatcagcagtagctcaatttggaaattaatgacccggaatagccacaagagagcagtagtaaccctgctgagcattgacaatgacaagagcgagccacggaatggaggaagccggatcaaacggctcagaaagatcggatggtgacaggtcagcttgccgttcccgggccgtcaaaaagggcatttgccataggaataagttcacattgggtccctctatttctcgttcagtccgattttcgtcccttaccgtaaaaccgggtacgacccgtcccccaacttacgaaaaccgggcaaacaaagtctcttggcggttttaaaggcggttttggctgatgtggcgcctatgtggcttagtttgactaggtctctatccgacgtggcaatgacgtgacgcttacgtggcaatttaacccaaaaaataaataaaccttgtgggacccacatgtcagtttcacacagaaattataaaaaaaaggtggggcccacgtgggccccacatgtcagtttcacaccgtctttagggacatctagtgggccccatgctggccttcacggacaggcagctcaagtcccttggcggttttgaatgcggttttggctgatgtaacgcctacgtggcttagtttgactaggtctctgtccaacgtggcgctaacgtggcaattcaacctgaaaaataaataaaccttatgggacccacatgtcagtttcacacagaaattataaaaaaggtagggcccacgtgggccccacatgtcagtttcacaccgtctttagggacatctggtgggccccacgttggccttcacggacaggcagctcctcgtcgtccaggacatcgcggcggtgctcttcccggccaccgagtgcgtcctcggcagggacgacgacctcgtcctcctcgtcgagtctttgcccgccaagctcacggcgcgatcgacggcctcgaggccttcgccgcaggcgccgtggggcacccgctggggcacggcggtggtggcggccgagcacgggggagctccccatcccatccactgtcttccgcttcggcctagctcgccctccgctgctctgcccgcggccgtgctcgctcgccgcccctccgccgccgcgctcgccctccgctgctttgcccactgctgcactcacccgccgccgctcctccgccgcgcttgcatattttttgttagtggctggttgcaggaagcaggtaaattaggtagctaacaacgttaatgtgctaagcaagctaatgaattaaatatgactcatgcatgagtcatgcacgtaatggcatatatacatttgagtgtgctcagccatagacacatgtttggctaatatatatgtctgcatgttgttggcggcaaaccaacaagaagctagctagaggctatagctggtcatctccatgcatgcatatatatgctcgtacgaagacacatatgcatgcggccgtctgtacccggcgtatatgcgtatgaggctatgagctactcctatgggctcggaaggaactcgagaacttggaggttgtcacggcggacgacggcggcagtggcgatggcaacaccgttaccgtgcatggcgacaaggctcccgttgatggcaaaggagaggcagcgactccggcgaaacgcgccgacgtatcaggtggccaagaatgcggcgtggtccgcgtggaggatgtacagcgggtggagacgccagctgcagagatcacgaatgccatgaaggacacggagatcgtgaagaataaggaccaggagagaggaggcagcgagagggaagaagaggagactgttgccatggccggcacggggagcagggaggaagcatctcttcgatacagcatggaaataggggaacctccttaccggcgggagcggcgggacggcgggtgcgcttgcactaactcgtggccgcggcgggtcaggaaggcaggcgacgctgccggtcgctgggctgcggcggcggatggagtcgcgtcgtcggtaaccgctggcgggcgcgggcggcgaagggcgatggaggaaaaggggagagaatgacaggtggggcccacgtgggccccatcttttttataaatcttatgtgaaactgacaagtggggcccatgtgggccccaccttttttataatttctgtgtgaaactgacatgtgggtcccacaaggtttatttatttttcgggttgaattgccacgtaagcgtcacgtcaatgccacgtgggacggagacctagtcaaacaagccacgtaggtgccacgtcagccaaaaccgccttcaaaaccaccgagggacctcgtttgtccggttttcataagttgtgggacgggtcgtagctggttttgtggtcaagggacgaaaatcagattgggcgacaaatagagggacccaaagtgaacttattcctttgccatatgccatctccgaataaattcagcccatttaacgttgtgggctgaacaaagagaatgaggaataagttcactttgggtccctctatttgccacccagtccgattttcgccccaggtcggttttggctgacgtggcgcctacgtggcttgtttgactaggtctctatcccacgtggtattgacgtggcgctttatgtggcaactataactcggaaaataataaaaagtgtggccccacatgtcagctgcacacaaaaaataattttaaaatggtggggcccatatgggccctacatgttagcctcacccctctcttcttccctctcccttctctctcttcttccctttcccctctctctctctccccttactgggcatggacggcgcgggtgggcggcggagcaggcgagcagagttggagttggagcgtggcgagtgacggagaagcgagcgcgccggccgggcggtcggagtcggcgagcgccgcgacgtcggaatcggccgacagctgaaggtccacgtctggcccgggctcagctgcgtgccgccggccacaccgtgaacgagcaccggttggtgatggtgaaggttgccgcgttggcgccgccggcggcgagggtcgccaccaaggccacgacgacgagcactgcagaagaggcggtcagagctgacgccattgttgaatatcgatctctcgaagctagctagtttatattgcttcttaggatatatcgatgtatgcggccggcggtggctgtatcgggaggtggaaggggacgcgcgcagtcgcagtgctactgctaccaccaccaccattggggctgggtgtgcgtgggtcggagagctcgaggattccgccgccggccgattccgacgttgttgtgctcgccgactccgaccgcccggcgcgcgcgcttctccggtcacccaccgcctacgccgcgctgtccgcggcgctccggtcggggggcagcgccgaccatgcccgccgccgctgccggagctcgcctgctccgccgcttacccgcgtcgtccgttgcgatagagaggggaaggagaagaagaagaagagagaagggagagggaagaagtgaggagtgaggctgacatgtggggcccatttaattttttttgtgtgcagttgatatgtggggccaagctttttattatttttctgagatataattaccacgtaagcgccacgtcaataccacgtgagacggatacctagtcaaacaagccatgtaggcaccacgtcagccaaaaccgccttcaaaaccgccgagggatctcgtttgcctgattttcgtaagttaggggacgggtcgtacctggttttgcggtcaagcgacgaaaatcggactgggcgacaaatagagagacccaaagtgaacttattccaagaaatgacgtgtggcccgaagagagagagagagagagatatagtacagcccattatagcattgccgatgtgcgttcttccactaggcctgacgcttccaatccaacctcgtcccttctcgtcagcccatcaatccaccgaccttgatgaatttttcgtctcgtttcttcttttttctcttttttattctctattggagtagagcatgtctctttttaaaaaaaactgagtagagcatgtcatgttcatcgctcaatttccacgttcctcttgcgagggttttgaattccatgtcaacatacgttcacgcggttgttcaagctgcacgtgtgagccgcgcgaaggttgaccgcagtactgtcgagaattggcttctgcccttatctcaaagctcacataaaaaaaacagggatttcgagttctggatgtagacttgaacaaatgaaaagtaacatgatgttgttttcaagccaggcaaactatcgctggatttcaatgaaaaacaaatcatggctggagtaagtaagatttgctgttgcatatacgcgccgccgtctgtctgcctccagtctccactgcatcttccagtgtccagtcttctctctagtctgtctgttttttcaaccacggccggtctacaaaaggtacaaatcaaatccaccgttcttgttggaattgcttaaggccaaatccattcgcaagtcaagcattcagatttcactataggcatccaataaaaaaaaaagagcatatgggagtatatttgttagcattcccttcttttgatcgtttcccctcttctctcgtacagtacctacctacttctttggatttgactgtacttactgcagagttggtaccaactgccctatcaaccacactaccacagttgctaagcatccagaaattcagaatacgagtattaggcgatcccaaaccctccctatcatctccctatcatctactgtccatgtggcaaaagaattaataaggagagagataaaaaaataaagaaactatttcttatacaagaaactatctctacacagtaaccaagaatgaaaacaagaggatatgtgcagccccatcgtttggctatttggtggaataagccaaacatcatatttacaaataaaaaataatctgtgaataaaacttttatatacatgttctaagcgatttaaaagcaaaggctgaaaaataaactatgatggaaaaactccaaaatcaactccaaatttaaggttgaaaattcaaattttggctgataagcataatcataagcgaaaagatgaggccggtggataaaaggagagagaagagagataattagataataatttaatctgaagacatcattcattggatatatagtttctatgcataagttgtgtttagttcacaccaaaattccaagtttgtttgaaattggaacaatgtgatggaaaagttggaagtttgtgtataagaaagttttgatgtgatagaaaggttggaagtttgaagaattattttggaactaaacacggcgatagtgcttatatgatatggcaagtatgaaaactacttgccctaggggtgcgtttagttccacgccaaaattgaaagtttgactaaattgaaagtttgaagaaaaaagttagaagtttatgtgtgtaggaaagttttgatgtgatggaaaagtttaaaatttgaagaaaaagttggaaactaaggctgtgtttagttccttccaaagttggaagtttggattgaaattggtacgatgtgactgaaaaattgtgtgtgtatgaccaattgagatcccctgcagtactgcagcagtactgcaggctgacatgtgggcccgagggctgtggggcccacatgtcagcttgcagtactgcacatgcagtactgcatgtgcagtactgcagacgacctgtgtccgtgtaagacaggttgaggtgatggaaaaaattggaagtttggatctaaacacagcctaaagcactactccctccgtcccaaaaaaaaaggtaaaccctgagtttccatgtccaactttgactgtatgtcttatatgaaattttttttataattcgtattttcattgttgttagatgataaaacatgattaatattttatgcatgacttgtctttttaattttttttcataatttttttaaataagacggacggttaaacgttgggcacggaaaccatctaggttggggatgacattagtagtagtatctcacatcagcatgactgacatccacatcagtttctggataaagctccaagttgacttctaccagtggattgtatatactcccactctacccgtaactaccttgccgacttgcagtagcacgcgtccggtacgcgagaagcgcactccatcaaatagcttccggatgtactggcagtattctgctttcgcctttcggcacaagaaatacacgtatgcggaaaaagaaaatcaactgaaacaacaggaggaacaattaaatttcaattcgttccggaattttatatgcctcgccacacgtacaggcgaagtggtcgttgtcccacacgcctcacgccccgtgcgtggcgccgcacgcgtcacgtccgccgccgcgcgggttcgccggttcgcatgctcctctcgccgacgtggtctacacggccgccgcgcgctacactatcctttcttccagtagatttattcccacgatcaaacgcgcgaatatttatcagtacacgatacactagcttagctcgatcgggtgtccatgacgacttgttgcaccgtccactgacgtgacggaatggccagtgcgtgcactttcgattcgtcaagatatgtacgtacagttaccagatagatggtcaatgtacgcacacgattaagcgagatggacagccaagtgggatgactggacggatactcatcaactcgtgacgaatatccgtatcctgcccgtgagcacacggagagtagtgtagtgttcctttttcgctcgcacacaactgccaggtgacgtcgcggcaaacgtttccgtttcccacttgctgatatattctcctgcactctgttggagccagtcgaaaacggaagctccaggagaagattttttttaaaaaaaaattgaaacggcggctgcagaagcgagttcctgaagttgacgaggcttgtgaatgatcggcttctggaaagcgcgcaaaagcaagcaaacttttagcccaaccgataaaccatgtgtgcgcgaccgagcgcttcgttgcgttccgacccgagtcggggcacgccacgggtgcacatacgtgatgcacacgtacgcgagcagcgcgaccgcgtcacgtttcttcgtggccaagcctggcgcgctagctacctcctaccgctacctcgctcgctcatgcggcttgcttgcttggctctagttagtagtttggcgcccgcgcgcaccaaccttgacgtgaacgactctatcacacctcattagcgcatattaaccgcgtactctctatatataaaacgagtacgtccgccaacgtgaagggaatttttagctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaattgttttgcatccttgaaaaatccttgtttccatgatcgtaataggaagtgttctttcccaacccgcaagaaagtaagaaacggtcgatcagagaggaaaaagtgcgaaaacgctaatccatggttccattccatggaggaggtcaacatttccaggcgtatctggacctcctagaagtccaatcgtattagtctgggctgtgaaccgatctattacaaaccgtgtgggctgtgagcccaagtcaccaactcatattttgtcacttgggctagactatgtaacactgacgcgagcccaatacactagaagtccaagattttgatcagtgcttgtattcctaatagattacttgcacactctccagaaatagttctttagtacataaatgatgcattcattctccagaaaatgatataacccaagacaccagacagtggtcagaggctagtcactagaggcatatacagaacataattaatggctaacatataggagtatcaatttcggaattatcatcccgtacaataggtagtatgagatcaccacaccggcgcaagcctgaacccaagcccaaactcctcatcccccgtgccttttgctcccgtactgcccgttcccgccggagatgaggtaggcgccgccgtccttcttgcccctgggcctccgcgggatgcatctgtcgtgcatgtccacggcctccgtcgacggctccaccttctgcaccctgccatgccgcgaggcagagatagcataccatcatatcaccaactcatcatcatcatattctcatcgtactccatgacgccacacagaggcaggctagcctggctagtagtattgggttctttttaagcaacggcgagcgccgtgcagcagcagatatgatgataactacgttatcaggttctgggttagggctctggaccacgcttaaagcagagttcaatgacttcaaattgctgacaaaggctggtgctactgctgctaggagctcgcgtcatattcattagttactccgatccctcacctcgtcacacacgtgattgagtgcggcttatcattgacgcgatatggctctcaacgagctaatcaaggcttttcgatgaaggctcgcatggattaattagggcgggacgagaattcaagccccgtccctgacattccccattcatcccgtcggctctgtgcgagacagctccgcgagacctacttccatttatgaacgcaaccactaatcaggtacactactcctcatatcttgcatgtacagcaatggcatttgcagaggagttcagtgccgcactagcaattcttaactgccgccacggcagtatggttcaatgcaacagtaccagttcatgtgttattccttacaactacgactctacgagagatttagaggcaaccattcaaccaaccaaatggagttctaaactgctacggcatggtaactaactggtcgtaccgatttggatactggcgttgaacattgatttgcattgatgttttgcgactaattaaccagctatggatggattggtgtacctgtcggcgttgtaagaggatgaccgccggagaacggcaatgtcttgggacgtgtcggccggcgacgagcgcttcgtctcgacgaggctaccgctgaagtactccttgtcctcgacgatcttttggcggtagttcgggatctcggtggtggtcgacgcgagtgtaggtgggcgcggtggccgtggacggtagtgcgcggcggtgcgagccatcaccggcgaggcgagcgtgctcttgacggagacggacccgcacgagatgagctgcatgagcacggacgacgccctggtcctcccgccgccggtgacggccgccatgacgcgtccgtccgccttgatcagcgcctcgagcgtctcggggctcgtcgacgccgtcggcggcgacgtctcctctctgctcagctcctcctgcgccgccgcggccgcggcgcgctgggcgtgtctaccgcggctgctgcggtaaccgtcctcggtctgcgtcgcggcgtccgcggccgccgcggcggggtcctcggccttgtacaccctgtactcacaaagctccgacgtgtttattcccgcgcccttcttttggcgcgcctcgccggtgccgttctcccacccgggcggcgaggacgtggccgtctcctgcgagcccgaggagcaggacgacgcggcggccgcgtcgagcagcgggagctggatcgggtgcagccgctccgtgcccttgagcacgtactctcgcccagccaccgggtagatgtagtcgtcgtccgccaggtcgtgccacacgaacccgttccggtagctcctgcaatattgccacaacattgaggacgatcccatgtccaatgctcgcttgcacctcactggcaagcaagccacaacaagaacaagttcgtgaaaaaaactaaccttttggacgcccacgagtacatgcgcgccatccccttgcctctgagcgcgtcgagccggtcgatcacatctacgcacagcaacgacgacgacgacgtcacggaacggcggcgaatgcagcaacaaaaacaaaagaaaaaccgaaacgcgcgacgacgagacgatcaagctgagcacacgcacgtacctcggaggtagagcccgtcaggtgaggcgacggcaacctccatgaaatgcgggtgctcgaggtgcccgttcctcgagaggtagtacacgacggcggccctcgccggccccggccttggccttggcggccgcgacggcgccatgtcggggcacctcgcctcctgctgcgcctctcgccacggcagccgctgctgctcccctttccccctgctgccagccaccaccactgccatcctcgtcaacctaacctacccttgctggctgctgctgctgcccccagcaataatccctgagctatatgcagcgagctgcaatgcaaggctgcaggcgtcgtcgtcaccgctcagcagctagcgcttaaagggcgcgagtgcgacacaggggaaggtgcaaaggagggcgcagcggaggcagtgatgagtggcattcaaacgatgccaggaccagctcagctgtgagagagctggggcagagtgtgggttgatggaggcgagagcagcgatatcagaggatttgtagtaatagaaaagcttcactagctctctggttagttgctttctcctttaggttcttgaagtcaacacactgctgcattgtgtatcactactgatgtatggtagactgtcctattgttaagtactggtacctagagcttaattaccggtgatgttgactagtagtagtactaattaaggtgtttgcagtgtgggggtgagaccagtggattaagggtgggtaattattgtgggggactctagagggtggtgaaatggcagctggttcggcgctgccaaagcagttcttttaagcgaaaacgtttgactaacgaggcccacacgtatggggcgcggcgacgctgaccaagactagtcgctgggcccgtatgtcagtgagccaatcgaggacttctccctctctcttaagactcttgctaacgctctgtgagtccaactcccagtgcactgtaagtcctggatggtttgttaatctgattgctgtctcttaatgcctgatgtgtccgtagacaaataagccgtgcatgtgaagccttggagcacgggttgggtttccccgctgatgctgcgagtattaatatttggaagcatttgcgtgcatgggaaggctgcaatccctgtcctgtccatttgggcctccttccaagtcccaattaaactccctgcccctcccctgccctggtgctttgctttgccatggcacagagatcagcgacgcgacaagtgatactaatcccagccacgtgacagggaccatcctgctgattaacacacagcagcggcaaacacccggcgttaacctaacacgggccattaagcagcgtgacccaccaccgcgaggccccacgcgtcggcgagacggctgcctgccgctatcgcacgcgaaagcagaggcgagagaggtgtttcgcttcgtcagggttttgcagcggaggaggacaaggggggaaggctccaccgactacgagatggcaaaatggagggggtgtgtagcctatggcgcggacagcgagacagcacggcgtacgcgcgcgaaaccggagaggagagaggaggctgcgtttgcctcacggagatgggggcggtgcggtgcggtgggtgcccgccaccgccagcgccacacctcgccgcgagcatcgagatccgcgccggccggcgtctcagctcgcgctgccggttttcttttcactcacatgccgcgctcctgcgtctcgatcccggccgcagccttcgcgctttgttctttaccgcgccccggtaattgaagcctgctgattactggggtctactactcgtctagtactcctgattaccggaccagtaattcagtacggattctactgattcgtctgaggccatgcgtgcctactgtcaggtatgcaatcgatccggtcacgcagccgaggtgtgtcggaattcggaagcgagacgcgcgcagcgagcgacaccgtacgcacaggttctccttttaatatttgcgtaggtcgacgtctgtccgtatcggttcgtcgcacatgtccccgaacgtattaggtcgggtcggtcagtggctcagtgcgtaggtgaaacggaggctggaagcttgtgcgggttgtgggcttgtggctgcctgcacggcactgcggattgaatcgggaccagtgcgcgcgttgaaaacatgagacgtctaggtcacgaggccaagaggcgccccagcacgacaaatcatcagcgattcgtgaacagcaaacaaacgtaacaccttaacacgtcatgcagtttgccgacgaatttgagcatgcatacgcatacgcttcactgctggtccatagcatagagatcattctttctcctgtgctggtcaggcacagctgtaataacggatgatagttccagcgcaagaaagatactaatgccgcgggcgataggagtacgtacggtgctacatacgggtgtagaactagcgtgtttctcgtgtcgagctcaccaaaacgacctttttgtgcttgtcctgcctgcttcgctgacctgtatagcttgacctttagaatctctcgtgtttgcttcgcttggcccacaagctcacgggcctacgaaggaggggggatttagtgaggcccactgggccgaaaaggccgtcggcgcgggagcacaaacctagcggagtggacaggtccgaaccgagttccacctcccaaacccctcaaccctcgccgccgccgccgccgccgccgctcgtcgctctgctccgccgcagccatggggaagttccgcaagctcggccgccacgccgcccaccgagtatccatgctcaggtaccatttggcctcgatccttctctctcgagcgcgagatccgcatctctctgtgtgtgtcggagtcatggacatgtctgttcggcaggacgatggtgtcgcagctcgtgaagcacgagcgaatcgagaccaccgtcgccaaggtacgtactctctcctttccgcctaggatctggtcgaacaccttgtagagtgggggcgcctcggatttatgtgctgggagtcgtggttgattccaggcgaaggaggtgcggcgcaaggcggatcagatggtgcagctcgggaaagaggtaaaaactgctacctgtgaaacattctcctgttgccatagaactataacctgaaaaaaattactgtttagtgccatccatgaacctatgtagagctttggattgccgcatttttttttgcacaaccgcgcacacagttctgtagtacgagtaactagtaagcatggatgagtacttgattagttccatgagcgtgacattttgtttactgttaaatttcgtacaagagatgaattgactattgagggatgtagggatgtgtcttcacaagaatggcagtatggaaacaatttactctctccatcttgaaatataagcatttctgattttgtcctaactcaaactatcctaagtttgaccttatagaaagaaagcaacaatatccacgatatcaaatgagtatcattagatccattatgaaatatattttcatactttacctattagacatggtagtagatgttaatattcttctctatacacttgatcaagaacaaaattagaaatgcttatattttgggacggtgtgagtaatgttttacatcgtggttttaatcagattcaaatgagttttctacttttgtattttattttctctcttcgttatgagatggttgaaatgttcaggtcatatagctaatcaatgattggttgtctgataaattgtctcaagtttctgttacatactaggcgatccatctgaatgatgtcttcttgttttggagtcgatgctacataagccttcctgtgattgtgccattctgcatgttaccttaaacgtcttttgatctggctggaatgttgcattgatttatttaagtctattcttaaaggtattcgtccagaaacttatcttttatttgcataaattatagggcacattggatgcagcaagacgtgcttctgcttttgttcggggagatgatgttgttcataagctatttacagagctagcctaccgttacaagtaaaactccttcatgtgttgtgtatcaatttgatttgtttctaccactgtttaaaaatatgtcatgttagcatctcacataaggaataaagtaaaatgcctaccatggtctttgtacaatgcatctaaaaggtgtaggattttatgcatcacaaaattgtaatactagaacgctatgtactggtagcatagggtcataatatttttaggtcgatcctaatgattcttttgtcccttttgaatttaggaaccgagctggtgggtacaccagactattgcgaactaggatacgagttggtgatgctgcaccgatggcatacattgagtaagcttctcttatgatttttaaaatggaaaattgatcagtgacctttccattgggttattagtcagttttttttttgcggggaattagtcagttttgttattcgcttacttttactttgtgtttgctattaaaaaattactaccatgccaccgacttgtttttgcccctgcttcacgtggaacaatcaactggttgagtataaaattcagcatcatgcagtgttttttaaatgaaagaagctagcgtgctaaaagcatcttcaaaccatgcaaagttttttttttctaaaatgctgagttttagctggctgtgccagaaatatatcatcatatcaaattcccagaaatcataacttgctgttttgcagcccaagtcactcgctgtcttcatctgcaggttcgttgatagggaaaatgaacttcgagaagccaaacctgcaacaccacagccacctcaacggtctcctcttgatccctgggccaagtctcgtgctagccaacagtgggcgggacctaaaatcagcgagggctctagaaaagaaggcttatgaaaataatattcatgtgttgagttccttgagactgtattcaattttctgtactaggctatgaggcaccagcttgtcattttggaggagttttgtcacgagatatattgtcaatagaataatttgaacttggctgcttacttttaacaaagcctgatgccctcatgagatgtgtatcatgtatgactgcaaatcattcattgagatatgaaatgcagaattatccatacctgtattattcccggaagaatatcggtggagtactggatttcctatagctgatgtatatgagtcccccttgccaattcgtgattgggttagatgctattcgttctggctattgtgtgtacactgtatacatgtttcttttctgtagactgtagctactgacttcctacatgtccggatcctctgacgtactttattctacgtcagagggacgttcgaccatggatcgccgttccttgcgcatccgacggcaacaaccgttttagtctcgtcacttgtctcaggccccacagcgcaatgtctctgcctgctctccggcccattcattgatagggacagcggtgccgcgccggccgccggagagctcaggccgccgcacactgccgccagcggggaggtcggactaggacgcggtgctagcgccgtccgtcggcgaggtcgagggcgacggctacgcccgccttggtgtttgctgtttgtcccatcgcacagagactgctgttctcggaaccgtcgccggcgaagttggattggaatcgatctgtagccgatcgaacttccatcatcaagttgccttttctcatggaagaggcagctggttgaaaatcttgctaaggcattcgtgctgtcattaacttgtcccagaaactaagaaactacaagtaacctgaagaataaaattcagagctaaccagaagaaaagaaaccaaaactttgccaacagattcacagtagaatgcgacatagcaagtctacaattgcaataagaaaataccaaagaagatggtttttttccttgaagaagagatcaatcgagtgcagatgttaaccaagtaaagaaatctcatggcatgaaatgaagagaagatgagtaacttttctgttctatttgttccccgtatagctctccgacgacggttccgacaacagcagccgctgggcggagccatcgccctcgacctcgccggcggacagcggtagcgccgcgttccagtccaacctccccgccggcttcagcgcgcggcggcctgagctccccggcggctggcgcggtgccgctgcccctattaacgaatgggccagagagcaggcagggacatcgcgcttgcggggcctgagacaagagacgggactgaaacggttgttgccgtcggatacgcaagcaacgacgatctatagtcgaacgtccctctgacatagaatagattacgttagaggatccggttcaatgttcaggagatgttgtcattttcggaagtcacaagcaacacaaccaaaaaacgcaaaagtatgtacggagtagatgctagcagcagtggggagatcattctcaagcaagaattccaaaatatagcgactctggatcagatttagtgcatcttccataaaggattatgatgtgtctcatctaattcttagttattatattttgtgacgtggtaatatttattatgttttgaataaatacaaaattcttcaagataggagcaaaccctgtaacctgctagtagtctgcagcaccaacgttctcttcggccgattcggcgattgcatcagactgaccaacaagatacagaaatcctcatccaccacatccaaagcggcaaagctcgtccgctccaaaaggcccgactttcctgcgatcagatgcagcaccttgggggttccctgaggaccctgacctagcccacggcacagctggtggtgccgttcacacggttccctggatccgcccacaatctgctcgacgaaatgccgcaccgggacgtcgtctcggccacggcggccattggcgcgctcacccgcagcggccggcaccgggacgcggtcgccctcttctccggcattcttggggacggcatcgtgcccaacgagttcaccttcggcaccatcctgcagtcggcgagcgcgctgcgcgaccttcgcgtcggtgcgcagctccacgcctgcgtcgccaagcttggcctctgttccaacgtcttcgtcggcagcgctctcgtcgaccactacgccaagatgggctccgtgagggaagcccagggcgcgctgcaggacacccgcgagccgaacgtcgtctcttacaccgcgctcattgcggggtttctgaagaatgggatgtctggggatgcagcccggctgttccggtgcatgccggagaggaatgtgatttcttggaacgccatgatcggcggatccagcaaggcaggactcaacgaggaggcagtcaatctgttcctggagatgtgtcgggaaggcgtcaggccgaacgagagcacgtttccctgcttgctcacatccgttgccaatgcaggggcgctcggcgttggcagaagcatccatgcttctgctatcaagttcttgggtaagcttgatgtttttgcgggcaattctcttgtcagcttctatgctagatgtggcagtttggatgacagcgtcctggcgttcaaaaagatcaagaacaagaacgtggtgtcctggaacgcgttgatctgcggatatgcgcaaaatgggaggggggaggaggctttggatgccttcaggaggatgaaagctacaggcttgaagctggatcgtgttactcttcttggcttgctgtttggttgcaaccatgctggtctggttgatgaaggttactcattgttcaggactgccgagatggagcagccgggtgtattgagacctgagcactatgcttgtgtggttgatctcttctccagggctaagcgatttgatgatgccaagcggtttcttgagaaccttcccttcgagccaggcattggattctggaagtcgttgataggagggtgccagattcactggaatagggagctggctaagagtgtcgcgaagcatattcatgcactggatcctaaggatacttcttcatacatccttctatctaatgtttactctgcagcaggaagctggcaggatgtgtcaatgatcagaagggaaattaaagaaaagggactgaagaggatcactggttgcagttggattgaggtccagaaccaggttcatgtcttcttcaatggagaccgcagacatccaaagagtgatgatatttacatgatgcttgaatcttgtctgaatagcgaggaagatgaggactgccttgtatgattatcagacaccataaaaaagacagctcgaggaatggcattccaatgaaagctttttcggatcttgagataaatataaagttctgggcacatgtacagcaagcttgtctttgcatatcaagtatttgcttaaagattaaactatgagccctaacagcattagcaagaaatactgaaagtctgaaacagacctcataagatttaagcatggtacctggtaacctggagatgaacagaaatgaccacatgcaactctcaactctggatctgttgtggtgctgaccattttctttattttttgcctcacatgattggcttcttgcacaaagggaaaattgatcatatgctacaaatactgtcaaaattgaattgttagcgatagaactttcctgttcaaatttttttttgaatggaaccagcacgtgagtgtgcttttttttttcctgttcaaattgaaattcctttggatgagaaaacatattcaatcataccgagtgcagaattgcagactaggagtctaggaccatcaagctccagcctcaaatggtttaatagtagacactacacaaaggatagattgtgtagtgtgtacaaaatcaccataatactggtgtcttttgatttaattttttcgggcgaaattctctcatttttggaaagaaataaacttgtttaaatcgcaaatcaaacgttagcgctgaaaacatcagtgaaaggaaactgatctggccacatcaacacttgcaaaaccatgacatgagatgagaccaaggatacacttctaaaggcctgtagagtacttaacatgtgttcaaaacattctatattattctgtaatctaaatcccataaattcggtattattcactctgatacatcacaaactttttccactgatacaaattacaaaatcctccgtaggtagcctctgcggtcactcatttgacatttcctgcagcccgttcaaagcacaaaccacaaattcacaggaattcaagcaccaagagaaacacattgaaagttgtgataagatcagcgattcatttatagcgaatttcaccgatactacattgttccatgtgggaaatctaagagcgctctaaataaacatcagaacagataaacatccaacgaacatgaacagatcacgcgtcttaagacgacgtgaacttggtgacggccttggtgccctcagagacggcgtgcttggcgagctcgccggggaggacgaggcgcaccgaggtctggatctcgcgggaggtgatggtcggcttcttgttgtagcgggcgagacgggcggcctcctgggcgagcttctcgaagatatcgttgatgaacgagttcatgatcgacatggccttggacgatatcccgatatcgggatgcacctgcttgaggaccttgaaaatgtagatcttataagtttcgacgctcttcttggccttcttcttccccttcttctcgccgccgccctccttggcgcccggcacccgcttctcggccttgggcttcttctccgccttctcctccaccggctttttctccgcgggcttcttctccgccttgggcgccatcgggaattcgctgaagatgaaccgcgacgacgacgagtagaggatttgggatttggaggcgagaggtggattggatttgatttgctttcgccgtgtggggaattaggatggggcgggtggggtggggatatataggagtgtgggaaggnacgtgattggtgggttgggtggtggcgcggatcgataaggtggtggggctcgcggccgttggattcgttgtacggctggatcttgacgcgccccggcgtggggatccgtgatgtggcggctccgtgggtggggttaggcggtaagctggagtttgggaagcgaaatgcaagcgggaaacccgtgttttggccaaagggaggaggcgattcgagttggaatttttcaggggattttggcgggccgcgcacggcccacgacgagcattgggccataggcggggggagaccaaccgccgctgggaagatggtcgatccgccggccgccggccgccggccatccctggccgctcgcttctccgccggcttacttgccggccggtacgatccatccctactttctccgtatccactctacatctctacagccagggccacgcccatcgctggatctccttctgcgaagatctggtttagatctaccggtggcctgacctagatttgttgaatcgatctaacacccccctgatctgatggtaaagcttttgtcggttgtctggataatcgtttagatgctgtcaacacgctatttgtagggttcgtggcatagttgttgatttgagtgagtttcggtcatttgggtgctatggaatcgtgctggtattacttagaacggagcgctgagtttgatctgacacgaaaattaacctaggcccggttggacctggtaattgcaggtttgcagcgcacatgagcatgagattaaggctcatggcatatggctgtatcacaaattcacaaatatttgctttgctttttcacaacaatgagttgctgctgcatgcattttagttctcccagcaaaccaaaacagtactatctcatcagctgctatgctttgctagccgttagcatggaatgattgtagtgacaaaactttttttttgggggcatatatgttccttatttcagttattgagtttggttaccttgccgatttcacttactacttgtttgtcatgtaccatcaacatacctttactggatacagaaatatttgtttgtgtatagtgctggtgagacttactccctccgttccataaaaaaccaacctagtactggatgtgacacatcctattacaacgaatctggacatacatctgtccagatttgttatactagaatatgtcacatccagtcctagattcactttttttgggacggagggagtatcttttaggaattgagagaaattcacctacagtttaacatgttgcacagttgtgcatccttgtcatcctgtgctgtttaatgtttatttatgttgtttgacagttatttttctttcagtttcgacagtctactgttgatgtttgttacctgtatatatataactatgtaactatctcccaaatcttaataaaattggatggcccttccttcggccaccctggcaaaataatgtttatctagtctgtaattttaaaacgtctgtaagttgaagagtatgcatttccttttgtttcctccctatagaaacagttcaatgcataccctttatccatagttattacattttgcttcagttcttggatgttactaatgctagctagaacttatttgcattggccttgttagttgtttcctctgcctcttgaaagctaggacatggatgcagatggcttttatgtatcaaaatttaattgtgtatgcaagccaacaacgatcatatagcgaagtggatatcgcgttagattccgaatctaaaagtcgtgggttcgaatcccactatgatcgatttcccttggcttttatttttccttcttgtttctggtgttctgttttcagctgacagggacatattggcatcatccacaagggcacgaggtattcagagttcacttttgaatatggttggtcccagaactttgctgcctttggagaggattggcacggagtgcagagttctgctcatttctaactcttgggagtcttaccatccggttttaccagctgcaaccctgcaaatacatacaagcttgcatgcttggaacttcatggcttatcgatttgccttctgtaatctgctggtagcaattgtgatctttctttttaccggaaatgggaccatccaagcaaggtttgctcgacgatggtccatcagcattatccaaaacatgaggctgtggcgtggtgtggttgctagtttcagaaaatctttttacgttctacctgtgagaccatagtagattcaatccagagttattgtgttcgtatgcgttgcgtggagaaaacatccgatatatatatttgtctgtggtagcttgattttggaaaatttgctagaacaaaaaagggatgtatatcatgcggcgtagattcagtatcaggaaaccctttttttttttttgagaactgcaaactaaaaagagtagtagtttgcctcgagaggaaacgaaacacggtaagccaatatagatttataactgatgaatgagtaaactccagcaagtatttttgtacagcaccgagtattgctccatttataagaacatattacaaagaacggactgaaaccagtttgcagacattgtgtttcaacgttcaacagctagcagatcaggcaggtgcctgcttatatgacgtttgttacgaaaattgtgatgagtggcagtatttcaaagtttctcaacgtttacagcccaagccacacaaatacaaccagagctttagaataggtgacaaacatgtcccagtgctattcagccttcctgggagacgaaaccgcgaccaccaccaggcacactatgggaagtacagagggggagaagtgaattgctagtgtcaactgacatttggaaatcgacagccaaatcatgcacatgtgacgtggtatggttaactttccccagtactgccggtttcttcagagcatttcttgtgatttccttacaaggcgcctaacctttttcttgaagtcatccctcttctctctccattccttctgcgcaagaacagtaggcagaagttcagaacaaaggtccaccaaacagcaggcaaaatacactacgcattgtcctgactacaattttctgtgtgtttaaaaagtcattcaaatgtctggtgtgtaaattcacagatgtttcaaggactatagcagtacctgagaaaattctcagggctgcaactaaccaaataaataggtgaatatctaagatgaaaggtacatgcagaatccagtatgcaaatgttgataataaagttaaatggtttttggactggaagttagattattttgtaggatctgccaactctgtgttttccctattgacaagtacttcaactcttcccccatccctccgtgacagataaaatgccatatacaccaaggcccaggaggaacagagttctcaatttccatagcaaatgttaagtgaacttacagctgcttcaatatttgctggtgattcatcatttggaccagaaagcatcgaaatgatgctcagaactatgctctcaacctgtaaatggaaaacactcattaaaattacaagaatcaggaatatgatgattagacagtaaaaaatggctacttacaaaaagctagagaagataaacatatgatcatgacaagatcagtgacaaaacaaacaagtaactttgcagcattgttcaaaatatgactattattcaaatgcaagattcaaatgctacaattacttttgacttttcagtataccagaagctgagtttgatatgtcaacgatggaatttgtagtgatgtttcaagctatcatactataaattaccgaaggttacaccaactctacatataaggcttcttatactttgaagtttgaaaggatttactatctgaactagataatatcagatgcacaaagattcttatgcaagtttaataacttgctagtccaaagaaaataacgcattgcactttacagtaacaatattagagataaaaggattacaaaaacgaaactctaggtggaaggcaaaaaagttatcatgaatatccaaaatgcaaaacaaagccatcatcattgttcacaattttaggaaatatttgcagtgtggtgttatgcccgtgtattgcattgcagatgcttaacaaactcccaaatttgcatcacaagctctttcctttgtcaaagcttattgattatttatgtaagaaaattcagcagacaataccctccaggcctccacgcagaatatatgtcaagttgtcaacaaaatggaactagtgcagaacagaatgaaaagggaagaaattgcttgcatcatagacaccataattcgtaccgtatgcactggtgtccaacgctcactcgcaagctcataaccattgggatcatcaccaggcggatgaagaatagaaatgcatacacgtccatccggataaactggcaattgaccaatattatgctgtgttaaaattatggatcatggagttacagaaacatgaagttacaatgaggaaagctgaccatttggatgccacatttctgaggtaaatctgacagttggaggactgttaggataattctgtggaaagctcattattgcattaaagtaacctccatcactgaaaataaatgtcattgtcacaaggcagtttgagaaagaacagtttagatcatcaagctaacagcccaaacaccaaagatgaatagatgacaaatcagcaagcacatgaaaagggctctatatctgaaataaggactgttatcagttaccacttactagaagtttaaaccatagtagctaactcattttgagctcatatcaaatgtttacacatttgagattctggaccatggaacaagcaaaccagtaaattcgtttaatgtgtaaagaatccttctgtccaagccaagaaaacaccaaagagcgcattatttgaaagtagaaaatatattgaacgcatatgcaagctccctgacaagagtgcacgattccattttaagcttaccgagactattctttagttttctttcaaataactagctgggtggcccgcgcaattgcgcggctagcatccgtacaaaactatctatcttttacatatgattttacttaaaatttgttaaacaactatctcgttgtcttgggacattggaccgaaccttatcatctcggtgtttctacttttatagtttataagagtcacgtcggtcgctaccacttactcctttgtcacatctccgttatttgcttgctcgatctactattgcttctattcattctccttagaaccttaaaaattatatcttgtagtttttagagtttattggcttgtttggtttcatttttataatatttagaagttccgtcaaatgctgccaatgtacttctctacggccagtccactatcctctctttattaacattgggattttaaaaatcgaacataattatctagaaagtcccgtcaaacgctaccattgtactcctctacggcccgtccactgcctcatctctttattaatattgggattttaaaattcgaacataattatctaagaagtcccgccaaacctttagcggctttgccaatgtactcctctacggctcgtccactgcttcccctctttgttattattgatattttaaaatttaaacatgattatcattggagtttatttgttaatttctagaaatcctgccaaaccatcaacggctttgccactgtactcttctatggctcgcccgctgcctcccctcaaacgttgtgacagtgctacttaacaacatgtctgtgttcctcctcttaatcttaattgggattctatttggagttctgtttataatttttagatgtaccatcaaccgtcatctactactttacaggcatgttgtttctcctttttattatcatttgtcatcattgtattctagatggacttttttttttgaaaattctatattctttattctggcattttatttataaattgtattcctgcatgaactcttctataatttttagaagtcctgttaaacaccgccactgtactcctttatggggtgcccactgcctcttctctttattttcattgggattttaaaaaaacaaacataattatcgtgttagttcagcttttactttctagaagttccgccaatccgttaatggctttgccaatgtactcatctacagctcgcctgttgcctcccctctttattgtttttgatattttaaaaattgtacatgattatcattgggtttattttttgtttctttctagaagtccagccaaccgctataaccataccgcataacgatctatccatcgttccccctcttaatcctcattgggattctatttgggttttttttcaaatttgtagatgtcccatcaaccgtcaccactcaatttctttacaggcatgaccatgatccaactgcttatattttttaatccgagaatttgtaagtcttgagagcaaacgtagagacttctttttacattactttattaaaataatagatagaatattttatttatataaaactacatcgatcaatatacaccattaaaatttagatcctttaaatacttcactttttattattaatatggtgatttccgccgcttctcagcattgccccattctcggagtatgagctataacatatggaccctaaatacagagaaagctattagggaatcttgttactaagaattttattttaaaaaaacatattgtctctaaagattatgcgatagtgcaaaacttgaatgtggttgaaggagtttggatgcccagttgttttgtctcccctacacatgattttgtacaggacgtgtcacagttgtgcatatttatgatttctaattttgctatgcagacatgacgtgtttgtctcgtgtcagtaaattaagtttcctaatttgattttgatttcaaaggctactgcatagcatgcaccaaaattctagttccacgctctttcacgtgtccgattcaaaaagtcaaagagtcaagcttttacatatattttgattaaatctcaacccttatagtctagatttgttatgatctaacggtgtaggttttttctttttccccgattaatgtgaaaatttctagcctccacggtgaacgtggtgccttcttttcgagctgtcttaataatataatagatgtggtgttgtagtttgcaactagtaaccacactcattactccatctattacataattaaaacagcagtatggcaattgtaattttacaaataaacctgaaagatgcatagcaaatgcgattgtatatctaatagtctatccccattgcattggaaattcagctagttttaattatgtcacatgcaggttgagttgaacctactgccagttcttcgggttcctttcctaaaacagcatccctgtacctttatgttaatccatttatcactcattagattggactattgtatttccagcatgtggtccaatagtgcaaactagctgctctggacggatttctggattttaaacataaattctacgaaagaaaaatccattcatgcaccaaacaccagatgaaattagaatgtaacttggttgatacatcggtactacttgaaacaagagtgaaaaacttgccaggtcaattaccggcaagaaagcactaataaataagctgaagcatatcttccccaaaattttatgagggcataaactcttacattgagaacatgagctgcccagtttatccccattaatagaaaaacacagtcagtctaatcgatacataggtttccatttccatgatgtagtttaagaatctgaccccagactgtcatgaacctttacccacacatatgcatatagaaatatgcgcaatctaaatgtgaacatgcaaactgccaccacttcaacaaacccatcctgcaaaacgagctacccatgcctcatccacacatccagttcaaaccaaactcattgaaatgggcatcaaccatgaaagctagtcgtaggactgtggtagctatgcaaaccttccaagaacctaaaatcatcgcaaaattcaatcggaagccaacctcaagccacggttagaaacgaattcaagattctgcctccaattcgcgggtatacacgaaaaaactccactcgcatggcatgaacacggatgaggcagatgattcatggaagcatgcatcgaattggagagagaatccaactcactatagggtgtcaggcgggccgatgattgtgacctgccactcgaagacgttgctgtcgtcgactaacccagccgagaacccatccacggggtgcttcgcgagatctgcaccaatcaccaaaccacaaacccaaccccgaaatcgatcaatccacggatgaaaaaaaaggggcgcaaacagaacaccgacgaacgaggacgaagcgagccgcatggatccgcacctttcagctgcttctgcaggaggaggctcgcctggctgatggtagccgccatgagatcggcgtggctagggtttttgcggcgggcgcaggagaataattctcggcctctgcaggaagcggcgacgcgaatcgataggcgccgtggggcgccttatttatagagagacggaggaggcgacgaggagagctcggcgagatgaatcaggaaaggaagaaggagagagaggacgataagggaaggaaagagggagaaaatgtggagcagcagagcaggcggataaaatgggaagcaccgttttgggtaaagggcttttcggttgtttaaccgtttaactatgatgatgttttttgtgtactatttcagagcaagtaataattcttttagataagcttttgtagtaattcaaagctagtcagattctgcagcatcacgcaaacgatcgtgtagctttgacatttcgtaattccgtccattctcgaatgctctccgagcaggcccagaatgcaggattgtagtaccacgcatctgtcaactgcttcggattcatcgccatgtacgcgcatcccggggggaatggccgacatgccgcttgtgccattgaacagagtccacgagcgaaggatggacacggtatggcgcccgcggccagttgacgaatcgagcgaagcgcgagcgcggaggggagcaccccctggacgctgccgttcgcggtttggagcacgcgacaccgagtggtaaaccgtaaacgcgaaaactgaacgagtgagccgacaagatttgggggggcgtaggcagtcacgtcgggttcccccgcccgtcggtttggctgcgatatgacgagtcagccgccgatcgaccgcctgtgctgtgcggtgccgtgcggtgatttccccccgcggcaaccgacgcgcaccaagaacagagcgtacgcagctcggattgaacggtgaatcggtgatcggcttggttgccgcaggtagaggggacccatgtcaccactcacccgccgtctcacgctcgcccacgcgaattgctcggtcgaacattggcgggaggcgagctcatcgtggtggtcaacaggctttcgaaagattcccgtcctgatatctcctttcacagatacgctcatactcaattacgcaagcacagcaagtagaccgtggttcctacatgtgtcttatacacacacgtttagagcaagtataatagtgagtataagcctactataaacttacgtggagaagagatgtaacaaaatattaagagtgttggctcttatgcaagagctagcttaacacaatttcaaaaataaatacattaatgcatataagtgtaagatagagaaagtagaagaaaattatagttaacattataactaatctactatatatgttggctttaaaataagataatagtagaaattgagctatactattcttgctcttacccgcatctagcatctaagtagatgcatagggtagacggatataaaacaatcacgcacaacaaagaaggacaccgcttttgcacccaaaaggaaagaacgagacccaccaccactcgtccactgggggctacgaaacctacaaattcggcacccactttccgtcccgagagacgcgataggacgggctgttgatttcccggaccccggacggtcccgcgcgactcccaccacccgcttcccttccctggtccactccagtactccaccaccaccacccaaggaacgcgcgatagcgagcggatctcgccctcgccttcgggtcctcgcgatcgtatcgcatcgcatcgcatccccgcccgcgcgcgaggcggagtcgcacgcgcgttcccgcgccaccaatagtgcggtcaggaacctgatgacctcgcggctgacgcgccgggacggcgcacacgctgacccgacccggcggagaggccattcgcccccaaattggcctctgtttcccgcaatccttttgctgtttcggggaatcgtttgccgtgccggggaaagccggcgtcgctctcatctcttgctggtgcaagtcgctgttttcttcgtcaggataacgatggatctactgtttcgtaggcttggccttttcttaaccctgcatgtagcggcaacaccccccgctgataatggtatggacgatgtaggcgggagctggagaggacacatgaacagcaaagagcgtttcaattctttccaccacatctgcacagttgcacgcgatggggaccgtcaggtatggcgtgttgacaacgagcgttttaattcgacaacatatctggcgatgacaacggagagcgccatacgaccaacaagtcaacaactcatattaatgcatcgagatcaaaacatgtttactttgttgctaataattaatcttttcgaattttggtagtattttatgggtcaaatttggagccttgccatattttggtggagtttttgtgaaagaaaacttatggaattatcaacttttagtaagtcggtaatggtaaggctatatttagtttattataaaaaacagaaatactagaagaaatactagaatgcaataatatagtttatgttgctgacgtcatgtttggcaccagatctattccattccgaaatggtatagcgttccctagtaactctataagaaaattggtagatttacaattgacaaaaaaataaatttgacacttgcatggaacccttagaagacgaaactataggcttccgttgcagccacactacgttatgtctaaagagaaacaagcctggcccattctacggcttcgtacgaacatgggaacatgtccctcgttgtcaccaaattacagaatcgtctctcaaccaaaaaatctgatatatggcatccctcaacttacaaaatcgggttactctaggcctttaggcgatattgaccccctattttatccgatatggcagctgagttagatgggacccacgtgggcccttcacgtcagcagctcaatattctctcccctctttcccatccaatcctcattcctctctttagggccagcaacgggtggggtggcggttagcaggagaggcgcacctctcacaccgactggtgggaagatactcgatggcagcggtgggtagggtacacaagcgtggcacgaggcgtgggatgagagccacgtgtcgatgctccagtggcagtagtcccccgctcagttccgggtgcgggcggtcgacgtcaatgcagatgatgtcgaactgcaatctttcatctcctgcgtgttccgcgtcatcacgagagaggagcgcggcatcgaggactcctcttttggggacgtcgtcgacaggtcgatgaccagtgttcagaactgcacgtgggacgcaaatggagtcagaaacgacaaaagatgcggggttggagtcgggggagagggggccgtgctagtagaggaggaaaaggccgaggtgggagccgtagatctagaagtggtagaggtcagggacgaagtcgagggagaggtgtggcaaggaggcggtgagtggctcgaagacatggagggtatgtttcggtttctcctgtaaagcatggaaaggaggcttctatcggtaatcaccagagcacgctagtggaaattatgagaggcgcacggcagccagtggggagaggccgccgcagctgtgtggagtccattgtcgtgccacgcgtgtctaccccgctcgtcgctggccaccgcatgcttctccctgccggccaccaccccttgcccctccccagccacgttggagagaagtaggataggaaaagagggggagaagattaaggtgctaacatgtgggggccatgtgaggctcacgttggctcagctgtcatgtcggacaaaaccgaggtcaataccgcctaaagatcgagggttacccggttttataagatgagggatatatacaggggcagatcaatttgtggggggagggggggctcaattacgcagtttcttcaacttccagccatttaggaacctttaatttatcattcatggtgaaaaaatcgaaaggggtgctccagggatatccatgggtcttgtgggtttaggggggactcaagttccccctgcacccacgttggatccgcccgtggatatatatatatatatatatatatatatatatatatatatatatatatatatatatatatatatatatttcggttaagggatgatattataattcggtgacaagatgagggacctttgatgtactttttcgtacgaacatgtgatggcatctctatcatgggcctttcgttattcatcaaacatcaaaagcccatcagattcgacgtctgaaaccagcaaatatgtttttgctagacccagcagcatttcgaatccgcttttttattttcaaagatcgagctccgcatcatctcctcatgataatctagtggtgcacagtggatagctaacggctgcctcaaggctcaagccctcgacaatccgtttgctaatggcactactcactgtgcttatcccatttcatggacactagtgacttgcggctgcctgataccaatgtaaagtgtaagctactagtggtacactttgctacaggaaaaagagtgctgccttagacactagcaagtcacgccatgcttaacctttcacctcttcccacgcactaccttagacactagcaagtctagttgtacagctccctactagcttcaattcatctatagtcaatctaatagccaattcatacaataattgtttactatactattaatatatggtcccacctgtcatacacacagtgtgtcttggagtccgtgctgcagctagctacagatctgtaacccgctgctcttctctctcatcgtttatatcattaaaatatatttatagctggctaatagcctgctattgtacctgctcttagagcaagtttaataatagagccaactatgagcttatagcttatattagagttaacatgtatagtaaatgagctataagattatctctttttttctcctcctctctctatctctcacctgtgcatttaatgtatttatcttgaagtatgtgaaaagctagctcttgcatgaaagccaaccctctccatttttcaaattctctttcctccacataagcttatagttggcttatagcctactattatacttgctcatagagcaagtttaatagtatagccaactactagctccaattcatctatagccaatctaatagctcattcatacaatagttacatactacactattaataactggtcccacatgtcatacacacactgcatcttgaagttcgtactacagttggctacaaatctgtagcccactgctcttctctctccttatttatcttcttaaaatatgtttgcagctggcttatagcctgctattgtacatgctcttaaagctgaccctcaccatcaacttgaaaagaggatggaccaagcttatacacttgtttgatcaatccaatgtttggagaccagggttcatcagatcatgatactagggtgattattcgggtttcaaaagagagcacaacgctaccctctttaatttcttatcctaaacaaactatcaatacgtaaagcagtaggatgtatggctccatgctaccatccatcagattttaaatctttctttcatcaggtactaggaaataaatcgtgattgggttgtatacatccaattggatgtaaaggccaggtttatcccattgtgtaaaaaaaggatttaaattgtgatatcgacaaacatgattacattcatccttgttgcaagctggaagctctactttccttagtaaaaacacattggctatttgttcagaaggtgccaattattgtgtcaaatgttgttggtgttccatatttcaagtaaaatgaggctaacaaaattttagaaatgtgcatatgtgatgtagggctagtaggagtagactaggggtctaggaccagccaaaattactgcagagaggcgccaaagacgcagagaaacaatccaatgcgctacctgaaaaggcagagcggcagcgccaatgggcaagaaaagtttaaaaggagaaaggtataagacgagcccgttaccagaagcagagccagagagaaggggcatacagggaaagggtctggggcttggggtactccttgagttggtgccgtgccattttactgcatctcgcgtgccagtaacgtggtacttttttttaaagtgaaaaaccgattaggagattgcgccttttcagcaatctatggtacttatgtttagggactaaactagtctctctcaaagacttaaaaatttatgtttttaagagagcggctaaagtttagccctgcatagaactatagaagtactattcaaggttgcggcagccggcagtcgagtccagagatggtggcggagataaggacgtgcatttcagaatttcagtgagaacatgcaagttcaaaccaaactcaaattactatatgtatatttacaattaaatttattatttttgttacgacttgtaaaagttgaatttgaatttgcatgtttgtggagtgatatattacatgttgatctatcttgtcaattttttcgaaagtttttcataaccatttagatgacatgcaataaacgggtgaacgtccattcgaactgttaaaacagtttccaatagtggagcatgtttgtaaacatctgaacacactaggaacatgttatttcaggctggaaacctggcagtaacaccattacagtcacagacatccctgcagccaacacaagcagcagcacaccgattacgggctaatcgaacgtaagtaacgactccagcatctaaacccgcgagctaatcgaacattagaacacagtcacagacaccccggaagggatcctaccgagtacgccttggcgcgctggattctagtggcagaagatgaccttgagctcgcgcggcgcggcgcactcgtgggtgagcgacgggctgtcgtgcgcgtaggtgaaggcctgcgggcactcgcgcttgaagaactccgagtacttggacgagcggcaggtgcgcgggctgttgtacatgttgcggcagcagagctcgtcggtgcggaaggcctcgcagccgctcttgcacgccacgacgctccccgccggcgtgcgcagctgcagctcgctggggcaggtctcggtcaggttcttgcggcacgccagcacggggcagttgccccggccctcgtgcggggtcaccgacagcccgacgttgaagccgtccaccacgctcacgccgtaggaggtctggtcgttgccgtggtggagggagacctgcgccagcgtcgcgggcgccgcgccgccgaggcccgcgcactggagccgcccgccgcagtcgcccgtggcgcagtggagctgcgcgccggcgccagtgcagcccgtgcgcgcccagatgcggccggaccaagggtgggccggcgcggcgaaggagcggtgggagagcgccgggaggaagaagccgccgccctcgaggacgtcgtggccggagttggcctggattcctggccacaccgggtatgggcagttgttcacgatggtcagcgtcatcggcgcgtagtcggcgaggatgacgccgcagctcaggagcgaggtggcgaccaggagaagcagcttggcagaagccatggcggcgagctgaccaggtctcgagctaatgagcagactgtgatggagtggtggtggtggtggtgataggtcaggggttttagggggtttttataggcgacgtggtgccattgttgttgtcgtggtttggcatgtccaagtataacacagagggaaggtggcttgtttttttgtggagaacttctaaattctgaatgggtttatcaaaacttggaaaaactatttgcattttcatgactcaggacttatcttcttggaatggtatcattcgagaaggttatctcgaagttacctatccttaaacttcttttctcaaagcagcttttcacaaacaatccgagcaaatgcaaagctagcatcgggccattttacacctagcgggaagaaaacggtaataatccgcgagaaccgagggtagtggccggccggtgttgccttcctggcaataatcctatagcaaggcacctccacctccatggaccatcatggcccatgccaatatggcaatgcggtatttttcttcgtgacctgtggataagcatggcagacagagacacagacataggactggcattgggcaaacaagggtagtccactggattggatacgagggaggagacgtaccagctttctcacacactgttcttccgttgttctccacctcgggttccctggcgctccaggggaatctgccaagagcaatacgcctgcgacgtggacgatatcatgccatcgtgctgaaagcctgaacaccgggatcgctttcgctttgtttttgctttttactgccttttcggttcttttttcacattgagccgtgtactcctctgcccccacatgttatcctagtgctccccctgtcaggctactacactttgttactccccatcttagcgcggattgcagtttaatttgacgctaactttcaaaaactctcgctttcattctgatgtttacttggacgcatgctggctgggtagcccttggtggcttcgtccatgtcggtctgagtaaggtggtatttggttggaggaactaaagtagggctaaactttaatccctttcacaaaaatttagtctctagttcccaaacaccccttaagactagacgctgtacgtatatctcgtcggctaatgaaactcccgtactcaagtcctttgccttcgcaagccccgcggggttcatctgttcggatctgaattgttcgaaacgacatagcccatgtgcttgttggtaatgtcgggagtggtcacccggattgagtgatgctaccactaggagctgaaatggcactgctcggtatctgtaaaaactgggcagcatgaagcgcgctccaagaagaaacttgttaccaggctgccagctactgaacctgagcggtaggggtgccgacagaggaatgccgtgctactgacaccgtgcgtgcgagtcctccaagtaaacagcacccggcggaggcttccgtcgtgcgcggtgcgggatcggaggacgaggtccggcggcgtttgtgtttcgcgcaccgcacggccggccggccagagctgggccgtggtgcatacggttcctaatcaacaccgtagatttgttcgtttatccgcttggactctcctaaccggctaaccgtccctctcagccgtaaaaccggatataactacaccttcaactattattaaaatcgtttaaaatgtctctctcagttgttttgagagcggtttttgctaacataatatccaagtggtaacccagacatcaaatgtattgaaaaataaagtgggatccatatatgaattaaatttgaaaatatattgttcattcaatttttctcaggaatattcgggatgtaaaaacttgtgcaaaaatataccgtcggtgtcgcagaaccgttgcgtgaaaatgacatgcgaatgatgtcgcggacggtatcgcgcggtctcgcgcggcaacgacgcgagaccgcgcgtgtcagggttatggataccacatacctaatagtagttgactaagtctcggcaggacccaccacataccatatcctatacggaaacaacctgcggatataggagtagttccggataaggaaagacaaccagagttctatatggaacgacaaggactactcggattgtatccatattggtttccctagttctacttggacaaggggacacctatgtgtataaatacaagaccccctatgaggagaggggacacacccaacacaatcaacatacacggaacaacagaagccacaacatacaagccaacatacgctaagacaagccgccggatatcgacttcacggataagcacggctagtcccctacggtgtctctgaatactatcaggagagacgaaagcgttatctctgatctcgccggacacggattcgaggaggaagactaccctattattgactacgagtcaaaccttcagaccgccatgtcgacaacagttagataggctaccccaaatattgtactggtgtgattatggtgaataagatcaacgaccggcttcggccaacaggatgtagggttgttacctgacaattcaggggcccaaacctgtataaaaatcatcgtctctgtctcttttacctcagtctcgcgtataccctagcaccaacgatccccatactatgcaaataccggaatcgcgacatcaaacgtcgacagtagcgcgccaggtagggggattttggtgcttcaggatttcgacgggatgggtttaagagatggattctccgatgataagctactcgacgacttcagctgagggggagatctaacctaaccagatcggaaccatcatcgtcatcgacaacttggtctatcgaaaccatccaagtctcaagcttcgcggcgtaccaaaaaatgtcagatcatatgatgtcgaacgagtacgcaacaaggtaattggtagattggttttttaaattgatctactaatttcgtagatacatccagcatgtatctacaaaggtacgcaatattttatatgcaatttatcgtacctatttttccaatctatacaatattgtcagatctataatttattatgttttcctagagcatgtcttttatacaatatctgttgcgcgagtgtccccgatgttaaatcgactacggtctaatgctaggggctcgctctattttcttctgtataaatcatgcttgtttatggtttacataatgcctgatatttacatctgctcgttatgtcctgataatgctagaagatccatgcagttttttggagtacataatcgatattctctgctatattttgtcttctagaaattatttttcaggaacaattgagcactcgagtaggttgtggtcgagtacacccccttgtcgaggacgttctcgataaggctgagtcgtcgcacccaacttaccaatgaagaccgacgatctatctcatagcaccggccatggccggactactcgagaaaaggttgttaacggataattcctcgcgaacgtcgtcggcttgatcacctgacatgattgcgaacggacatctggatatactacaagttgggtgtgtgagtcatgctggccacatgagacgcacatgtaataaaccaactctagcacctccattggtgttcgagagataattctacacgttcgctggtcctcgaaccagtacgtagcaatctctcgcaccgcaacctccattgatgttcgagagataattctacacgttcgctgttcctcgaaccactacgtagcactctctcgcaccgcaacctccattgatgttcgagagataattctacacgttcgctggtcctcgaaccagtacgtagcaatctctcgcaccgcaacctccattggtgttcgagagatgattctacacgttcgctggtcctcgaaccagtacgtagcaatctttcgcaccacaacctcggatggtcgaggtacgactacagcaataacgcagcggtcctcgtaccacgacttcaaatgatcgagagacacctactcattggttctcaaccagtcaatcgtagcgatctctcgtacatttacttctagtggttgagttacgactactacttggttcttgaccagaggtgtagcgattctcccattacctctacttcaacaaagttgatatcaggtacacaatatcgccaagtgttttacccagagatcccttaccacaaaagacacctagagttgaaacctattctcatgtccctttacgccgtcttgacaaggcctccgaggaacctaagggaacttcggctggggacgcccagagctgataaggccttgtcggatccttcagagacgaaagaaccatgtaagatctggtcgtgtaagagttctcaccgtgcgtattaaccaagccgtgtaatcggaaatggattttccaacttcacggctgggggctaggatcagtgcttgttcaaccgaggcaggtcaaaggtccaagagccttatcctccgagaagaattctccgacgacaaggctgggggctagggagagtgtataactcaaaaaaccgactgatcgaagtcggaaaagagtagacgctcatatacaaaacattggtatgtaaatttaattcattatcagttttctatacattctataacatgttaccctttgagcgttcgctcgggggctatttctatctaatattcttttctgagtattgatttcaggaaaattctactcgacattgtcaaagacttcatgtctctctggttgtacaccaagatcgactaaggcgagtacggcaaatgttgacaaggctccgtcgcagactctacgcctactcgattactcgagaacggttggtggatctcgacaaggaatgcggaatgaagagatgttgtacccgccgagataaaatttcttgacttcaatccaaattctcgattacagcaagacgtgagacttagtcgtatgctctgtactttcttggttgacatcggagattgactcagacaaaccctttaggtgcccgcacgaggctgataaaggaagtctaacgttatctccaaactcaccgaaaacggtcacatgagctcgataacagttactccaaggcctgcacgcggttgagaatatgaattcgttcatttgcattgaagtcaggggctactgtcagggttatggataccacatacctaatagcagttgactaaatctcggcaggacccaccatataccatgtcctatacggaaacaacatgcggatataggaggagtttcggataaggaaagacaaccagagttttacatggaaacgacaaggactactcggattgtacccatattggtttccctggttctacttggacaaggggacacctatgagtataaatacaaggccccctaggaggagaggggacacacccaacacaatcatcatacacggaacaacagaagccacaacatacaagccaacatacgccaagacaagccgctggatatcgacttcagggataagcacggctagtcccctacggtgtctccggatactgtcaggagagacgaaagtgttatctctgatcttgccgggcacagattcgaggaggaagactaccctgttatcgactacgagtcagaccttcagatcgccatgttgataacagttagataggctaccccaaatattatactggtgtgattatggtgaataagatcaacgaccggctttggccaacaggatgtaggattgttacctgacaattcaggggcccgaacctgtataaaaatcttcgtctctatctcttttacctcagtctcgcgtataccctagcaccaacgatccccatactatgcaaatatcggaattgcgacatcaaacgtcgacagcgcggtctcgcggatcgctcaagcaaccagtgacactgtccgatgggctccatttgattagtaattaattacttaattaaaaattaattagtaataataagtgattaattatcctgacgctaattaaatcgacaaggcacggtatcgctgtttgcttgagcggtctcactgattgattgagcgagaccgttcacgcgcgataccgcgcggtctcnnnnnnnnnnnnnnnnnnnnnnnncgcaacatcttttccgcgtcattttcgtgcaacggttgtgcgagactgatggtatatttgtgcaaaagattttacatcccggatatttctaacaaaaaatgaatgaacaatatattttcaaatttaattcggatcaatatatcatcttctttctctactaacgtctctttccccatttcttcttcttgacacccagtgtagcaggacgacagctgacagtagcagaatggtaggacaacaatgggtaacaacagcgatagtggtgggctctcctctctctccccgaccccttctgcactagcttgccacggggaggtacttccaccccctcccttagcgacaccatcaaaccaaaacagcatgtggtccctcaattacacaacaatggagctgctcatcgggaagtagacgtggtcagagctcgcaacacctgcgaggttggcaagctgctcttcctcatcgggttcgacgggaagacccctaagctccctgtcggtgacatgggaccggggatatcttgactagaggtttggggcagccgcggtcacccgcttggcctgaccccctcggggggggggggggggggtcgggcccgagggtgatgaggccgcccctccctctatctccccgaggggtcgggccgctcccgtttcgaccccccgagggctgggacgccccgaccccctgggggtttggcgccacgtgtgtgggttaggtgagcacagcggcgctcacctaaccgcgtttattgcgggttggacgagcgcctcacgccgcatttaatgcagcgtagcgcatgcttatccggtccgtgatcggtcgcagtgtgtgaccggtcacagaccggtcagatcgcgggttagggggcaacaggcggcctgacacacgcctcgccccatcccgtcggaatgatgagagcctccaggcactcgtccctagccggagccggcatgggaactcctggagttggcacgtcagccccggtcagatacattccaggcttcatcgcaaccattgcaaggaagtcgttgtatgaagaagggcagacgtgtagcatgctaaactgacacgtggaggacaagaatgaccggtctgtgactggtctgacgccggtcgcgtcatcagcaaacaaccgtgcttccacgttgcacctgcttccagcggagtggaggttggtatgacccatcccatcggagggtcattcggacagcagccattgcaaatctccgcccattaatgagggaggacagggttatcccggtgtcagacaaaggtacaagccaagttttggtcaaagtaggatgggtccccacccaaaaggagggtaggtagaaatggtgtatgtggtatccccttgagatataaaaggaggaccatgcctaccaaagggggaaagaaaaaaaagaaaagggggaaggggacctgagctggtagactggagaaaggaggagtgagaggggctctagagtttgaactctcttgctctccagctctttgtaactccttcatacacagatccaccagaacacaggagtagggtattacgcttctcagcggcccgaacctgtctacatcgcccgtgtcttgcgcatttactctctcgcgaaccattccacagatcaagggcttagaacctcacttagcacccccggccgaaccggcaaaggggggcctgcgcggtctcccggtgaggagccccacgctccgtcactcccagtgtgcgtctctgactcgtgccgcgacttcctcaacaagtgcctccaccgtgacgccggcaagcgatggagctgcgatgagttggtgcaccaccccttcctctcctccacggacacccatgacgctggcaagccatcgcccctccccctacctccccccgccccaccccaagccgttcttggctgggggcaaccatgtcggatttcgacttcggcgacttagacgacatggaggcgcacaacaagcgtgaggtgatggtgcatgccaaggaaaggctagtggagtgggcatcaaatgcaagcgcggcggggggggggggggggcgcgttgtcaccgccattgtgttgaagccggctagaaggaagggccgaatcccgaattgggaagaggaaggagatcgagaggggtaagggtagaagagagagaatgacacgtgggctccacattcttaattggtggaagggccaagttaacgtgccaagccagtgaaaaacaccatgaaaactgttaagggagtcaaattgcatcgattttaatagttggagggtcaagatatctgatattactgttgagggatgcgaataagatccgaccactaattaagggtgtcaaagtggacttattattttatcggctggtttattttgggccgcgaaaaagtgggtgttggttgtccatctgggcagaggcctgctatgtttgggttttggtctactcttagtccattacgcttttcgaggccctcgtgcacgagcatattctcaggcccatctaaaaattgcccgaccaacggttgggctgcgggcgtgatagaagtccacagaacaaacccgttaactgtagaacatactggactgttcaacgtcacggagggcagggtctcaccaactcgcgtcacccgccgacgaccccactctcccctcctggcgctggcggtggcctctgcgtaccatccagacccttccagaactcccatccgatctcaatccaacgtcccagattggcgcaccccgaacattctcgaaacaccttcaaccccaataaaaccactccccctcgcctccgtcccccaactctttgcaaaagaattccgagctcgcaaggcgaagaaatctcgcaacaatctcatcagatctcgagatctcatcaggtttggtttgttcccgtcggatttttcttttccactgttcgatcttcctgttcgtgcgagatggcgaagggagagggcccggcgatcggcatcgacctcggcaccacctactcgtgcgtcggcgtgtggcagcacgaccgggtggagatcatcgccaacgaccaggggaaccgcaccacgccgtcgtatgtcgcgttcaccgactccgagcggctcatcggcgacgccgccaagaaccaggtcgccatgaaccccatcaacaccgtcttcggtacgtgctcctgctatttcttccttttttttttgagctatcgttgttactagtccttttgcacgctctagttcgaatctagattgaactgtcatctggatggctggatgcattcgttattaagatgttcctgggttgcgctgatgttgatttcactccgaaacgaagacaaacattgtatctgtgctctgtttgggtgtgctaaattgctaatctcataaaaccaaagaataatgattatattaaacaagtatcatgcatttactacaactctcagggtctgtacttgaatggttgaacattgaaattgataggagttgctagttgtcaagaaattgataggagctgctaattgtcaagagattgaactgaacaatttaaacattgtatctatgctctgtttgggtgtgctaaattgctaatctcataaaaccaaagaataaggattatattaaacaagtatcatgcatttactgcaactctcagggtctgtacttgaatggttgaacattgaaattgataggagttgctagttgtcaagagattgaattgaacagtttgctagttgtacatgttacattttgttgcagtggtgcattttgttctatggaattttcgtctggaaattctgcttgttggctagttagtaatgcggtggtaaatcacagggagtaggcaactcatattctcgtggaatttgctttgagcgaaatatatacccacaatttgtttcgagtacattgcttactgattataaattaagctggctttactgcttgtgtgcctgctgtactctgctttagttataagctgaattttcatatgaattcaattgaacaatctgactcataatctcgttcgtcttgaaattctgcttgttggctagttagtaatgcggtggtaaatcacagggagtaggcaactcatattctcgtggaatttgctttgagcgaaatatatacccacaatttgtattagtacattgcttactgattgataaattaagctagctttactgcttgtcatgcctgctgtactctgctttacctgtaagatgaatttttaagctggctttactgcttgtcatgcctgctgtgctctgctttacctgtaagctgaattttcatatgaattcaattgaacaatctgactcataatctcgttcaattttgaatgcagatgccaagcgactgataggtaggcggttctccgacccgtccgtgcagagtgacatgaagctgtggccgttcaaggtcatccctggccccggcgataagcctatgattgtggtgcagtacaagggcgaggagaagcagttctccgccgaggagatctcctccatggtgctcatcaagatgagggagatcgctgaagcctacctcggctccaacatcaagaacgccgtggtgactgtgccggcctacttcaacgactcgcagaggcaggccaccaaggacgccggtgtcattgccggcctcaacgtgatgcgcatcatcaacgagcccaccgccgcggccatcgcctacggtcttgacaagaaggccaccagctccggcgagaagaacgtgctcatcttcgatcttggcggtggcacgttcgatgtgtcgctgctcaccattgaggagggcattttcgaggtgaaggccactgctggtgacactcaccttggtggtgaggacttcgacaaccgcatggtgaaccatttcgtcctggagttcaagcgcaagaacaagaaggacatcagcggcaacccgcgtgctctgcgccggctgcgcacggcctgcgagcgcgccaagcgcacgctgtcgtcgaccgcacagaccaccattgagatcgactccctgtacgagggcatcgacttctactcgaccatcaccagggctcgcttcgaggagctcaacatggacctgttccgcaagtgcatggagccggtggagaagtgcctgcgcgacgccaagatggacaagagcagcgtgcacgacgtcgtgctcgtcggcggctccacccgcatccccaaggtgcagcagctgcttcaggacttcttcaacggcaaggagctgtgcaagagcatcaaccccgacgaggccgtggcatacggcgccgctgttcaggccgtcattctcagcggcgagggcaacgagaaggtgcaggacctgcttctgctcgacgtcacgccggtgtcgctggggctcgagacagcaggaggtgtcatgaccgtgctcatcccgaggaacaccaccatccccaccaagaaggagcaggtgttctcgacctactccgacaatcagcctggcgtcctgatccaggtgtacgagggtgagcgtgcccggaccaaggacaacaacctgctgggcaagttcgagctctccggcatccctccagctccccgcggcgtgccccagatcaccgtctgctttgacatcgacgccaatggcatcctcaacgtctctgccgaggacaagaccaccgggcagaagaacaagatcaccatcaccaacgacaagggcaggctgagcaaggaggagatcgagaagatggtgcaggaggcggagaagtacaaggcggaggacgaggagcacaagaagaaggtggacgccaagaacgcgctcgagaactacgcctacaacatgaggaacaccatcaaggacgacaagatcgcctccaagctctcggcggacgacaagaagaagatcgaggacgccatcgacggcgccatcaactggctcgacagcaaccagctcgcggaggcggacgagttcgaggacaagatgaaggagctggagagcatctgcaaccccatcatcgcgaagatgtaccagggcgccggcgcggacatgggcggcgccgctggcatggacgaggacgcgccggcgggtggcagcggtgcaggccccaagatcgaggaggtcgattaagctggtggtggtcctacgtgattccggctggaagggagtctgaaccgtgtgatgtggctggcgtcgtgtgatcccctgtgttttttagccgtcgagagtttcgtgcgatgaagcttttgtaagtgtgtatcgccgtatggttttacctgaacttgctctgaaatagtttaagctttgacctaaatcgctctgtctctctctttttgtgcggcttgcggcttgcctgcttcacgagttcgttcggtcgcagtttcagacagaggattagccgcaagtttgttctattgcccttatcttttcgtcagacaaagttaaagttggtgggatgcaatgactagcgagttctgtcttcttttttttttttccattcttcctcacactgaggattagccagttgctactgttttctttacctttattcctcaaaacaggaccaattttgagacgctgttttcttttcctttattcttcaaaacaggatcaaatcaatcttttgcggctgcgaccaacacaaatgaattcagcttcttttgatatgcaacgcaattctgccctgacctgattgacccaaactctaggggtagggagtcatccaaattttaggagcaataggcgaattgcacgtccgtttcatgtttctaaacctaagggaaatatcaatcaaaatgccgacttgttttaggaatcgacacacaaaaaaaatctttgagattgactaagattagtgccatagtttagtttaaacaaattttgtaggcagttgtataggttttcactgctgctattcacaagttctttgccgatcaacaattcactgctgtatcagagtgtccttgacggtttgacacagctgagctaccaaatcatggttggcttctgtagtcagctgctttcgaatttgcaagcctaactggaagatgaactacttctcctttagtataatcctataaagagttgcattcagtgagttcttgggcgcgcatatactctgcagacccgcagcaatgttcaccatctcacaacctatactaccatatccaaaaagaccatctaactgctagaattcaacgtatctctgcaggagaagatcaaggcaatcctgcatatgcccattcctgtgttgattggcacatgacacatgcaactaggttcttacccaccaatcatatcttaatgctaaacaaaacacccacaatccatgatccaagaatggaatagtaattcagacaatttatttctggttaattcaacacagtacaaattctagaaaaagcaatctagccatattctacaaaggagaagagcatgagggctaaaaagacacccatcataacatactagaacaaactgagtagccttcagcagacttcgctgaagaggcctagtgcagtacgacaaatactcagaaagcaaaactcccaacacagtcatgctcataccttctcagccatgtttgggcattgatctggtggtcagaaacaagactatatggttgatagaccttccactggttatgtcaggagtagatcgttagctgcaaggtgaggggggcgcatagagactcttacttcatgttcttctggctcatttccacgtttgggaaccatgatctcaagcactgcagcggcctcatcaaagtatgcttctagcttagcgtcttcagggatgcgagttgctagaggtatttcacggacaaattccccatgagggcagtgctcaggcataggatcagcaagcttgaataccctgtcatgccttctgatgtatggcgtctgggctgtactaacacaaaggatctttactataccatgagtaagactgttcctccatgaaactttcaccttctgctgatcaacaaatggtaagctgaccattatcaagtagccttggtcatcttcataaatcgacttggcggcagtcacaggcccgcgagcctttttcatcaccccagaaaattcgtgctgccatgaaggctgcactactgaatgcatctccacatcttgttgtgtcctctcgccgcaagagttgagtggcaagaagcattcctcatccatggcatgcggaaacacctccttcctgcgcttgctgctaactggggagagatccatgccatcttctcctgagtgattggagggtgatgacaaattcaagccagatccattaagcagcttctttgggtgttgatgaacgttgcccttcatgacaggatgtggcctgtcaagctcaatctctgtgtttggcatagtcctccatgtcccaaaatcacaggcctcctgcgggattgcgaaattgagctccctccctgtaagctccacccacctcctcctgtctacctcagttatgcttgcaagatttggtgatctcaccacctcaattccatgaatacactgtgggtttgagagtccacggtagtgcttgcgctgcatccggtgtgatcgcacaaatcccctgtcaacgctgaacgggaattgcggctcaccagggcgggagtgcccgttcatgtagctcctcagctgcatcttgccaagggcattctccggccgctccttgaagacccacatgtacatgttctccatgtcgtgctgcaccatgaacatgtcgagccggagatccgtcttgtcaaaccctgacacaccgttggcatcccgggtgaccttgcctttgcacttgtccgcgagcaggggcttgaagtagaacgtgaagaagaaccaggcgccccagatgctgtccccgcgcttggcggccttgcggttcccagccttcggggcactgctcagcacggcgagcgcctcggcgtcgtacacctgaatctgcgggccgaggctgacgtcgagcatgtcgcagaggtcagtctgccacggctggttgatgtccggcggatgcgcgccggagagcgacacggcgtgggcgcgcccggcgccgtccccgatgcggggctgcaccatgaccccgacggcgcggtcgtcgaggtggccggcgggatccatggagagaagggtgcagaggctgtggtggccaccgccaccgccaccgccgccgttctccatggacagggtggtgacgaggtcttcccccatggcttggtgactcgcgcctcggggtgactggtgctaatggcgacggcctccgcctctgccaccgcctgctcctctctcctctcctctccctcctcccccggccgctatctaatcggtggcctccggatccctccgcattccaggacggcgtcccacagcaaccaatcgtgcacgcactccatgaatcccaccatcaattcccccccaacagtttccgccacaaatcttcacccagctctcctcccccccaacccaaatccacacccccaaggagaccaaaatgccgcccaaaccaaaaacagagccgccgcgcgcggtggacgatgggttagccgccgaggtttacctccaccaccatcaggagtctgtactagtgcgggggaagcgtgaagctgcgggagcaagagcgcggggaggaaggcgaggacatggggaggggaggggtgcgcggcgaggtgggagaaaaggggaagaggagattactcgtgggggcgaccgcttataatggcctctcagatccggaagcgccctccaccggatgcggccgaacacgacgacgacggcgccgcccgtcacgcctctcacgccgttagggcacaagccaaccccgtctgttttaaaccgtgattagcttagtgcaaaaaccggccaaacagactcaatctagttatctacccaaccaaacacggttaacttctcgtctcggttgttcggctttttatcacacagtgtctagacggtgaggtgatggccgggcggcgtttaacgagagctttcccggatcttccccgtgtgggtgccttttccggtgcaacagatgcgacccaccgcgcagcagcgcggccaccacccaccactatgcaacttctatttggtgggtcaggttccgcgatacttgtcccctcccctcccctctctcctccccttctcccacattgctttcagcctttcagcaaagcgcgattctttctactgctactactctacttgcgaagtttcactgcagccatcgctgtctatggattggaggcaaaggctgcgtgcttgatctactactactaccaggttgcttagccacaaaaacgaccgaaattgcgtgtcaaatcagcgtggcgttcggacatcttatcaaggttagtatctttgtggcgattcttcttcttgtggcagagggtctggtaatatcaaggttagggttgatagactcgcattgcttgccgttcatctgctgtcgatctatcgggttgtttggcgcatctgtccaaatgatttccatgtaattttttcctagatggactaactgtgataagtacaccgtatatataggaaagttttttatttgatctctaacagctgaaaaactcctgtttttgccactagaccttaaaaaaatctcctatgttttgctttcaacaatcatatattccaaacagagcgttagagcattatttagccatgataagcacacggtttcatgtttctgtggtactgctacagcgccaatagattagtactcctaagatgtcatttggcaagtgggatgcttaacatagttactcaactatatgggagcgtatcctatgcacacaggctctcgcgtgtaaaccaattaaaaattatcacaaaaaattctaggaaaattcatacatgtacgtgcaaagtcacatcttcaaattcattctacatagataataacaaaaaagataaaattctgacaaaattacaaccttaaaactgtcagattttttgtttttttgttacggctaaaatataatgaatttaacgttaagattttaaccctaggtgtaatacaattgaaagtatgtatatgattttttctagattttttggtgatattttttagttggtgtacacttgtgtacacgtgaaggcctgtgtgcataggatacgttgcccaactatatacacacaacaagagaattatttgctttggttgttgggatatcgctaggtcccaccaaggtttgaaatgtagcggcattcatgtttgacttgacgagcttatctctgtactctctagccaaggctgtttgctcgtttatttatcaaagaggaaaaactaaagcaacctatcgcatctctgatttctctcttatcatggtggttggtagagtagaacagaagtggtgggcctttgcgctaataacacaatcaacttatgatatgattaaatttgtgtcctgttattgaaagttcgtcatttgaatgtcgtaaaggtggattagattggagattggcctgttgaagctggtgcttgtctgatagcgatggttccaattccatcttagaaaaaccttgcatcatttataagttataaaccccccacaaacggctttaccactcgcatttttcctcttcttttttagtgttatatcttttgtactttaaccctactcttaatttgaacagaaaatatgcactccttcaatacttaattgtgtgagcatctattatgcttctttaaatttattctacgattagtttaatctagcgtaacaaagaaaaccacgcacacttaaccaattgtggtattttagtaaaaaaaaatcattttctcctgacgacaaaggaagaaaataaaggaatttttgcttgcttcagctttagtgggctccaatgtaggttgaaatgcatctttctcccgtcacaatcttcagtcttctcaatgcatgataatatatgattttacctctgtattacctcatcgatgacgtgtcacgtgttaccctgtaaattcccttgttagcaaggtagtaaattctgccccatataattaattagaggcctccctatccaagttgagtgaattattgtactttgtgccacaatatgcatcctcattggactatcgttcgtggatagtacatcattagtcgtctgaattataacccctaaaaacgactattaaaacgcactttctagagcgaacaagatttggtggtcccaaatatattctcaaccaaacacacggtgataactgagaaaaataccgtgcgtgagctcatcgccacatgccaagttagcaattttttttgctcataattgagcgcattatatataggccctggcaggaaaatggcggattagatgtctaatcctgtggtgggagtagcttttagggtgggttttttttttaccgcatgtatatttccctcccaaattgataaacgttgttttttgaaaaaacaaaatctatataaaagatgtttaaaaaaatcaaattaatctattttaaatttattctaactaatgcttaattaataatacgctacttaatcacttttgttttgtgtgtggggagctaaagttcacaaccttcgactacgaacgcaaccttagtccataatagtaagagctctcctccaatttgaaaccaccatagtctcgttaacctaaacaataacttaccatacgtgcaccccaagtcccagctacaacccacgtatctagttgtacaataaagaaatttgaaggttaaatacttgtacaatgatgccgacgagcttatcatcctcttgcagctatggtgttcctaggggaggttctgtcctctgtgattactccagtgaaaagtcgtctagccgattgatcggtgaacgacggtgggtgctgagctgaatcgtgcagccgtgctcagcgctcggcgccaaggctagtaaactgcacgtgtggctgtctcggctgcgcgaagtgggcaggtgttgaacagggcgacgcgcctcggcgcattgcaatatggcccaacgaccaacgtccgattccgatctctccattttgcattcgctcgatcagttcgtggcgtgtcgagattctcggctgcttgcgcgcgcggctggcagtgggggaggcgaacctttatttagttcacgttaaaattagaaatttggttgaaattggaacgatgtaatagaaaagttgaaagtttgaagaaaaaattgggaactaaacaaggtctaagggtgtgtttagttcacgctaaaattgaaagtttgattgaaattgaaacgatatgatggaaaagttggaagtttatgtgtgtagaaaagttttgatgtgatagaaaagttaaaagtttgaagaaaatattagtaactaaacccggcctaacccagaaaatttatcggcaattcggcgttcggcagcgtatcagtatcatcagttgagcacttgagcacactgattttgtcagcaatgtagtaactcggctcgtcggttggcagccggttacccgttccggcaaagcaatgcatgtttatttccacttggagatgaactatactaataaatttcagattaggaaaaaagatgttcaaagttcttccacttgggaacagaacgatttgcagttaacatttgctgctacctgtgtgccgctgactgttagtgccgggtcgccggcgagaaagtggccggagcagagcacgctgggatggacgtcgcactcgcacgacgtgctcaagcggtctctgtatcgcacacatatcacactgtgtgtggcgatggcgctcgagagtgggaaaacgacacgtcgtccactccggctaggcccgatataatttcgatgcccataattgccgctgttgccggtggttttcgttgagaagaaaaaaccccacgaatgattgcccccaaaagcgcccaatgcgaaagcgaaaagtgcaggtctctctctgaatgaacaagcccccaagcagatcgaacagacagcagcggttgcggtggtgcggtgcgtttccttccattatttcccctccttgttcttttctctcttttttgcttggtcgatctgaagtctcaactgttgccgtgttctgtttcgctctgttcagcgcacacacagatcgaacacaacaagacaagtgggaagctgtagcctgtagtattattgccggtggcgttgtccgagtttgtgagggcagcagaacggcacaaggctacggcaagtgcaagcgtgatgtggcctgcatggaagcttcagaagagagctcccccggatactagctgatgctgagcggcatagtggtgtgcactgctggtggcagtttaagttttctttgtttctcgatgcaaatggcacatgcacttcaccacgtcttctgcatttcatgactgtttctaaccggaagaaattttataagtgccatgtcttgactgacgatcatagtgactgaatttgctaaccaactgagaaaattcagaagagggcagtacaactctacgagtacactagtacactgctgcttaggtcaaagtaagacgtgattcaactgagaaattcgatttggctcggccaactggttgcaaaactcaggtctcatatgttggttcagatgcaaactgatgggttgtctgggatcagattctcaggatcctcgtttttatttttccacaagtactagcgtgtacgattaacctatcatcctgaattactgatgagcactagtagaaaacctactggcattgtagccagggccggtcctatgattttgagggtcctaggcgaattcatcacgatgggtcctctaagctatataaaaaattttatgatatatatagacactaattaattttacttgcaaaacaaatacatccatatattaaatcttaacatgtctggtaattatcgaaaaataaagttgatcaaatttgtaccttggaactaatatcactaccttaatgaagaatagaatcgcatcatatccattatttctcatgaaaagatacttctcgagcatttcttgatgcaaaatcatcaagaacaagtcgacgatgttgtgcgcttgtgcggttgtgccctgtgcgatgcgatgtcgtctgccgagttgccgacgacgctacaactcctatcgtctctcggacgtttctgcttccagatagacaataggcaggtactagactactagtattaggtgttggcccctccaccatcataggcccccgaccatcatgggcccccggcggtcgcctcggctgcatagccctagggccggccctgatcgtagcaaggtacactcacgaacaacagtagaggagagcaaaaaggccacgcgttttttttaagaaaaatgatgacactgaaacgcacgtatgactcgctcaccgggcttggaaaatttggagtgagcacaacaggcgtggcggacctctcagtagacctctcgcgaatacttgctacagtaaagttttccacttccctactcctctctctttcctccggcctaaggtggcttctcgccgatgaagaccgggaaaggggtcaagtccctcttctcctattgattcaggtttttcccgtggtctttttccttttggttctcgaggtggttgttggcgttggccgtccttgtcccggcatctgggtgagcgttgtcgggcttcttctcagaggcgatttactccatcgctgggactcttctcctgggtactacctagggcgcctccagatatgtacaaagagaggtatcgcctgcctacataaacatctccggcaaggtctttctaaggaaggggccttatgcttgatccctggcgacgaattttcacttggtggctaaaattttcaggttgcgccaagggggcctcaaccgggtacgcctcctgcctttttcacggtgaaatacatctggctgtgatctttggaatagttatggttttttaccgatttctctcaagaacaatggtgtaaatcttaattggtgttgctaatatttcattttgctcgtcaacgtcgtaacctccacgtgtgggaggcctcttcagggatcgagtaatggcgccacctcatgcaactcacctgatttcacactccaccggaagtgagctccaaatattttccatcggtgacgaagaccaaagaagaaggatttgattgttttttcaattctttttaagttttttttttgcaaattgttgggcaaaagtgtaatttgcccattcacaaggggcttcttttcaaaactggaagtgtcccagtagcactgtaacaactcatgtattttatgtttctaatctactttatataaataaatgcatgagttttaaaaaggaaaaaaatgactcgctcgccaggccttgttgcgatcatgctccatcttttcttttgctttcatgttcgtgatggccgttactcctattttctcagtggaattgtatttaggactggtgcagtagcatacacttatgttgagtctggacccacgtatcagccactgatcaatagcctacatcctattttatatggacattattgggagggtgggagtgggtggctgtgggtatggagggaagaatctctctcgcacagcgccacccaagttgaaagcttgggacaggtgcagccgcatgggtcgcgctctccgccactacgaaggagaggagtgatcaacctcagctacaccgttcaggtgctgcaaaaagcggcgtaacgtccctgcttcttgtactggctacgctgcaataattctgtactataaccacttgtcttagatctgataagatcgcgaggcctttatcactttgatctctggtcgtcatctgtcagcgacttttttctctctctctctcttttcatcttcttttctctcggaaagaccaggcttgatcaattcatgtgcatgtcttctttgcaggatagcggtccaggacattctgatattttagtgaacagaagaaagggccagttgcaaattttcccacacttaatgtattttgattttgcggggaaaaggtattttaagaaggcttttcatcactagttcactacaggaaaccagcagaaacatatcagacagtgaacggcacgaactagtagtagactataatatcttgtgcataagctcggcacatgattagtctttattttagtaacatgattgaggagccctctagctgtctggcatgcaaaagaactccagaaatgatggagatctgaaggaatctttcgtgctgtttttaaaatccatcaacttctgtacaaagcagaaataataaacctttttttccccctcacactttctgattgtcgacaaatttttgtcaggcagatggctgcctggccacttgtctgctctttcctgtggatcacagagtaaccgatccatgtgaaactcttcagtcctaaaatgtcgtttggtctcttgctgatggaaagtttataagctgcatctggtcgaatagctcgatgttagctgcattgatgtctcttttgttattctctttgggaagcatatgagcaacttcatacagatacgttggtattatctgttcagatcttcctcaaaatgtactactactactactatttagacgtctgcacatatgctgaagacaatagttaattctaagcattgctggtatcggcagttttcagcaaggaacacgaattagtcgctatctcaatacacaatttcccttcctcaatcccaaccccaagctgaaagcctgaaactcctggatagaactaagcaaacactgaaaagcaaacctttaaatggtccatcgcatatttcagatgtgagactagtgagcactagacttttgcgatgttttggcttcagtttggtctagcttctagcaattgcaatttcttccagaatcagaatctctcacaaacagtttagcttttaatctagattatgaaaacttgtagtatagaatccagaaaatgaattacttaaaagttagaaggtgagaaacctaacctttcaaattctcagaaactaactaccgactagtatttctcataattttaccttcacaaacagacccctagtacccataggccatatcgcgtgcatcaggagaagcaatgccaatgcagtgattgttaggttcgcgtcgtcgtcgtgcgtgcatgcgtgctcgcgtaaccgcgggacagatacatcgcccaaatcaagccttgtgtcttttcgccatgaccggcaaaccgacgacaaaacatgtgacgatctgtaaatatgtgtgcattgtctaacaactagtcgatcgatggtggatggttggatgccgcaccaataaccaccctaaaaagtctaggcgtcaacaaataagcgtgcctcctttctgcccggcctctcttttatttcctcatctgagaagtactgcgatgaagaacacgacgcgttactttctttttgtggctacaaaatccttagatgattggttttaaaaaatgttgtacgattgcacttttcgaaggagctagaagtacccgttgaaaatctagctggtgagactaggaaaatatgattttgatttcgagtttatttttcacattgtataactataaccttttaaaatctgaaaaaaaatctatttggaagagcttttagttataggagaacccaaacatgcctatatctgtttttcttccaaaaatctactagactttgtgaagtctgcccatccttggaaagatatctagaggtatcatattttctagtataaaattttggtacctctaggtactacgtatcttaaggtatcaaaaatttttagtataaaatttagttacctaaaaatacattttcaggactgtaaaattccactttacggaaagacattttggcccatctattattaaattactaggaaaaggagcctccacgtgcgctctcacgggctagaaattctcatattaatcggataaaaaaacagagtccatatataaatacaattttaaaatagctgaaattcgaaattaaaaaataaggaatattaaaacatgatactagagtccattccggtatacaatttagaaccaatgaaaattccgtattattttttaaaaaaagataaaagtagatgttagagttcatatagaaatacaatttagaaataactaaaattcggaattaagaaagggaatattgaaagaagagtatagagttaatatagaaatacaatttagaaatcactgaaattcggaatgaaaaaataaagaatattagaagaagagtatagagtccatctaggattacaattaagaaataaccgaaattcggaataaaagaaagaaatactagaagaagagtatagagtccatacagtaatttataattaactaaaatttagaataaaaataataaaattaaaagtagagtttagagtccatatagaaatacaattaaaaataataaaaattcaaaataaaaaaataaatattagaagaaaagcctagaggggtctagagtccacataggagtattatttagaaataactgaaattctgatttctaaaataagaaatatatgaataaattttatatgtaacaaaaaatcagaattaaaaaaatgagtattggaagatgagactaaagtcaatacaatttagaaagaactaaattcaatattaaaaataattaataactatcacgtacatacaatacaatatgaatattacatattgatagtttggtaaaattagtacaaaaatttaaattatgttatcattttaatatattgtaataataaaagaagaaaaaaatactattatagaagagaaaatatagggatgctagctaagttcaatatgaagcgtgcagagtggactagtggaaactgataaggcaaattgcgggcaataatttcaccatagtcatggcctccctttcgtcctccgtcagccaagacttcactaagttcagtagaactgtagatgagcaggaatcttgtagcctagctccttgtcaagttatccggagcggtaaattattggttaactagcactttagaagtggacaagttcggtccatctgtctcttttcgaataacttatcgcatgcaacaacaaaatgaccttcaactaaaaaaacaaacaaatgaaccgtcgccggatgtctcatcgattgacgtctcaagagtgttcttgtagaagatgctttgctctatggaaagtccgcttctgaagagaactcagctactacaagggaactcgccgtcgccggccgagtttgatttctgttggggatttggccctggtgctgggacttgggaggctggggccgtcgaattgggtcgcgtagcgtgaaggtgtgcgggccttgagccctgttgcttctccatcactgcccattgtacttgttactgggccattgtttgagtggatcagttttttggtccaaactcgagccccacagaaaaaaaaatcttcaacatttactctgactaaggacattcgtaaaatatctgcaacactcagtgtcgaagtcgactacctgtcaaactcaaatcagaaaaaaaaagatcacctatgattaaaacaaaaatcacttgagagcacgaacaaattgtgagagcacagccgcctcaaaacatgcatcattccattccaatgaaacacttcaagttgatgaagcagtacaccttccaatcccttaaccaattaaaccatgcaatgatcgatgcaacaatgcagataagtttcaaaaagcacgacgggttcgtccactcatgaagatatcaacttccactccactccactccactctacgctcactcactctcaccttcacgctcagcggcctccagaatggacgccgaagaagtcgtagaacggaggcgcctcgctgctggggctgtccgagctctccgactcccacgagaacgacgcggacgcggacggcgtcgtcggggacacggcggcgcaggcgctcccggcgcggagcggcttgtgatccggcagcacgaaggtgggctgcagggggaacagctggagggtctcgcgcccaccggcgccgccgccgcggcggccatggccttccgcttccgccgcgccgcggccagccgccgccgcgaggtgtgcgctgctcggcggtgcctgcaggtacatggtggtggtggccggtggctgcgccgtggacttgtcgtgcggacacacttccatccctgggtacagcaacggcgtctgctgctgcgggtagtagctggcgttatttgtcgcgaccggcatgaagcttggcgtcctgaacatcactgcaaggatcgaaagtgtgcatggatcagtgcagaacatggagtggagaattggcatttaagaattgaaatgcaaacacaaactgtagtaaaaatagaatctaataaacgcgcgcattatgatcaaatggatggtcatgctaagaacaacagatcaaacatgccaatgtcaacaacgatactcgaagctggattggatgacacgtgcaccgaccactcatgggacacattttcatgtcccaacattatgagatggaagggcagcatttcttggatgggaaaggaagcagctaaaggatgatgtggaaggttgtgtctggccgttttggccctagctaggaggatggtcatttccttctaccctcggtcatgcacagcatgacagcagcacagtgcacagaagattaatggagctacaaaagggtagcagcagaagctacataggcaggcaggcaacgttaaatcgtgtgaccatgaataggcagtctctctgttccactggcactgtatataggggggcagaggagaaaagacaggtgatacgaaacaatggaagaaatggaagaaaaaacggacggatttacagtaggagacatgaacaaggcatgcacatcgtgacagaatagtgatagctagctaagcaagcgtaatgcgattgcatgcaacgcaacgcgtgcatgcagaggataagtacaaatagacaactagcggcagtactactaccgtgttatacatcatgccgttgtgcaacaaagcggtcaaggtcaactgtgaagaatggatgttctacgccaagtatacttgtcatgccagccatgcatgtacaaaacgatttcgtatagatttattggcccatgcatgaaaaatgcaagaactgaaacgacagcacgagaactttgacctccatacgcatgaataccacgaaaaatgaatggatgccaggtgcatgacacccatgtgtaaagctaattaagcaagacatgccaaagagaagatttaatacgtgacatttaaagcacgagaaaaggtttggcttaccaccaccggcgttgcatgcggccgtcgtcgtcgtcgccggcggcggcggcggcggtggcatcgccgtcggcgccatggcgagagggaagggccgcgcgagtggcctgtggagcacgggcagcggcggcgggcggcggaacagcttgctgaagtagtcgaagctctgctgcttctgcttctgccgctgcgggccttgtggttctggaaccagtagaacacgttcttgccctcaatgtggccgtgctcccggagcctcgccgtgatctgctgtatctgctcggcggtcggcgtgcgcagcccctgccggtacagcccctccagcaccgcgatctgctccttggtcggcgtccaccgcgcgttcgccagcgccgccgccgccgccgaggccggcgacagcggcggcgagagcggagacggcggatcggagaagcctcccgcccgcccgccgccgccgccgcccaacgtcgtcgtcgtcgtctccatggcttgctctgactttggtcgcgctcgctcggctcgcccgctcgcgtttgtgatgcgtttgctgcctgcgagcggccgcgggtgcgtggtttttaagcgtgcatgggagtgtgaggaggtgggcgatgggtgggccgtagcgcgtgtgcgcgcgcgcgggcggcagggggaggcgtagctagcgtggggatcgtgtcgcgttgcggtcaaggggagcgtacgtttcgacgttttcgtgaggacgggaggagtcgcgtgccgcccctgtgccgtgcgccgcgtagatcaccacggcgagtggcgtgatccatccatgcgtgcatgcatcgtcgtcggtactccaatcgatggatcaagggcgtacgtgcccattgtgaagtgaaatgaaaagcaatttttcactcgtgaaaagggccttttccttcgtgtacgcgttttttttgcccagctggccgcatcgatcggaaaaaggagagagtaaagtgtgcgtgcgtgctgttcgacgtgggctctgaaaacaatgggggaagaggaaggaaaggaggctgcggagcggagcgcatgcaatgcacgcagctagcgcgcggccgcacagtgaatgcgtgccaacttgcctttccagaagagaagtagagtagcctagtcgatctagtgtaggaggcgcaagccgtacgaagcatctcctctcctcgtagtcgtcctcgggaatgatgggaattatttgctcgtggcaacagatttttcgttttacgggcgagatctcgtgtgtttagcccctttcggtagaggactagctagcatccatcgcgtcgctctattcatcgcgtacgtacatgtagcctctgcacgtactatgcgctgtactctgcgtccccgtataggctacttttgcaatgtccaagttagatcgatcagattcaatgcatgcacgagtttgggagtgaattgaagcttgcttgactgcttgaggccaaagtagatcgagttgttacatcgcattgcatgctttgactactacgcgatcagatcagagtgccttcaggataaacggatcaagcattttttttgttgggaaatgctcgtatcgtggttttgcgcccaaacttcagtctattgtcacagaaaatgttcgccgcggttctaaagacatcaatgcaggagattcatatcgatctcgcgcattccgttctgtgaaagcttaattcagtatacatcggtgtaaagcaattggttgcaggcttgcagcatgctgcatgcagctgaaatttttcgagttactggttgccgcatgcgtgcccgaacaaggatctctgaaatgataaatcaggtttattttgcaataacaaaagatcaaaccagcaagatacttcctccatctaaatataagtgcaactttagtacagatatgatataaggtgtatttaattctttgggtgtaaagtttttgaagtatacggacgcacatttgaaatattaaacgtagactaataacaaaacaaattacagagtccgcctataaactgcgagacgaatttattaagcctaattaatccgtcattagcaaatgtttactgtagcatcacattgtcaaatcatgacataattaggctcaaaagattcgtctcgcaatttacatataaactgtgcaattgttttttccccacatttaatgttccatacatgtatcaaacatttgatgtgacctttttgaccaaatttttttgagatctaaacaaggccatactccaatctaggaatacaaatctgaaaagtaaggcccgtttagttcgcgaaatgaaaatttttgggtgtcacatcgaacgtttgaccagatgtcggaaggggttttcggacacgaatgaaaaaactaatttcataactcgcatagaaaccgcgagacgaatcttttgagcataattaatccgtcattagcacatgtgggttactgtagcacttatggttaatcatagactaattaggctcaaaagattcgtctcgcaatttctcccctaactatgcaattagtttttatttttatctatatttaatgtttcatgcatgtattcaaagattcgatgttatgtttttgaaaaaaactttctggaaactaaacagggtctaagaagtatgctgtgtgcatgcaaacggaaagttttaaagacaactttactgcttgtctacatgttgtgtgcatggtaatcagctatcacgagctcacaaacaatgaagaggagagagaggccgggacctgaatgatcaatattgggacagagggacgccggccatggcttttactccctcaactggagacggcagctaggctgccataggtagggattgaaatggcgaggcacattgggaaatggagatagaggctgaggctgataccaaagcaggctagtgtagggcgatagatgagacgacgaacactgtatgcatgcatgcatgcgttgtgtttgggacatgcatgcaacgcacggcaatgggagagggcagaccggacggttcaggagtcggattttgagattatcgcttcccgtttccccgtaacgtgatgtgagagaagccgagacgctgcacgcctgcgtcgcattactcctcacgagctaagctagagactagagaggcagggacgaagggagaggcagacgagagggggaggaggagagaacggatcggagacgctgcaaattggcgcttgctggtgctgcgcgcattgggaaatgccatgcgtagctagaggctaaccacgcgcgactcgcctcacccaatcgggctccggtgagcagtggcagcgtgagcgtcgtcgtcgtcgggtgtccctgactagataggacatggattgactttgatcggcgacaaatcttcaagagagatccgaatacccggaaaaccgttcgccctgatccgacttaaaaacttcgacggccggccggttgggcaaatcaaaacaccggagcaggttaaccgcgagcgagccaacgctagcgcgaaaccacaaagatccaaagcccgtgctggttagttgccgtggtgcagtgcaggcgcaggtagacgccggtggaaggcgacgcgagacatccgcgtcaaagaaatcctagaattccgggcacgtagcgcaacggtgcgtgtgccatgatcaggagattgtcaaaaaaaaaaaaaaagacaacacttgagagctgttgagcagctgctggaacagacattctgaacggataaaaataataacgggcacgagaagcatgagtacaacgaagttttctgggcccaacatatattttttccttggttgattagcaccgtgaaatagtgcatagaggatcgatcagaaaaaaacaggccagtgcaaatgtgtgcatgttgttggtatgcatgctcaacagggatgcaagtgggtaatccactacccgtataaaaactcgcttgttagtatatttttcgtatgatagtttaaaatttagaagaaaaaattaactaaaagtgagataagcgggaaaaaaagcgcgcttgcccgccccacttgcatccctaatgctcaaggattctagaggtgaaaattagggatgacaattgtgcccgtttgcccgtttatccatgggtaaaaaccctattagggttgggtttgttctccattttatacccatgggtatcttattgggtcaaaagctatgcccgatgggtaaattggcatgggaatgggtaatcactacccatgcccgctttgcccatttacccgcaaaatctaacttacatgtaggctaggagcaaaatccactagaatacataagccacgtttttattttctacggtttcccttttatttcccttattatttctctccctttactctatcgccgctagaagagagacgacaccgaggcggagaatatttgatgttttaagttcaattcgaacttagaagcttgtagactttttgttccactgcttttgttgtggcgggtaaacgggcacgcccgcgggcataagacgcccgcgggcaatgggcaaccatccttacccgtcatgtagtaattgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcacttggggtagttcttccttcactccgaaggtggtgaactccaaaccactcacaaacggtgccgggcctcctccacaatctcctcggagaggtcaccgggcaacacctccacaagctgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttatgaggccggtcagaccggactactttgtaacggctagaaaactagccgttacagggcaatcattgagcccactcaacctggccggtctgaccgcagtgtaggggccggtcagaccgccgtcggctcggtctgaccagttgcggctctggcggctctgtatcgccaccaaaaaccagaccagtgcaatagactagtggggccggtcagactggccttaccacgccggtcagaccggctaacagacccggtcagaccggcctaaggcccacggtcagaccgtaggtcacttttcagctcaaccgactgttagtaaaacggtgatatctcttgactcgggtatcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcataagatcatccacaagctcgcttcatagacccctcttgatagtacggcgcctatctagcaaatccagtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcctttgtcaagactttattctcattacaagcttgacttcattcttgccaacatgacgatgtccttggcttggtgaccactaacccatggtgtcattcattagcctcatcataatgggacctattccttttcacacctcaaaggagaacattagtctcaacaaatcggttgtcatccttcacttgatgaccaaccggttgcatatgaaagatatagatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagactaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagaaagaaatcttataataaacaaaatatagaataagctccccctcaagatgtgcatacatatggatatgaaggaacgcatatgcacataatcaataaagatcaaataggaagctcacactatattttggatccacaagagagaccaagttagaatgtgtgaagtttaatacatacctctcatcatttttactttcatatccaaatgagactagtcaaagaaaggctcataaaaatgttagtctcatataattaaatttgtcattaatcaccgaaacagaattaaggcacttgaacttatagtaatgggtatacccacgggcacaaataatctcacgggcatgggtatgggtaggaactacccgtgcccgtcgcgcccgattgccatccctagtgaaaattctttattttgaaacacttgaaccggtgtaccgtccatcctctcccaccttcgtgtgacctctcgccatgtccacaatggcttcaccgacgaccctatttggcgattaaccctcaaggcctcgaatacgaaggagccatcgtggaggtgctgtatgggacaaatagggtctgtttgggagagcttattctgaaaagtagcaagtgagaatctagagaaattgagaaactcatttctggattctacaactgtagattctcataatctaaatgaaaaactgaactgtatggaggagctcgcagctagagattatagaagaaactgcagttgtcagaaactcccctaacagacccataagctatattgggaacaatgtgggcaaggaggatgtgggggttgagcttaacacgggcatgtagtgacggcgtgatccacgatgggatgaccaggggacggcggctagatctagttgtctcaaagtagattcagtccctccattctgggatccttccgtcatctcttgagttcccaacaccgttagagcaggtacaataacactattgaccttgctcttaggacagctacttcgccacgctcaagggccccgagctcgacactgttaacaacagaatttggtaatatcagcgtcggaggtgaagatgggatcgaagcggagtcggagataaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcgatgcatatatgacatcggctcaaagataaatgatatgtcatcggcactagccgatcggctatcatttttagatttaaccgcgatttctttgcttctacttcttgttggttacaggatcaaatcaactggcatgctagcacacccgaaggcgagctttggacctgcactggagttaagcagatctcccaggcctcgtgttttctgtcaacacgcttttggcacgcctggtgggacaactaagaagtcagccaacaatcctccctcatggccgaaaaaccaccaccaccaccatctagcccaggctctgttaaggaaaagatgctgaagttgggattgactgacgtcaatgaaggaaacgtcgtgccgatcgatccagaaaaattcacacctgagcagaagaaagagtttgaagcaatgttgcggcaagcacgggatcagttcttgaactcattcatgcagacccgcaaggggacacttgttcagaagtacaaaataaaagttgttgctgatgatcctggaaccagttcttctaaggatggagatgggaaacaagctctagacggctccgctcagccgagtatcaaaggtgctgccgatggctctctaggaaatcaaggcaacaattctcaaggggtccatggaggacaaggtgacggggtgcatggagttcaaggtgacggtgctcaggggctgcagggaggaaatcttaatagtgacgtggcacaggactttttcaataacttccaagatcaggttgattacgctgtacatcatgctttgatcaatcagtctggggtgatagtcaataccctgtcaaacatgatgaagtcaatagccgatggttcaatagctgaacatcaggctgcaggcccgatctatttgcaaggaggtgtttttccaaattatcggtctttgattaccgacgttcagtcatctactcaggcagttccctccgttacacccacaactcagccgacggcaccggcaacaactcccctacctgctacatcagctatggcgccaggccagccaatgaatcctcagctgttaatgagagagcatccatagcatagtgggcaggttgcgaatcggccaacccaagatcaggttgctgctatgtttttgccgcctcaacatgcggttgatctaatacagtagcagccgattcagcaacagccgattcagcagacaccccaaattcagcaggttgtgcaaccaatccagcaacaggtcatgcaaccagcacaaccaatccagcaacaggtcatacaaccagttcagcaaacaccaccaaggcagcagtctctgcagccgatttagcaaacgccgttgagacagcagatcgtctagccgatccagcaccaaggtttagtgagcgcatcggccgggtttgcaacgcctggtggtcagcctgtacaacaacttttaaaccaagttgtcccagaacatttggttcaccacgtacagccggatggcatagtaatgcctcaggttgttcctgagcacttgctgtgcaatatccagccggaccctcacaattaccaagggggtaacctaaattatcaatatcaacctccttccccacaagcccaatatcggccagggggattggctcaacctcagtttgcatcgcaatatggtcagttcgagcccatgcagcaacagtcacaaggcgcaactcagcaacgaccgtgggccgatgtaattgctgacgtaatgagggaacagtttgggcttaaaccaaaagagatcggaagcttgtatcggcagccttaccctgagtggtttgaaagagttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagatgaagttatctgacttgacgacgattaagcagcggcatgatgaacctgtgcacgagtatattcagagattcagggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattccaaaaagccgatgaaggtcgatggtaatccttttcctgttaatatggtgcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacggcactgattaacatggtctttaccttgccagccgatttcgggattgatcaagccgatgtcgacgaggtggaagaggaatcggctaagttggttctatcaccagaacaggcagtgtttgagaaacccgaggggacagagaatcggcatcttaaaccgttgtatataaatggctacgtcaatgggaggccaatgtctaaaatgatggttgatggtggggctacggtaaatttgatgccttatgctacgttcaggaagttgggtagaaatgccgaggatctcatcaagacaaacatggtgctcaaagacttcagtggtaatccatcggaaaccaaaggtgttctgaatgtggagctgacagtcggcagtaaaactattcctactacgttttttgtcatcgatgggaagggttcttacagcttgttgcttggaagggattggattcatcataattgttgcattccttcaactatgcatcaatgtttgattcaatggcaaggcgacaagatagagatcgtgccagtcgacaggtcagttaatgttgccagtgctgatttagctctttgggagatggatagccttgattgtttatctggaaaagtctgggatagagattttctaaaagtatccgattctgatatacaaccaattgaagatggagaacccaagctattattttgagggcgtcgtggggggttcagtcgtctaccctaaggatacagtagatgatctcgatgacaagcaaggtcaaggtttcatgtcggccgatgatttggaagaaatagacataggtccaggcgatcggccaaggccgacatttattagtaagaacttatctccggagtttagaaccaagctgatagaactcttaaaagagtttagagattgcttcgcttgggagtattatgagatgcctggactcagccgatcgattgttgaacatcggttacctatcaaaccaggggttaggccacaccagcaacctccgaggagatgtaaagccgatatgcttgaacctgtcaaagctgagattaaacgattgtatgatgctgattttattcgtccttgccgatacgctgaatgggtttctagcatagttccagttatcaagaagaatggcaaggtcagggtgtgcattgatttccgagatctgaataaagctacaccgaaggatgaatatccaatgccagtagccgatcagctggttgatgctgcatcagggaacaaaattttgagttttatggatgggaacgcgggatacaatcaaatctttatggctgaagaagacattcataagacagcttttgagtgtcctggtgcaatcggcttatttgaatgggttgtcatgactttcggcttgaagagtgctggagctacatatcaaagagccatgaattacatatatcatgatctaatcggctagttggttgaagtctacatcgatgatgtggttgttaagtctaaagaaataggggaccatatagccgatttgaggaaggttttcgagagaactagaaaatatgacctaaagatgaatccgacaaaatgtgcttttggtgtatcggctggccagtttttgggatttcttgtgcatgaaagggggattgaggtaactcaaaggagtgttaatgcgattaagaagattcagcctccggagaataagacagaattacaggagatgatcggcaagataaattttgttaggaggtttatttctaatttgtctggaagattagaaccttttataccattgttgagattgaaagctgatcagtaatttacttgggaggcagagcagcaaaaggctttggatgatattaaggagtatcttagctctcctcctgttttgattcctccacagaaaggaataccgtttaggttatatttatcggccggtgagaagtcaatcggctcagttttgattcaggagttggaaggaaaggaacgagtcgtattttatcttagtcgtcggctcttggatgctgaaactcggtactcccctatggagaagttatgcttgtgtctgtatttttcgtgtacaaggttgaggcattatctactatctaacgagtgtactgttatatgtaaagccgacgtagtcaaatacatgctatcggctccaatattgaaaggaatggttgaaaagtggatattttccttaaccgagtttgatcttcggtatgagtcaccgaaggcgattaagggacaatctatagccgattttattgtggaacatcgtgatgattcaatcggctcggttgaaatagtaccgtggactttattctttgatggatcggtgtgtactcatggctgtggtatcggcttagtcataatctcccctaggggggcatgtttcgagtttgcttatactattaaaccatatgcgactaataatcaagctgagtatgaggcagtgctcaaagggttgcaactactcaaggaagttgaagccgataccattgaaatcatgggggattctctgttagtaatcagtcaattggcaggagaatatgaatgcaagaatgatacattgatggtttataatgagaagtgccaagaactaatgaaagagtttcggctggttactttaaagcatgtttctcgagagcaaaatattgaagctaatgatttagctcaaggggcatcgggatataagccgatgatcaaagatgttaaagttgaaattgcagcaatgatagctgatgattggaggtatgatgtacatcgatatttgagtaatccgtctcaatcagcttctaggaaattaagatataaggcattaaagtatactctgttggatgatgaactttattaccgaacgattgatggagtattacttaagtgcttgagtgctgattaggctaaggttgcaatcggcgaagttcatgaaggaatttgtggtactcatcaatcggctcataagatgaagtggttgcttcggcgcgcagggtacttttggccgacaatgctggaagattgtttcagatattataaggggtgtcaagattgtcagaagtttggagcaattcagcaagcaccggcgtcggctatgaatcctattattaagccatggccgtttagaggatggggcattgatatgatcggtatgataaacccaccatcgagtaaaggacataagtttatattggtggtaactgattatttcaccaagtgggtggaggcgattcctttgaagaaagttgattctggggatgccattcaattcgttcaggaatatataatctaccgatttggtattcctcaaactattactactgatcagggttcaatcttcgtgtctgatgagtttgttcagtttgccgatagcatgggtatcaagttgttgaattcttcaccttattatgcacaagctaacgggcaagccgaggcatctaataaaagtttgatcaaattgattaagcggaaaatttctgattatccgcggcaatggcacactcggttggccgaagcgttgtggtcttatagtatggcttgtcatggatcgatccaagtccctccttacaaaattgtttatggacatgaggctgttttgccatgggaggttagaatcagctctcgaagaacagaattacaaaacgatttaacggccgatgagtattacaaccttatggccgatgagagggaggatctggttcagtcacgattgcgtgcccttgcaaaggttaccaaggataaggaacgtgttgctcggcactgtaataagaaagtggtacctaaagatttttcggaaggagaacttgtatggaagttgattttgccgattggtactcgtgatggtaaatttgacaagtggtcgccgaattgggaaggaccgtttcaaattataaggttgtatctaaaggagcgtatatgttgcaagggcttgatggtgaagtctatgagcgagcgctcaatggcaagtatttgaagaaatattacccaagtgtttgggttaacgcataatcggctagtattgccgatgcatgacagccgatgtgtttccatcgccttgagatggccgatatggttatatcacccttagttgtttttttttcctggtgtaatcggttgtggtttgccgatgtacaatggccgatatggttatatcgcccttagttgttttttcatggtataatcgattgtggtttctataattttatcaatgcttttgacattgtaaaattagggggcacatatgtatcaaaatgaaatttttttgagcaaatttcgaagtcatattaatcggcacaaaggattgtcaagacagtaaagtactagagcatcttagccgattacaaagatttctaagtcctattacataaaagttattgagacaagtattgctggatagccgaaatagctttttgcctaatttgttcaacttcctcaatagcttgggcaccttgagcatcagttccaggaatgatcttcaaagacttagtcagatcagcaacattcttgatagccgatttaagtcttgctttttgttcttcgacagaccgcgggagatcggctagtttcttgtgctccagatctaattcggcattgcattcctgaagttgtgccaggagctcaatcttgcgagcctcgagccgatcaatgttggatttgatcggaccttctgaaagctgatcaagtttggattttttcctcatgcacaagttgccgattagcttggattgtagcttcaatgtctttacgttctcgccgttcggtcagtcttaacttggctttctccaatttgaattgatgttgctcaagataaacggctggagtaaggatatcgactaactcatctgggatcagagcttgaatttcatgtagctgagtcctaattgaggcgcaatcaactaccaagctatctagtgatgatgcctctagccgatgagaaatattttccagagttttcttcacgtcatcggataaaggggctaaggctttgcttatggtgtcttcttctccttcatcaagataatctttgatgtcaaaagaaaaaagatcggctaagacctgcagcgacgatttaaagagagttaggggtcaaataggcatagccgatctgaatgttttttgtcaaaagaaaacctactgggatagtaggaacagttggttgaatttcttcttctatatggtgacttcctacagctgatggagtctggtcacttgttgattgctgtacagaaggagaaggaggaggaggaggcttaaaaagaaacaagtgttaggcaaaatcggctgagagttaattaatggaaaattgaggttatcttactggtggagctggtttagatgttgtcgcagccaatttctttttcacagcagtcttctttttctgcaattattaaatctttaagtaatcggtcataagatacaatgattataaaagggattaaagggagctatttactcttgaaaagtggactggagcagaaggagttggaggggtttgtttgggtgaagccgatggtgttcgttctgtatcgcttacttcggctgcggcctcgtcaatgtcatcttcaataatttcttcatccagagcttgttcaatggatggatctagagcagatagatcatcagctggtgtggtcttctttgtcttagtcttcttctttggagctggggctgaaatatttatagccgatgatctggtctttcttttcttgcgggcatcagctggttctctgataagcccttggagaagagctgaagacttgggggcattatagccgatgacggggggagatggcccacctccgttggggatcagtcctggggcatactcgatatccctgccgctgttgctttggtgatggggagaagattctgttgtctgtaaatcaggaggaaagttagctaagggctaatcaaccaagtagttattcaaataaaatcaagtgagttaggacttacttgagggacaatatctggaaagagatctatcatatacttggaagccgattgatggaataagtgtagcttccattcaccccaccatctgtcaaataatttgctcctaaaggttgccagctttatggtgtcaatgctgcctagaggaggtccttggagattgagcagccgatccatcattaaagatgatgagatttctcctcggcattggatcttatcggcaaagaataagccaattgggagttggcccattccaaattgtctggcagaactcattggatgataaaactcgtaggaaacttggatggttctcccttgatgaatgccgactggaaggatgcatggggtgattgcagataagaagatttctctgggcttctgatatctgtcattgttgatgtcttcgaatttgaagtcccatggattttctagaagtgttgagtctccatagagaaaccaaactcgagcatccttttggaacccctcataaaagctacaaaaccaatctttgagcagctcggccgatagctttgctcctgcatcagttggggtagaggcgtactctccatatgatgtgcatctccgatgagtgagttcctctccgtcatcgttaacagtcggctctaatcttgggaattcagtttctgttacagatggccgatcgacgaacctcatgactaccaagtttagccaggattgcagcagccaccatggtccacccgctccgactactgagccgacaattagcttagccgatgcattatttagcatttggtacaagtagccgaggaggattttgcctaaaggaaattgtctttttgtctccaaggcttcggctacgaactgccaattggttgtaggaccgcagctagacccacaaaagagaaacttttctaaccacattaataggaaagccacatgttctcgaggggtaactggaccctggcctatatatgctgctacatagcctgaccagccgcctatgctcttggtcttgaagtcatattggttctttgtattcaaactcatagggttggccgatgaggtgacatccagacccgtgatcatgctgatatctatgagagttgggatcatcggcccttgattaaacgaaaaggcattgatggtgtttgaccagaagtaagaagcagctgccatcaggggttcatctttggccgagtttgctatagtgaggtcaagtgcttggccgattccaatttcgtcccagtgaacccttttgcttgctgacacacgtttgaaccatgtggtccaacttttctcgggtggaactttctctagagatggccaagatttaaaggtgttattccaatgacctagatctgggttggttagtctgaagggaatcctattggtttcaccaatgataaactcagtgggatcaggattgccgactgggccgagaaagtagtagttttcgtgtgataagcttggaatcgcgattcagttagagagatgctacaaatccaagacaaccgagagaaagagagcgatataagataggagaaaatcgatctgctgctaagaaaggggatctagccagtggagacttacctcagcatactcggccgatggcacatcagatggattggtggaagacgacatcgctgcaggcggaggtctcgctggagatgaagtcacccgggagtcgcttttgcgtcggaggaatcgccggagagagagagaggataaagtttcgcttgagcggtgaaaacagaagtcacggtgtgagatttctcgagggtgacggttagtatttcaagcacggcaataacggtcggaaaacagcaaagtgcgaaacttgctcgaagtcagtacacggcaaatccggaacattaccaaatatcccggacttggggggcatgtgttaacaaccgaatttggtaatatcagcgtcggaggtgaagatgggatcgaagcggagttggagataaggattgttgcgggaacagagtaagaatcggctggagtccagatcagctacgactagaatcggctaaatctgaatcagactgggttacgtgatacaaccaattccggcaatacgacttggtgtacaacatcgggttgagtcgatatgcttcaagatgattgccgcacatggatagagttctgagaaggcaattgtatctattaattaggatgttttacgtaatttccttagagatatgcttagggcaaaagtctgccgcaaagaacgtatatgctataaacgtatatagtttcattattaatatatatttcgatctaagtgatttatactgtctcggcatggcgaccgatctatcccaatcacttgatttaagtatatatcgatataaagattatatattggtaatatatgcagccgatcgagtatatttagtcccttcttatttattaatggttgccgattgatgtatatatgacatcggctcaaagataaatgatatgtcatcggcacctagccgatcggctatcatttatagatttaaccgcgatttctttgcttctacttcttgttggttacaggatcaaatcaactggcacgctagcacacccgaaggcgagctttggacctgcactggagttaagcagatctcccaggcctcgtgttttctgtcaacagacaccctccgaatgcctgcatgtcgtcgtgcgcgccgcattctgtgctgtccacccacgcccaccgcccgtcctcgccatgcacgcagcatgtgcgagagagaggaagaggggaagtggagtatgatgactggattgccacgcgtgcgccacgttggacaaaaccaatcttaatttggtctagggggttaatttgtccggtatggaaagttcaggatagggtttagggggctatcaaattttagttatttctaaattatatttctatacaaactctatactccacttccaatgttctttattttttaattatgaattttcattatttataagttttactcctatatttcttattttaaattcaaaacttcagttatttctaaattatactcctatatgaactctagacacttcttttaatattgcttattttttttaatttgtgaattttcattatttctaattgtatttctatatgcactctaaactcatcattcgatattatttatttttaatttatgaattacagttacttctaaattgtatttttatggactctagactattgttccaataattttcataatttctaattttagttatttgtaaattgtatttctatatttactctaaactcaacttttaattttattgtttttattttgaattttaattaattctagattcctatatggactatatactcttattctaatattcattattttaattcctaatttctattaagtctaaataggctataaacttacctttcaatatttctttttttatactccttccatccacaaaagttacacctattacttttgtcgccaagaccaaggaaaaattgaatcatcttgaatgttacaaaatcaatgagtgaatgcaagcatgcaactaatgagtatttagatgactccttggattgtactccctctggttctatattaattgacgttttggacaaggttgaggttaaacttttataactttgaccatctataactttaaaaatattaagtttaaagaaactagaaaaacatatatagatttgtctttcaaaacactataataaaagtaaacatgcatttatttattttatatattataatagagaaataaggtcaaagatatatcttgtagagcgtatcattatccaaagcgtcaatcaaaataaaaccagagggagtaatcaaacatttaatttatctcctcaatcatcttgaatgttacaaaattaaggagtgaatgcaagcatgcaaccaatgagtatgtagatgactccttggattgtaatcaaacatttaatttatctcctcatttaagtctttttttttataattacacagtacaacgcatacactcacaacgcacgcgcacacagccttatgaaggcacgcacgcaaaccctacccctatgagcatcttcgaagactaagccggcaaatccttgagattgatgaagtcaaacgcacgctcattcacacctatgaacgcacgcacgcaaaccctacccctatgagcatcctcgaagactaggccggcaaatccttaagattgacgaaatcatcacaggcgcctcgctaccacttaaagcacaacactgttaaatcgtagaaaattcgcttccatggagagtcgaacccaggacctcagatgctactgagactcttgtaactactataggctacaggcattttcgctcctcattaagtattgaatgcaaaaagactacaaaacttatttggaaaaactcaaatgtaaaatatgtctaacttttatggatggggggagtaattccgaatttcaattatttttaaattgtatttctatatggactctatattcttcttccaatatttattattttttaatttcaaattttcattatttctaaattgtatttttatatggactctaacctctacttttaatttttcttatttttttaattccaaatttccattagttatattgtatacccgtataaacttcagtcttccttttctatattcattatttttaatttcaaatttcatatatttttgaattgcatttatatatagacttttttttattaatatgagaattttcagaccatagagcgaacgtggaggcttttttctattccttaaataagttaataaattctatagttttatagtcctccaattaccaaagtgggtggtaggatttgtgggaccaatgaatatacaaagcttattgtgcatcaaccactcgatgagatgagagagagaataatatgtttgtaaacatcagcgcccgatattttggcaagagcattattttggatattcctaaaatatctgtaggatttatggaagccagttcatgtgttctgaatggccatatagaaatttgttcttagtattttctacaaaaagtatcgtcgtccgattatattcccttcaagacccttaaagaaaaaaaaaagcatgagaccacacctcgcgaacgtctgttttaaaatcttccagggttccaacgtaaaccaatgcacatgacacattgacaccatattcttgcattttcccaatcccattttggataatccaaatctaatgcacatgacaccatatttcttacattttcctaatctcattttggataatcctgtgtttcagaggattagcatccacaaatttttggttaatcgttgggccatttcgccattggaaaccaaatagctcccaatcttacagcccaatagaccgttacgatcacgtcaggacacaataggcaagaacagtttcaaggacaaaactccacagaatcaagggcaatagaaccctgagaaattgtgacaaaaccgatgtatcgaaacatgtgccaaaatttcaatgctcctcaatagcattgcaatgttctcaacggcaatacagcacctcgatctagagcttactataggtccatataaatgaattacaataaggattgcaaaaagatcttcaacttgaaacttctatttcttcttgtcagtagtaccagcagacctgcacaacaagagaagggatttagtttgcaaattctctttgtcaaaggtaagaattggccagaaaatgaaaaatgaaacaaaacttacatacaactgaggtaccaaaacaacggagaaaatcatttgtactgctttgaattataaagctataataaataacagaacagaagtatagggacacaagttgggcggacaagcgggattattttatttttcccggttatcccacttatagttcactttttcttccaaaatttgtgctaccatgtgggaaatgaactagcaagaaggtatttatgcaaatagtggtattgtccacttgcacccctacatagctacagaaaaaggaccaagttaatttagagacaagtccaatatttgcagaatgcctcttatatacttgggagtacttacacaaataaatctcacaacaatgttaccgataaagtgctactccctccggttccataattcttgacgttttggacagagtgtagtcaaacttttataactttaactatcaactttaaaagtatttagtttaaaagaattagaatagcatatatggattcatctttcaaagttctataataaaagtaaacatgcatttatttattttgtatattataatagaaaaacaaggtcaaagatatattttgaataccgtgtcattgttcaaaaagtcaaaaattatgaaaccagagggagtagaacccattctacaatacgcacggaaaaaaaatagcaactaaaaaacagagaacatcaacaatgaaattgcagaatgcagtagtaaagacacacacctcatcttcctgatgacacccgccatctcctctctcttcttctttgctctcttgtgggtaccgagctttctcttagcgaccttcagtgcacgcttgtcctttccaaccttcagaagctcagtgattcgtttctcatatggagcaaatcccacaacctccctaatcaagcccctgacaaaattcactctcttggtacttttctgcaataagacaagaaaacatattaatgaaagaatataaataggaagcagctatggtgtatggccgtattcatcaggaagacagcaaaagaaatctctggtcatagactcgagaagcagctatggtggagattgtagttctcctcagtaaagtgaatttttttttcacgtcataggctcaagagatcacaagatcaactaatggtaattcagaattttctatttgacatgaggtgacaaagcatcacttcatcgttcatttgtcatttcaaaatattgaagctgtggaagttaaaaaatagattttaacagaacatcatttttatttgcttttatagctttgctcagaaaggtaaaccaaagatccacacaactgcacaagcaaaaaacattcaatttttgtttacattgcacagaaaccgaatctacattactggataataaaaaacaaaaaacattaaaatatttagaacaagacaaaacagaggtaaatttagtgagatattttagaaacaaaatcatgaggtgatt

SEQ ID NO: 58918 - DNA, 10487 bp, Oryza sativa
ttagttgtcaaaatttggaaggcaaaatgtggttttttgagccaagtaaaattcttggagttgaactatcctatcagatcacaattgcgtgattaaaatggaagtccttttacttgatattgatcaataggttttaagatgaatctttgatggccggcttagtcacctgttgctttctccattttctatattttatttttaatgtaaagctttatacaatataagatagtttctcgcaagcactcttggttggtgcataagcctaatgtttttgtcatatatggaatggattggtcttatctattatatctttaataacaaattttaagatataagctttttgtgacttctggtatttttgtaatcaccaccgcattgttcaatacaagacagcctactattcattttattgccatatcttgatttattaatccttgtttttgtactaccaagtgcaattggtactgtatgctgttttacccccaggttgcttcgtacattgctgtagtatgtgaaggtgtggaaaatgagcttcttggaaaccaaatttcattaatagacctcacttaggatcagggaagaggagctgtcaagtgcctagattatttttcttacaagatatatactgtagtaatcacataaaactgttgatggtcttaaattccattgtggatgactgattgcctgaagtattcaagtttcataggtacaactaatattcaagttttatctgtgctaatcccactgtcgatatcgttcaaccgccgttgtctgcactctgcactctgcagcactgtgactgccgtcgtttgcaggtctccagcacaagaattactatgctgttaacatgtacagactgtaaaattatgttaatttgagtttcataaaccttttcttttggtatcaggcaacagttgaagatgccactaatctgtatggatggcccccttgcattgacactctactatgtgtctgtaattttgcttctgttgcttatgaccccaacagaatttgatgattcagatttgatgtacaccaataaagaatgtaagcaaatataagagaagagaaacgatgatgttcttagtgacagattaaaggcgggcttgatcctcttgatagtgagagctacttccttgtttttccttatttatggtgagcatacttttcaaactagtattaaacagtatgtttatttagaaaacttcctatatcgaagtttctcttaaaaatcaaagtttatgatagttaatacttaattatatgcattaatcactaatcatgttttacgtgtagctcataagcttgacccatccatccattcgaacggagcttaactatacttttcaaactattgtttagaaaacttcctatatcgaaatttctattgaaaatcaaataaatttgtcttgtttatgatagttaatacataatcaattatacattaatcatttgtcttgttttacatgtactctttccattcgtaatataagagattttaggtggatgtgacatatctaataccacaaatctggacagttttcttaacaagattcaagattcgtagtactaggatgtgtcacatccatccaaaatcccttacggcctgtttggtaagagcagggaaggggaatttatatttttgggatggagggagtagctgataagctagacccatccatcaattcgaacgcagcctaaccaggcaaaaggattttagagtgttcctattggatgatttccatcacctgaaaataacatattatttcagatccattttttgaattgtttgcattcggataatttgatatattatttcagttaaaacacttctaaacaattccagcgagaaaatataatcttatgaatcgtgcaccaatgaatcaccaggaaaattattggaattacaaaattgcgccgtagcgtaagcacggacatattacaactagttttgattaggaaaagacaaattaaaaatcaggtgaaagctactcccagtgacggatttacctccagggcaggccggacgactgctctggcttcaccgccttcatgtcgccgagccgcttagcattagcgattaacaccgccgattcagcaattcccgggcggatcgtgggtgcaaggcagcaacgcaagctcgtgcaggcgtgcagctgtcaggttgtccttgcaggcagcagctcaaaagcatgcatgcttatggctgacctaattaccttgcttaatcacacctatctatcaatctattatatactaaaaatccattaaacttcctacaaacgctcttagatcaccatgtggcactctataaaccctcctaagttgccacgtagcaaagaaacatctaacccttgattttcatttaaattggtggacctattcttttcaaccattagattagatgtaaaaaataataattcccccatcctaatccacctaggtccactctattcctgcggatgtaagctcctacatcaccacgtggtaccctataaaccctcctaagctgccacatggcaaagaaatatctaacccttgattttcatttaaattggtgaacctattcttttcaaccattaaattagatgtaaaaaaaaataatccacacatcctaatccacctgtgcccactctattcctacggatgtaagtacacgtacgtactccgtatgctcctattcccattattctcttttcattctgttatctttttctctcctattttccttctttcaatagaaagcaaaatttatgtaaaaacatttaggcaactatagtatttaaatcataaaagtaactaaataatacatatatgttttgatcacagtagttaaaaaaggcacatagatattggtgttatgggtgcggaaagtgataaaaccagcacctatagaccatttcccacctctacaggatgaaaacacaagaaaaccggtacggcacctttaatagactataagtgttgattaattaacaaaccgataccttcaatctattatatactaaatatatttatttgtcagtgttatggataccacatacctaatagtagttgactaaatctcggcaggacccaccacataccatgtcttatacggaaacaacctttggatataggagaagttccggataaggaaaaacaactagagttctatatggaaatgataaggactactcggattgtatttatattggtttccctagttctacttggacaagtggacacctatgggtataaatacaaggccccctaggaggagaggggacacagaacaatagatcaagacacaagatcaacatacaagccaacatgagtcaagacaagacgccggatatcgacttcagatataagcatggctagtcccctacggtgtctacggatactgtcaggagagacatagcgctgtctttgatctcgccagatgcggattcaaggaggaaggctaccctgttgtcgactacgagtcagcacttcagaccgccaaatcgacaacagttagataggctaccccaaatattgtactggtgtgattatggtgaataagagcaacgaccggcttcggccaacaggagtagggttattacctgacaattcaggggcccgaacctgtataaaaatctctgtctccatctcttttacctcaatctcgcatataccctgataccaacgatctccataccatcaaaataccatagccgcgatatcaaacgtcgacactattaaacttcctacaaacattcctaatccgctatgtggcactcctacaaaagctatagagccgctatgtgacgctctaataaattatagaaattatgagaaaaacgaaaatatctaacagtcgattttcatttaaaatagtggacccaatcatttaaaacatcatatcaaaataaaatccctcttacgtatgtacgtacgcctatcctcccctcattttctctttcttttttttttgctaattaagttagttattactacgagatatgcaccataacttaatattgtaaatggttatatctttccttgcatggcatggagcatcgagttggctgtgcaacgtgcaagtactaattttttttatggacgatttatacattgattttatgatacgcttcaatgattgtatgttttaattaaattaatcaatgagctaagtcctatattcactctattttctatgttttcgatatagacatagacatccgatggatcatctgcaataatatcatatctaatgggtaaaaaaagataagccgtttgagatatagttacggccttacgggatatgagttcctctgttacggtggccgatcttcacatagtctaaatgattatatataaacaatagatagctaaatgattatatttttaaatatattcagtttttagtttgatccatgtaggcttttcttgatatatgataaatatattttcagacataaatccatatcctttccgtgacaactaaacatcaatgcaacgttatataaaaattgataacatatatcgtatcatcatttatttattagatgtccattacaacacctctatgtcttcacatttcacatctaataaattattttttttaaaaaaacctatttttgagaaaaaatacatatgaccatcggttttatttaaatcgatagaccttccctctccgaaaagtttagggctctcctctcctcttgcccttcctattatttagctaaagtccattaaatttactacaaacacttataacttgtcacatgacgctctaataaattagaaatcaaagaaattatgagaaaaaacaaaacaactaaccctcgattttcacttaataaggttgacccgatattatacaccattagatctatctttagaaaaaaaaatcaaaacccatctccaccgcctccttcctcctgggcctcctctcctcacggtacaaacatccctccctctttccttccttcttttaattttcccgctaacagattaataaaaatcataaagattctaataaatgtttagccattatttttttaaaattgatggagccattaattttaaccgttcgatcttcatctaaaaagaaaatcggatacctgcactctcactgtcacctccatacgtgcacacttatgacttatgtagttacgttctccctccaccctcctaactctccccttctctcctactccctccgtttctaaatatttgacaccgttaactttttagcacatgtttgaccgttcgttttattcaaaaacttttgtgaaatgtgtaaaactatatgtatatatgtaagtatatttaaatgataggaaaataattattaattacttaaattttttgaataatatgaacggtcaaacatatttaaaaaagtcaacgacttcaaatatgtagaaacggagggagtatttcttaagctaactgctattttttagctgacactcaatctatcaaaaattaataatcggatttctaaatgatcataaaaactcaagttacatattttctcaatttttttgaattattgtgttatttataattaaatacataatttgagatccatatacataactcgaacttctaatataaatgtttgagatcaaaattttaagcatcatattaaataaatattatattttgatcctataacgcccctaaataatgcccctaagccgacatgtgaccctcaaaataaattataaaaattcatagaaattatattaaaaaaatcgaaccattgatttttcaatatttttaatcattagatctaatcttaatcttaacctatttaaaaatttcaagatgattccatcctccattgcttgatgatgctatccatgagtcagccgcacatactccgcgtatatgttccgttcacgagagagagagcgcacacgattctgactcaaattgataaaaaaaataccacatccatttgactcggctcgctgaaagaaaaagtcgattgaaaaaatatcttacttttaatttgaaattaaattgttagaccgatttttaacaaactaatacatatgcccgcgcatcgcgtgggctaccttcctagttcatataattacgttaagctcatagtccactcaaccaacatgtagctcaaggaatgaaatgcatattacgtactatgctgtatgcaacgtccggctaaatgaatttctttcctgtaccgcgtgctctgtgctcatgatcaatgcttagatttaaatagcaaattctgaacaatcagcagtgccgctttaagttattcacattttttcaacgtataaacatttatatgcacgtttggactgtttatataaaaacattatatattttgatgtgcaactttagtgataatttagacatatatacttgattttagtcgttttatttaggcttacccacctgcccacggtttagaaaatttctggctctgctactagctactcaaatgacattgttagcgatagaagaaatctcaccatataaaccaagccatggaatggaatgccacgagatcacgtaaggcaagaacaaataatttctactatatgggacaagaattcctgagacctagacacacataatctggaaacgaacgagagtggtcgctagcagacagcccgtgaagtacaatctcgacgagcaatctcgcatgtccggtggtccagcgtcccaccaccgcgggggaggcaaggcaatgcaagcggcagtactccccacgccatcatgcctgtccccccctcccctcccgcgcgcgccgccctgctgcctgagacacactccactcgcggccatcatggccgagagacctcctccccccctagggcgcgcaacaatggcgcataaccgcatcgatggccccgacgcggcacgcgcgcgctcgcagcagccacccgggccctcatactactattgcttcgcgtgtgcttgtgcttgtgcttcgttttcgtcgtaacgcagggactgctgctcattcgctcctcttccgtcttccccccattgactctggccccgcctccgcgcacgggccaatgcaacgctgatgcgtgtgagggaggggtaggcaggcagcggcgtgggccccgcgagtcatcggggatgttggtttggggggtgggtttttttttggggggttggggttggcacgttggaagcggcacgcgcacccacacacagcgcacagcagcatcgagtgcgcacgccacctcattaattcgttcgctcctcgcgccaccatccatccattcattccctccattcctctgcactggactgcactgcggctgcactccatatcctctcctctcctctcctcctctcatctcctgccttccccgcttgcttctctgtatcatcatctgctcaaaaggagtgcagcgacgagaaaaaggagaggaacaccaatccgagcatccaacgcttcctcgtccgctgtatataaaaccgaccccctttgctggctccatccatccatccatctatccgtctcacttcctcccctgttccgttccatcgcccgatctgcttcttctacttctgtctgctcttaattggagtaccaagttatcacctgcagttccctgataattttggtacgccaagtagtactactgcatttgcatcccattcgatcattcatacttcactgtcgttgatggccttccaagctctgataagaggctggtgctgtgtctgtttggcagggaagaggcaaggacaggatgccctgggcagggacgacgtccgttcggctggcggtgttcttccgcgtcatcctgtgatcgatctggtcacgggcaaggcgatcggtcaccggcggtgaggggatccgagccgtgccgcggcggaggacatgtgcgttgggttcaacgggaggagccttgacaccgtcgttatgacaagtggcgccgtcgcatattactacagattgatgcaagtgtgccaggtgagagaccacacctcattctctcctcctccatctctttgtgttgcatttttgttcaaatttgcaggcatttcggttacttgcaaaagcgtgtctttttttctttcttctttatttgagagatcgtcgatcaatgtgctggtggtgggaatcataatcatcataacatttcgtggataagcaacttgctaattggtgctgtccgttagcgtatgtagatagaaaaaaggaagtcacaagatggtgtcgcatcgcatgcggataggtggggcccactgcatgcgggacctaccttgatgtcaaccatggggggctaggtctaagctagttgacaaaagttttttttcttttattaaaagacttgacaaagttttctgcggtcaaagtataggtgtgaactttgaggagcctagtacatattgtgtcttgcaattgcatcttgccgcagcctggggagcatgttcatgtgtttgtttccttctggtactaaacgatcttaattaacatccattaattagtgaatcgatgctcctatatcctcggttttacagtaattagttctatgccgcgtgcaaagaccatcttgaatgaagtgctaagctacgtgaagttgttctatttgccagtttatcacgtaagtttatcgtaatttggcataaccagaatcaattgctcctcagttccttgtgtttttttacctaatttagatataaggtgctgatttttttaaatcaacattttatctactagatcagtcaagctaatcagacgagcactcgattcactattcaatccaattattctatcatagttgttgtatcccttcctgtgtgcatactctgttttgctttcgtccaataaagtgtaaactatagatatacaaaaccatactctttttaattggcgtgttcgtactacagcagtacaacatacaaattgaccgaatagtacgttgcaatttaaccatgaatgcaattcatttttgaaactgagaaccaaatatgaagatctgtaggattttttctctggattgtcaccgctctgtacagcatacatcaacatcttggattacaaattcaacattttttttgtcaacttctattcgacaaattgatggataacagtctttgctcctgttctcgcctttatttctgtttcagtctgaaaagagcaagcactatcttcccatatacaacttgcctagattgctttagaccttttctcatatgctctgttctcgccggcaaacatctttgacgaattacattggcaaatcgcagcttattagtactttctccatcaggttgacacatgaaaaacttttacatgacgactttttacctactgtttgattctctcaatgtgaagtattgccttgtcaatcagagtagtaattcatcttcataatggttgttttctgcaggccgaatacttccgccagctgctcaagcccgtgacgtagattagctcacgcacacattccatccaaacagcctgaaacccccaaacaaactaaccaaatcaattttgaattggaccaaaaaaaaaaagccaagctccagttagcaaaacacctttgaattcatacttgtttagtttcgtttcaatcaaaagcaaaacatttcctgctttcccagacaaacacagccacacaaaaccagcacgaatttgagcagcacccgatgcagggcgacccagggtacgggtacggtggctacggctacggctacggctatggctacggcggcgccggctacgacatggccggctacggcggcggcggtggagggtactacacgagcgatccgtacaatgccgctcctgctgcttatgaagacccgctcgccgtcgctggtcggaggcagcacgacttcccggcgccgctcaccggtgtcgagttccagccgtcggacacctgccccaagaactacgtcatcttcgaccagacctacgaccggagccgggtcatgttccacccttcgctggccaacaacctgggcaactccggcggcggctacgaccaccaccaccactgcggctacggcggcttcgagcaggactacgccagcaagagcgcctactatggcgtcgaggacgacggcggcggcgggtgctcgatccggcagaaggaggacaccgacgagatcgacgcgctgatgagcacggaggacggcgaggaggaggacgacgtcctgagcacgggccgcacgcctgggtgccgggccgggggctcgccggactccacgtgctcgtccggcgcgtccaggtccgactgcggcggcgggcggaagcccgaggccggcggcggcgagaggaagaaggagcggatgaagaagatgatgcggactctcaaggggatcatccccggcggcgaaggatggacacccccgccgtcctcgacgaggccgtccgctacctcaagtcgctcaaggtggaggtcaagaagctcggcgtgcgtggctcaagcaggtagcgcgcgccacaacatccacagtcaaaaattttcctactttcaccctttggcagataagacgagactgactgg

SEQ ID NO: 58919 - DNA, 13402 bp, Oryza sativa
tcccggtttttaatggaaccgaaactattgtgaaatttggtcgaccgaccaaagatggtttctcctccagtgaaccgcttgctagcctgcacctgctgccggggacgacgagcaggcgcggcgaacggaggagggcgaggttgagggtcttgaagaattggtgggacttcatgtcggcggcgccgcggcgggagccgaggcgagcggaggggtccttggctaggagccgcgggcgatgaggccgtgcgcgtcggcgtcggccggccgctttaatttctctcgatccctaactatatatgccgccacgtgcatggctagctaagctcatcatcgatccatctccctgcagctacgtactgtacttgttagcaaccaatcccatcaaatcatccgccgcttgctgctgccgctgctgctacgtaactatacaccttgttagcaatcaacttgattagttaggtttaacgacgacggcaacagggacagatatgacggccgccctgcaagcgctgctcgacccgacggcgctgtccctgggcctgcccacgccggtgatcaacaaggaggtgtacctcgccatctgcctcaccgtgctcgccggcacgcgggcggggaaggccctggtgggcaaggccgtcctaggggtgtgcggtcagcgcgtccgcacagggcctccaatttccagggaccccttaggtccaaaacttcaacactagtctaactagttccgaaaatctgttattttttcttatcgtttcggtttcgattacgtctttgctggttcgaacagttgcgccggttcgcaatcttgaatcgcctcccactgtggaactcgccaatcgccaatcacaacgaacgagaggagtaaacgacgccttacctctctctctcgtgcggtcgtgccgcctaacgccgtcgccgcctgacacctgtcacgcccctgacctaattctttccggtaatttctaatccgataatccctaattttggattatcattttaggccatactagattgctatgaaatatattacggagtataaattattttcatattatatcatcaattaagtttttatccttcaactttgcacagggccaccctgctggtgggagtgggagaccagcaggaggtgcagccatgtaggcctgcaagcggttgtccccgaggtggcgagcggcggcgcgcaccgtggactggaggccaccctccgcaacattgtccgccgacctcttgccttcctctccgcctccggctcgtgcggccccgccaatgctgacatgcgccacctcatcgctcgcctccttgcgaaggaccccgccgcccgtctcggctcccacgcggcgccaccgacgtgaagtcccacccgctcttcaagaccctcaacctcgccctcctccgttcgtcacgcccacccattgtcccgggcactggcgccgcgccgctgcactggtcgcagtcgtgtaaggtggcgcggacaacgcaaccaccgccgacgataatgaagatggcctgctcagagtttagagaggagagagaggaggaaaggagaggaagggagaggctggcctgctttcgtggcatcctgagtcagccgccacgtcggataaatccggagtcaaaaccgctgatggatctagtttgcactggtttttataagttggaggatgagttgtatccggttttgtggttgggggacgattttgtaacttgatgacaagttcaggggtgtactttttccttgtagtagtagacccaaagtcccgcacacgcgccaagccgccaaccggtccttgcactcccgcctcggcggctgctgcttgggccgtgcgcatgccatgccgccttgctgcctgatgggccttgatgtctcgttgccaatccggctagcccgagcgaacaggccacctccatcgatcaaacagctagcttgatatgctacagtgatcacattaccattggtgtttacaatttgacaaaatttactacatcacccgctcaaagttcatggtctttgttactgcaaatccagaaaacgtgatacagtttataaatgctctaaaaaatcaaaccaataatttgctaaaaggcactgccaccattattttattatttgcggatcaaatagaaagagaaacaacgtagaaaagacaagtttgcccctctgcctccatgtacctcctgcggttgatcacctcctcccatcacgtccgtgcattagaaatttttactgtgctgctatggaccgctggttctgaaccgtttgggacttgaacaatttgtagtgaacccttgtgctagtataaaagattgtttgtgtatgtctactcagctcacgtacgtattcgacctagtgtttcagtgtattagcgtgataaataatagccatgctgcatgttctagcttgagagtataagaaataatatgcaaattaaggaaatgagagacgtttggcttgcctggaacagtgcgccttgtggaagtaatcggtggtttttgatgccgccggcgccggtgcggatgaagatgtggcgggcgcccaggcttgttggcagggcactggtcagctacggcttgcgctggtgcccggcccggctgcagcacacgcgccagttgtcgcagcgaaacgtactcgagccacccgtcgtcgttgttagatagcttgtcgtcgatcctgttagtgcgtgtactggtcgctgaagtcggcgatggtcgataatcagggtgaagatatgtccgccatccttgtctgtccgatccggatatacgtacgtatatgcctcgacaccacgccctcaggctgcacgcgccactgatgcctcgccgcggcgcgccaaggttggacacgtcagtgctcgtggcggcctccacggtcgcccatgcatgatgcgggtgcgccgtcaactcagcatcaatgtagtggaggtgtagctcgtcgatcgtcaatcagctgatggacggtgacgcggcacgacacaaagaggcggacgagcaacttggcggccagagacgcggtgcgcacgtggtcacgggcgatgtcggggtgaatataactagcaggttggcccgcgcatttgcgcgactaggtttaagtcattttatgttttactcatattacttttgttctttaaactataaaacatgtgtttgtttactaagtaattgttgtctgtttcagtataattctatttaatatttatctatatgtttttattctttaagcatatattaattgtgccatggtgttgcgcaagcttagaaccatagctgcatgtgagatcatgtgaactaccatcctttaaacttactcaagactattgtcggctgatgctctcttgtctgtccgctacagtggtcgagctatcatgttgtcatctccttgagcttgctctccactttagacattactatcatcaagctcgctttctattatcataccgtcaatcttgttccatggccattgcactctttgtgcttacttgtggttgtcaccttgtttgatctcgcctcatgcacaattgctattgtcctcgagctcaaaacttgcaactgaaactcatcagcaagggctgggtatccgagcttattcatgatcgtctcatcctcgatctcaactgaaacaatcactactgctatgccctcaagcttgtccacaaccaccattatatcgacctcgctcgacattctcgttaaatttcttgtgtagtttgtcttcaaacatatatgctctcaagaaagtggtgaggaagaagggtggcaaaagatgtaagcttgaaaagataatgcatggcttttaatagtaggacggtaaagatgagaacaaagatgattctttatagtaagatggcaaaagtgaactaaaattcctgctatatgtttaaaatcgtaatatatttactgtatgtcaattttgtctatctaaaagtataatgtggaaacaaataccttttgcaacctattattatctgtaccaatctatattatctatgattatggagaagattaaccaatgaccacatgaatatatatgatgtgcaatttgttctgtgccttatttcaaggctctttttacattatttctagtaggattttttgttgttaaatgtgtatgatctaatggtgtagaggtccaagtggctgtttatgttttgtttgactcgctgacgcatcaaaatctaatccttacgatctagatatattatgatctaaaaatgtagatttttcttttctatagcagatctagaccttacgatctaggtatattatgatagaacggtctagaccttacgatctatatatattatgatctaaaggtgtaatttttttctttttatagcagatctagaccttacgatctagatatattatgatgtaatggtgtagattttttcttttttcttttgtctaatctttttttttgttttttggttaatatgggattttctaacccgtgagagtgaacgtggtggctttttttctaattacattgtatttctaatcggattcttcttaactggaattttagatatttccagattgtatttatagatggactcttacctaatatcaattatggcggcgggcctcggctagggtaacagtgccggcggcgacggctggattagggttagggtttgtttattctttttttttgtttcgattttttatttttccgtgcgggcggcacgcgaaaatcgattttcccgtgcgggtgcatcgcccacacgaaaaaatcgcgtatttttgcagacgatttcttccagacggtcgaatcttctgcacgcgaaaatcgatttcatccgcacggaaaaatccttgtagtagtgtaatcgattttctctatttttaaaaaaataaccggtagccaatgaaattgtactagataatgcatgttgcatgcatgcattcacatttggcatatgtctgtcgttaacactcgtacgggctactccagaacatatattgtataagaaaatgcttgcttttgtcaaaagggacaagcacaagcaatagcaaacatacagatcactacaggttctacgcgtgcatatggtcaaagaatcattcgtatctgatcaagcagaagcgtatgtatgtacgtacatagctaggacatatacatacatacatacatacatacatatatatatatatatatatatatatatatatatattaactccctctctctctaacctaatggcgccatgagctacagttggacatagctagcttattaggcagattgtccagtgtcgtacttaccgagctgtctcacatgtacagtgcccacacgcagaagcatcccatggtgcaatgctaacaccaagctgtacgtgccatgcacacttctgatttgtccatgcatgcatggtcactcttatcatcatatcggttccatccattcattggccctcgatccatatcgatctatcatcgcatgcatgcaagcgctcctactaggtaggtatggtactccagtaataactccactctggatcgatatgatcgattgatcgtcgtcagacaccacacccaccaactacacatacacacatccttctcgagccttgaacaagctatccatcacctttcacttttatataaaggcaaacaaaaagcgatgatcttttaggtgagaatttactgtgtgtttgctatcacattattgtgtacgacatatgcaagaaatgtatggaaaaaatatattatatatatatgatgtggcttcagggctagtagctattttttccctgcaggtagatctcattaaaaaagaaactactagctagtgttgtccatgtttgccaacattgttggaattttttttttaaaatggaattagtaagcttagttggttaatttcaatatgcaaccatccgtgcatgcataaagaaatttgtgtagtctgcatctaagctggagatactattactacaaatactgcatctatgtttgaatgcatccaagtcttaaaaaaagaaaaagaatgttcaccacatgtcatcacaaaaatgcttgatatatacctagacccgtatcaggttcagtcaggtgacgaactaaaactctataagcaagaatatatagcagttaacaaagctctttaccgatagctacatttttgaagaaaaaatgtctggtgtgattactggacagcgatggacacgtatgtaaagcggttgcatgcattagtcaatgctagtcatgcatgtccgtcttacaagcacagcgcagcacgcgtacgtacgtacgcacgtaggatcgatcgagcaagcggctggtaagtgtagtgacataggccaggtgcagtaaaatgcatggcagacagggcgatgtgcaatgatcagtacaacacaacacacggccaggccggccggccattaatattttgcttctcatctctcttgctcctttttctttttcttttggctcgtcgtcctctagcgtttgtactggagacagtgtctgcgcccgcgaaagaaggatcaaaaaaattatacatatatatatatccaccagagaaaacaacaacaaaacgtaaaaaggaaattaaaggcaatgcagcatgcatgagatgagaaaaaaaaaagagcaaaagtccggaaagccatcggaaaagaaagaaagaaagagagagagcggccggtgctcgctttagggagcagcaaaagcccaacgggcgtcaccgatcgatcgaccgatcggccgctctgcagcagcgagcgttgcatctcgcatgcactttgcagagaggaagctagaggtagacgacgacgcgcgaggcatgcagcgaagcgaggagagcaagcgctgcaagcgggcgagagcgagtgatggagacgtgtgagaggagagaggcctctcctctgctgcaggtgcacgcatgccgtttgcgtccatccagtccacgacaagggaatatcgtcgtcgatgcagcagcagcaccagccgccctttgtttatttaccaccataccttgctacacatccactttactagtttcatatacacattgtagagggagaaagtaagagacagagagaaggtgttgtatatatactcctacctcacacattctcattctctctacataggagtatatatctgtcgtcgatcttctaaaactagtacgcacattctatctgtatgtcgctccgatgttcatcagaaagttgttaaaataatcaaagcatgtttgttgcaggatcattgtcttgaagggatcaaacgtacgcagatgtgattaaactattgcccgaatctctctgacccctttttcttcggacatcaccgatctggccgtaataaacaggctattccctgtttaactatctatccacggtctccaatgcaaatttgcagccaggaggaggatcggaatggaagcggcacttgcagtaaaaaaattgaggcatcgaaagaataggtcgcggtacgtacggccaggatcgtccgtagctgggatgagaattaccagcagataatatgtgttggttctttgttcggagcgagtaaaaaattagtggtaacatttaagccataggtaggaagcaaatcaagagagacatcgcacagtggattctgacatgactgtgcattcaggcgtgattactttaaggccagcacaggataaggctgctgatatcttcactgagacagcgagattagataactgctgccaggtgagctccattggtgttacttaagccagcttcaacatgattcgagcatggagagtttgggccttttattttgtgtgtggaaaggagagtgtgggcatgcatgtgtcaagatgggtggataaattggtacaaatggttgagcatatatatattatcaccttgagaagtgttacaccttagttacaaaatttataccctcataacctcacaatatctgcgccttattggaaaatgttacacatttatcattatttatataatacactgttggaatattgtcggttcttctttaaatgttattttacagacaagagaaacaaaattttgatcaaaaagagcatctgcgcccctttcaacattcataaaaagatggcaaatttacgggataggtaatcagagtgcttgggtggtgctcagttctatatatatatatcggtctgtactggctgcattttgatgaaagctttgataaataacatctctgtttgttctaaatcagcatacacatcgtttcatgcgatcgaaacatataattggcactctggtcaatgtagatgcgttgtactggagcacatattcgatgatttgcaaagtccgaattttcaataaattgcaaatattcgataaaaggacgcatgagttgcgtcaattactcaaaaattcacaaggttcaaactggaaacagcagcagtcagcagtgcgctcctaaagaaagcaaattcaaccggggactttctgcgcccaagactcccaacactccccacgcataattcacaccaagacaccggcccatggctcatggcacgcacagttgtcgccgctggatcttactgtgcatctcaccttaccctacatgcgtagtactccccttgacgatctacctatatttacacataaacgcaggacctaggagagggctagaaccaaacggaaccagaacccacagggccactacggcaaaagcacggaggagtagggggtatgtaggacactcctccgggcagcgtacatcatctgggtgttccgatgataggagcagtgtttaggagaaaagcgctctgctgctgcatgcaggctgcagcaggcactagccaagccaagagagaagaagaaaaaggcgacaggggagacagacagggcgcaatcatgccgacccccccaaaacacgactcgattccaacctacacaaacggcacaaccacaaacgtccacgcccagtttccttggactctctcctatgctcctatgcatcctactactcgctttctcgctcacctgcacgcctctctctctttcttggaaaacgtgacacattctctcctctcctctcctactcccagattctctctcatggggggatggagtgagtgagcgagtagttttttctaccagccccataacatcgcaccatcgcataatggaagagagaattgaaacaagttgcagcacgaccacaagacgacaatctgccccaagacaaaaacttgctgcttataaataggcacatgcccactacactaccaccaccactactaccccccctcaaacaacagaacccccaccaccaaagcacatacggcaaagtagccagacaaacggaaactcaaagagaggagagagtgagttcctttgatcatacagttgtttttggccaatcatcgtccgaggagagatggggatgcagagcaacgacggcgccgtcatgttctcctccatcgcgctgctgcagcagaggttcagggagctggagaggatcaaggaggagcgggaggagaggctcatccagatgctccctccccgctccgaccgctcccacagtggcgctgcggccgtcgtcgtagccacggctgctccgagggaagtgccggtgaaatggttcttccatccggagctgttgtatccatgcaggcctctgcgtgacatggctgctgctaccttacttccggtcatgccggccaccatcgactgtgaattcaaaaccttccagctccgtggtgactcgctcgccgtggacctgtggcctagtaaggcctacaagcatgtatccagtgaagttgatgtcgacacctcactgcacctctagattactactactgctactaaaattgctatcctaagctgttaaccttccaagtatccaccagtgttgctgctctagttgtttttggtagcctagtatgtttctcttcttctttggttttgtaacaaggggcaggagggtggtgagttgtaattattgccagtagtaagattgtgctggttgtttccctgttaccttgtcgccgctgaattgccagcatcttccaattgggcactgttatcgtctgagtagtagagtagctctgcagggcaaccattttctgatgtatcagtacactcctcatcatcgctatcggaagaatcaccagggttctgtttcttccgtttgatgatctttttcgaaatcatccggttaacacccttgctgtcaacatctacacattcgctgctaattggcttgaaacggactttgccaacctttcttgcattagcctctagtatctgcaagggaggccagagatttagaaaaggtgacaaaaattatactccctccgtccctaaatatttgacgtcgttgacttttttaaacatatttgaccgttcgtcttattcaaaaaatttaagtaattattaattattttcctatcatttgattcattgttaaatatacttttatgtatacatatagttttacatatttcatataagtttttgaataaaacgaacggttaaacatgtttaaaaaagtcaacagcgtcgaatatttagggacggagggagtaattagtaagcagaacatgatgcaagttaaagcacaactgaggaagcttcagattcctaagaaggattgctaactgcaccaaaaaaaaaagatctggagacaactaaatcaaagttctgtacaaaacgtcaatgaaaagtgttgtgattattctgctaccagctcttttttcttgagttatttattagaaaataaaaaaatatttaagtaatacgatcttgagcaagataattgtactactttatatccctgcataaatagaatatttaaaatccactttccctagtaaggaaatggtaagggtgaaaaaaaatatggcaagcataattgggcaactactcttgtggtaaacaatgtttactaaacatgtgaaaaatatgcaagctttggaacttagtccagcctgactagagatcaagtatgttggtatgtttcctttttttttcctgaagacaaatatacattatacatggatttgccttcatacagttttagtaattcaactgttttattatattgttatctagagaacataagtgtaataggtaaaaaaaaacaaacaagaagttagttgtttcctagaaccatgttacttttcatattacccttttcatttgatagttgacaccttacatcatgtgttatgcttaaaattatagaatatggatatatgaaaatagtattatactttataaattcgagtgatctaaagttggaaaaataataattgtaagtcacagctcagggactgtaaaaaaaaaagcaaaataaaaaaagagagaaagaaatgagtactggaaaaaaacagctttattgtgggctatgtacacagaataggcatgaacacaataaatatcttccaactgaaaagaaagtggtgacataacccaataaatacaaccttgaataaaagctaaataaatcaactgaagtaaacgttctcacagggtttttggaaacctgaactaggtcagacagcagaaggggcactggttaaaattcacacaaaaatcatcaaatccagctacctttcttttttctcaactttttttttctcaattttccatgttttccccggatttgaccctaagcatataaagcatatgcaactacaagtctattgatatgtaagatgagtttgaagaaactattattttggacatggtgaaccaaaataggggtaccaaaagcagacatggtgattgagcagtatggtccattttttatatatatggtggataaataattcaaaaggtgcaatgagtttgacaaattttccattttcatgaactctaaactctagccagatttggtaagcagagattgtaggctgatggccaagtgggattggttaggccagccaggtatagttgcatgatgtgccaagattattttacagtgcatagcacgagggaacctatgacaaggacatggtccatgggttgctaaaattatggatcaaagaagaaaggtaatctgtaggtcactagttatttagcaaattgcattaaacagacaaatatcatgagattgacaactaccctacaaagccccacattctcatgccttcactccaaatgacagctctcggcagcagccccctcttcagccacagctccccctgctgtctcatccttcctccacccctgactttaggatacggtggagaacatccagagggagacatcttggacgatgtcccatgtgggatgaacttcacaactgtattcataaggggatcctagtgtggtcttgaagaaccaaaccacggaacaataacttaagtccatgccccaaaacctgtttgccacgagacaccacgacccttgcactgggataaggaaccaaagaggccagtgtatggatccgagctgacacaaaggaaacaaggtttgaccttcagctggtccttgatgattcaggtcacgccaccttgctgatgtagttttgaaattccgccgtaagcagaacattgtctgagactgttcacctatggcctttgtactccctgtgtacttccaaatttttctaaagttatgtatagtgagtgtgtgttttggaggtaagaccaccatgaaggtctaagtgctctggttccaaaagttcaggagtaaagatatccaattgtgcagttcatgaggttcagtcaaaacctgaaacttaccccaaccttgaggtggtaatattgattattccattgcctttattaatgctatgttcaggttaataactgaagtactgaactcatattaactattttcaaataaagcaaaaaaatgaaaaacaaattatcagaacacataactgaacatttcatcctatgtagaaatagaaaggtatttaaaaggcaaagtagtacaaatagaacgtgaacaaaatggaaatgaatcaccaaaggaagttttggacatgacacaaataacataagccaattttgttggatgacatttgtgcatccaaatgcattagaaaccattccgggcttggaaaaaaatcactaaaaaaatatagatgcaggagatgttcatctctgcttacaaaaaaaaaagttataaaatgtatcctacatgatgaaatgatatgaacaaccaaagtagctaggaacatcaacccgagttcctattttggttgttttctaaagtctggtgtgaagttagaaaacgtcttatgtatgtatatgggctggagtgtgtgtgtgtgtgtgtgtttggtgttgtatcccgtatgttcttctttaacaaaatgacaagcagttctcctgcgttcgagaaaaaaattgtaccctacaattttttttttttaaaaataaaggccatttctagaaagtagctctagatctgtttattgctctttgttttcctgatatgcagaataaaacatctagggtaatgttggc

SEQ ID NO: 58920 - DNA, 2645 bp, Oryza sativa
aacaggacccaaagttttgctataataagcaatagggtgaccctgctgacttaaaacaacaccaagaccataagcacatgcatcagtctccaaagtaaaaggaagctgaaaattgggcaaagctaacactggagtgttactcatagttgtcttcaactgatcaaaagcaagctgagcagcatcagtccaaagaaaggcattcttcttcaacaagagtgtcaatggtcgtgttatgatactataaccctgaacaaattttctgtaatagcctgtcagtcccaaaaatcccctcaattcagtaacagaagtaggcacaggccaagccagcattgctgctgtcttctcaggatcagtactaactcctttgtcagaaatgatatgtcctaagtattctagttgagtgcaagcaaaagagcatttagacctcttagcaaacaactggtgctgcctcaaaataacaaaaacttgctaaagatgatgcaaatgactatcaaggtcagggctataaactaagatatcatccataaacaccaacacaaacttcctgataaatggtgcaaagactgagttcataaggcactgaaaggtggagggtgcattcgtgagaccaaatggcataaccctaaactgaaattgcccatgatgtgtcttaaaggctgtcttggcttcatcagtttccaccattcgaatttgatgatacccagctttcaagtccagtttagagaagaatttagtgcctgagagctcatccaataattcatcaacaaccagcataggaaacttacttttaatggtgagagcatttaatcttctgtaatccacacaaaaacgccaacaaccatcctttttcttgacaagtaaaacaggtgatgcatagggactcatactaggtgtaattaaaccagcatcaatcatttcgttcacctgtttctcaatctcgtctttttgtaatggataatagcgataaggtctgcagttgacaggaatagcatcaggtactagagaaatagcatgatcaaaaaccctgtgtgggggaagacacttaggatcgtgaaagacatcgtcaaagtcagttaacaattgttgcactgaagaaggaatcacatgctggacatcatcctgggaatgttccaacaaagcagcagtccatatttcacaacccttatgccatttcaaaagttgtggcagagtgacagcagcaatttcagaagggactgcagcatcttgtactccttgaagagaaatccaagacccttgatactgaaacttgagtgttttattagcccaatgacaagacatttccccccattgctcaagccagtccctacctaagatggcatcgtgaccccccaaagtgaccaccctcatgtcataagtaaatgtgtgcccctgaatccaccaagaaaaaccaggaaccacatactgacaaggtaagcaatcaccattagcaactttcaccagagtagaaggaattggttttagaggtaaacccagcatctgtgcaaagttgtaatcaataaagctgtgagagctgccagaatccaccaaaagtaacaagactttactgtgaaccaatgctctcaaatgaatagcagtaggaaggtgagctcctgtcaatgcattcagagaaatatgacagtcctcctcatcatcagattgttctgcagcaataacaacatccaatatgtcatcagtgagcacctcttccaactgcatagctttgatttggcctccaacagcacaacgatgttcaggagtatatttgtcaccacacttaaaacaaagaccctgagcacgtcgatagtctttcaactgcttagccttccatagatcctctttatctactcgacctggagcagtatcagaactgatatcactcttgtactgaggaagtttcacaaatttccctttgagagctttggtagctctactagccaagacagattcctgcataagagcaatagcagatgcttgctgtacagtgtcaggcaattgaacaacaacagcagctcgaatttcttcagtaagaccattcataaaacgagtcactaacattttatgttaccccccacagatggatcaaacactctgatctgatagacaagagaatcaaattgttgtttatactcagtcattgtaccagtttgagtcagagtatctagtgcagacattttctcacgttccacaacaccctcaaattctgtttcgactgccattctaaactgatcccaagagttaacctcattcactaacttataagaatgataccattgagccacatttcccgacatatgaaacacagcagcagagactttgaaattttgagtgatttggtacatgtcaaaataagtctcacacatatccaaccaaatccgcacatcagaaccatcgaaacgaggaaaatccattttaggaagtggctgatgacgccgataaatcccatcaccaaaaccacgacccaaatcaaccccatccaacacaggaggaacaggtggattcaacggcggaggagtcgcggaacctgcaccttgccgacggaatccatggcgagatccaccttggtagtcaccttctcgagactgccaccttgggaatccagccgctgatcaatctcgtgcatccactttgtgatgccttccaacttc

SEQ ID NO: 58921 - DNA, 14498 bp, Oryza sativa
atttccaaccgaaattagccgagattccataagagaaaagatagagtggatcgcggggatcatttcccctctatcgattcggccggagatggaaaggagcgacggaatttgaaaggccgccgtcggcttgcgcgtggctagggcacggctgcgacggcgcgaggttgacgacgaccctgacaagtggggcccacctgtcagcgggagagagagagaggagagcggcggctcggttgcgggccggcttgggccgaggagagagagaaaaagagagaggatttgggccgactttcggcccaaagccaaaagagacttttaaaaacctttttcaatttaaattattcatgaaatgcaatttcatttattaaaaatacttccttggctcaaataaatcccagaaaaatctaggaactatagaatcaagcaaagtatttaatgaaattttatctggccccattttatattgggatttattaattaaaattagatcttctcttctaggcttttaagatcatttctaataattcccttttagacaacaatttataaattaaggatttttaaaccagaaaagcacttaatataattataattagatcattaatgattaaataattactgaactgttctttgtatcatttaggaattgagctccgaaaaatccgagaaaatttcagagagtataattaatcatggagaatttaatgaaaattaaatccatccatgctttaaatttaggaaattttatttcccacatttgacttcacttgtaaattaaagaatatttaatataaattctattaataatttattagataatttataaatcctgaaacgaaaatgaggatgtgacattgatcctatttaaagctattgtttctattcaactattgcatttatttttgaatgtcaccgggtgggaacgacctatttcctttgttatagccctttgttattgattacctatactttgtcacctggttaataattggattagctagaacattatatggttttagctaaagtaattaggatgcttagccatgcttagagacactagctcatatgaatgggataactaatgattcactactacttaatgatggattaatggtagctcatgaaggtcaatcatgataggatgattaattaagatgccaactaaaacatggtaaaggtgggttgtgagcacatggttttgatggtcgtgctcatgacaattaaggaccggttcacgattttcagttgtgaaacattaaccgtgccaaccacaagccagcgtgggcaacggctttacattttgtatagtgtggttcattgtgggcaccagactgagaagtggcagagataagcccacgggggtcgctggggagtccatgccttgttttataagagggtgattatgatccaggaatggtgcactgctttgaattgtgttatgcggagggtattgtcacaatctctattcgggtacttgttaagtatcgcgacgcatggttgacatgatgttgaggttgtgtcttgtgggtacagtggtacacctctagccagagtaaaactattcgaatagccgtgcccgcggttatgggtgggtctaacaatgtctttcatgattagtctcacacctctcaccataatatatgatgttgtaattgattataacttgtttagctcctggtttggaatggtatattcctggtttggagatagaactgtgtagccaggaatggttgttcagaaagtttgggcctatgcaacgggtatgctctatagcgttggattaatattgtttaattaaatactttactgtttttttaaattcaaaagtatttattgaatgccatttatgcaaatgagactattatgccatcctttgttatccctgcacttgcatatttgctgcatggcttgttgagtatgtcagatactcaccttgcaatcattcattagaggaggagttctacagtgatgctgaaggtgtggaggattaggcgtagccctggtcaagctgcttgtgggatggagtcgcctgtgctctttattttattttccgctgcttagatctttattgtttgagaggaactatctacctctgtaatgactttatattcgcctattaattagagtaataattgcactctattatcaatttgttattgtgtgcctcagctgatttctggacgaggatttacacacatgtaagcgtttggagttttggatagaaattccgggcgtgacaagttggtatcagagcctccttgaccctaggttatgccaaatggttacctatagaagccctctaaaaatattgaaaaagtagaacggttctcctctctttctcttttaattaaaccaagctaatggcacatgcagattatagtctctttaattgttctcattcaaaatttacttattattcctgtgttgttagtactgtacatctattactgtactaatgggccatttaccagcaaaagttttacaatgttacttttatttaatcatgttgcaatataatgaacttagcatgttgattttataactctcttttattttatttcttttgaaacctgttattcaaaagtgcaaaaatttgtgatcctgttttcaactgtttcaacttatcttgcaagattagtttactttatttacctttcactttgattttctaactttattcaatttaattcaaaaacttgtgctattaattggataaatgtcttaactccctcctttctcttgtccttagatgccgcgcttcaagcctgagtacttgttcggtgttgagggatttgtccaggagctgcgtacgatgtcctttaccataggattcgggactgcccctttgtatgcccagattcctcatgatcgtgataaagagaagtgctgtgtcaaggtcaccttgaatagtgatcgtgaagacctcccatcggtgatcttcgaggctggagggggaagctatcctcatgcttgtcaggaggtggcaaggatcgccataggagagctctggaccgttacaatgatctgttggccgacactgagtatcgctaccatcctcatcagccccagggaagggaccgtgccagctatgttgaccctgaaggaattgagaatgatgctagcacaagacatttggtcgagatgctgtgggccatggatgagtcccacgctgaagtcgtgtcagctactcaagctcgtgaagaccggaaccatggtaagatctacaagctggaggacaaggttgatcgtctggagaaggaactgaccgaattgaagggagaagcgccaccacagaaggccagggttcgtcttaccgcaaggaagagagctctttttattccccgctaccagttggtgcccaagattcgtgtggtggcaagagaagctgtcccaatcccagtggatcctcgggtcgttaatttaagtgatgatgagaaagaagattcagagcgcacccattcaaaggttgagtggggtgttacttaagatgatgaggacgagccgaacgagctttcaatcaactccgatgccaggaagacctagacgtcttgttgagtcgttgccttagcgcgttgtgttagtttgcttgtttaagtttggttgtgtgtgtgggtcttgcatgtggtttacatcattggtgggatgtaaatgcatgaatttgtttgctttcaagtgttaggaagtttgagttaagtggtgtgggagtcttcagttttatgtaataatgaaactaagttcagattaataaaagtcaagttagtagaaattaattccctgtcgtaagtagttttcccccttcttgttctcttgcctatgccagatggtgaacacttgcagcaatggaaatgggcccaacaacaacaacaacaacaacaaatgagagattcccacgcttgcccaagtcctagctcaacaggcccaactcatgaacatgatgatgcaacaactccagaaccaacagaactaggggaacaatcacgctcctccccagaacaagttagcagaatttcttcgtgtgaggccgcccactttttccagcactaccaatccggttgaggctggtgattggctgcacgtcatagaaaagaagctggacctgcttcagggcactaaccaagaaaaagtctcctttgcttcacatcagcttcatggccctgcctctaagtggtgggatcacttccgtctcaacagggctactgctgaaccaatcacttggcttgagttcactgccgctttcaggaagactcacgtaccatcgagagtggtgtctctcaagaagaaggagttcagggcgctcactcagggatcccgttctgtcaccaagtacatgcatgaattcaatcgtctggcccgttatgctccggaggatgtgtgcacagatgaagagcgtcaagagaagttcttggaaggactgaatgatgagctttcttaccctctgatgactagggattattctgatttccagaagttggtggataaggccattcgccaggaggataagtacaaccgaatggaacagaagaaacgcaggattgctcacttcaaagctcagcagaggaatagtcagaggtcgcgtctcactatgggacctcaggcagtgtcacagggaggatcttcgtctgttgttcgtccacagcgtcagttcttcaacaacaatgctggcaataacaaccgcaaccaagctccacgccctgttgcaactccagtccagcaccagcctgtcaagagggagcaaggaaacaagccaggggtgtgcttcaactgtggtgaagcaggtcattattctgacaagtgtccgaagcctcgacgtgtgaagattgttcctgtgcagaataactccaatgcaccaacgtcaaaggctcgtgtcaatcatgttgctgctgcagaagcccaaggtgctccagatgtgattttgggtatgtttcctgttaactcagttcctgcaacagtgcttttcgattctggtgctacacattcttttttgtctatgagttttgcgggaaatcatgggatggagatggaagatcttagacgtcctttgatggttagtaccctagtaaccaaggactctcatcacaacgtagcccttctgtcagaatagagattcaaggtgttccatttctggccaactttattttgttagaatccaaagaccttgatgtcatcctagggatggactggttagctagatacaaaggtgtgatagactgtgacaatagtaaagtaactctcaccagcaatgatggtcaagttgtaactgttcatgcattgcctactgaacctttaaggtcaagtttgaaccaaataacattggaagagattcccatagtacgggactacccagatgtgttcccggatgatttacctggtatgccgcctaagagagatatataattcagaatagatctggtaccagggacaaccccgatccataagagaccttatagaatggcagccaatgaattagcagagggggatcaagagacaagtagatgatttgcttcagaaaggatacattagaccaagttcatctccatggggagctccagttatttttgtggagaagaaagatcatacccagaggatgtgtgtggattatcgtgcactgaataatgtgaccatcaagaataagtacccaatgcctagaattgatgatttgtttgatcagcttaaaggtgccaccgttttctccaagatcgatcttcgatcaggatatcaccagttgaggattaaagaggaagatatacctaagacggcttttaccactcagtatgggttatttgaatgtattgtcatgtctttcagacttaccaatgcccctgctttcttcatgaacttgatgaataaggtgtttatggaatacctggataagttcgtggtggtctttattgatgacattcttatctactcccgaaccaaagaagagcatgaagaacatcttcgtcttgcactagagaagctacgagaacatcagctttttgccaagtttagcaaatatgaattttggttgtctgaagtaaagtttcttgggcacgtcatctcagccagaggagttgccgtcgaccctagtaatgtggaatccgtaactaattggaaacaaccgaatacagtttcagagattcgtagtttcctgggtcttgcaggctattaccggaggttcatagagaatttttccaagattgctaagcacatgacacgcctgcttcagaaagacgtgaagtacaagtggtcaaaagaatgtgagcagagctttcaagagttgaaaaatcgcttaatatcagcacccattttgattttgccggatccaaagatgggtttccaagtgtattgcgatgcatctaagcttgggttaggttgtgttctgatgtaagatgggaaggtggttgcctacgcatctcgtcagttatgtccccatgagaagaattaccctacccatgatcttgagttagctgcagtggttcatgccttgaagatttggcgtcactatctctttggtactcatacggaggtgtacacggatcacaagagtttgaagtatatcttcacccagccagatttgaatatgagacagcgaatatggttggaattaattaaggattatgacatgggaattcattatcacccgggaaaggctaatgttgtagcagatgctctcagcaggaaaggcaattgcaatgctacggaaggacgacagttgccatgggagttatgcaaggaatttgaaagactgaatttgggaattgtcagtagaggttttgttgcagctttagaagcgaagtccacactcattgattagtgattaggttagagaagctcaaaccaatgatcctgatatccaagaaatcaagaagaatatgagaagaggaaaggctatcggttatttggaagatgagcaaggaactatgtcacatcctgattttcgtcttaggatttataaattatttaataaattattattagaatttatattaaatgttcactaatttacaagtgaagttaaatgtgggaaataaaatttcctaaatataaatcatggatggatttaatttttatttaattctccatggttaattatactctctggaattttctcggatttttcggagctcaattcctaattttaattatacaaagagcagttcagcaattatttaaataataaattaatccttaaatggtctgattataatcttgttaagtactttgagtgtccaattagtttcaggatttttcctgaaattatttgagcattggaagtatttttaacaattcaaagatcattttggtgattgatttatttggaaaagtaataaaaatcctcctcctcagcttgggcccttttcggcccattccttcctcccttctctctgttcctcagcccagcgtaaagtctaatccttctccctctcgctacagtgcttctcctacctccagccggctggacagaggtcgtgttcatcccgataccggcgccaatctccgccgaacccggtcgcttcgttgcttcccttccaaaattgattgcaaaaacggattcctctctatctcctctatcttatccacaagaaacctccatcaaattcgttaactatctcacgaattttggtcgtttttattcgggtgaactcgagataaatcctaatttccttcaccaaatccatctgttcccgaggcggtctctccctcttcctgctataaatagcatcccctcggcctcctcttcggtttccctctgtttcccgaagttttccctagccctagccgcctccccacgctcgtcttctctctccgtcgccggcagtcgctccagccgccgtttgccgtctcctcggccgtcgccctcctgcaccgccacctccctcggctccgcaaggtcgagctctaccccgtccactggttcccctccgcctaatcccgccggaagccgctgtcaccgtgaaggctgagttcgccacccctgtttgatctccggccgagcctcctcgctattgcggtcgtcacccgttcaccccaaggacgtcgtcggcatcgcagcgccaagctgaagcccgtccacccgtccgttgccgccactcgtcgccggaaagccgtcgccatcgtcaacccaaggtcgccgcccttcggagctcgtcgccggccatctccctcgccgtctgtcgtcgcgtaagtggtggtaagggtcgccttgatctcctctctctcccggtgccctccatttgcatcatcgtaccgtggttcgctggtaaccgccgttcccgtgctcaccggcgtcgatcccgcgtggcagccatgtcatcgctgacatcagcgccatcttggccatcaaaatcaatataaatcctgttatccctttgcaatggcatattagttctttttactatatgtcgtctactaaattcattccaataatttccggaggatgctttagtcttttatctcagatataaattatttgtaaattgtttaattaatttggaatagtattttctttaataggctttaattggaattaatcttgtaaaattcataactaatccatatgaagtcggaattaagtggttcaagtctctaaattcatctaaaattatgatatacatgtttgttttctttttatgtacggtttatttggtttttattagtctttttctttgttttgtgtgttagcttgtcgtttccgttgttgcgaaggttcgtgagtgcgtcggaagtgttcaagaagactaattgaagaccgattattgcaaggcaagtcacacagatcccaaacaaccctttaagcatgttgaacccgtttaaagctaatgttttatgtcaacttatgcattattttcgaatggcatcgggtggtgagcctttcccaattaattaatggccgaagatgactttattttcctatgggttatactttgattagctagaaccttatatattggtttggttcagctaaatgctatatatatatatataattgcttagccatgcttagaaacattagctcataaatgggatgaatcacactacattattatttatgattatatttaatggtagctcacgatggttaattgtgttatgataattaattgataattaaaacctgattaatggtgggttgtgagcacatggttttgaaggtcatgctcttgacaattaagaaccggttcatgagctactgttgtgagacattaaccgtgccaaccacaatccagcgtgggcaacgactttaccttttgtatagcatggttcattgcagggcaccagactgagaagtggcgagaagtccgtggggttcgctggggtgtccatgcctctgttttttttgagggggtgattatgatccaggaatggtgcactgtggtgagttgtgttgtgcgaggggtactgtcacagttcctttccgagataccgtggtggcattgaggcgcatggtaacatgtcgtggagctgtgtcttgtgggtacagtggaacacctctggccagagtaaaactattcgaatagccgtgcccgcggttatgggcgggttaagcaatgtttttcgtgattagtctcatacctctcacaataattattgatgctataattggtaataatttgcttaactcctggtttggagttagatctgtatagccgggtatggttgttcaggatagttgggcctgtgcagcattggggtgctgtgcagtgttggttaaaattgatgattaattactctactgttttactactcttaaatgtttgctaaatgctgcttttgcaaatgagcctatgttatgccatcctttggtacccttgtgcacttgcatatttgctgtgtggcttgttgagtatgtcatatgctcaccttgcaataatcaatcaacctcagttgaagaaaaaggatccgaaggagaagacatttggcttataccccagttgagctgcctgtgggagtggagctgaagccatcgctagaccgttattccgctgctgtttttcttttggtttgtaagtatgtaacgttattattatgatggatttgtatattaaattgtcagtttatgtacctcggctgattcctggacgaggattctatgcacaaattagttcagaaattattagtaaatttctaggcgtgacaactgtatggttgggtgagagaatttgtgtcccagacaacaaggagttgaagggtacagtcctgaaggaagctcatgacactttatactccattcaccctggtagtaccaagatgtaccaagatctcatggagaaattttggtgggcgagtaggaagcgtgagatagcggagtatgtagctgtgtgtgatgtatgtcagcgagtcaaggcagaacatcagaaacccgcaggtttgctgcagcctttaaagataccagaatggaagtgggaggaaattgggatggatttcatcactggtctgcccagaatgtcatctggccatgattctatttgggtgatagtcgacaggcttacaaaagttgctcattgcatccctgtgaggacaacatattccggaaatcgtttggcagaattgtatatggcaaggattgtgtgtttgcatggtgttcctaagaaaatagtatccgatcaagcgagccagtttacttcaaagttctggaagaagcttcttgaagagatggcttctaagctgaatttcagtacctcatatcatccgcaaacagacggacaaactgaaagggtaaatcagattttggaagacatgttgagagcttgtgttttagacttcgatggaagttgttataagaatttgccttacgcagaattctcgtacaacaacagttaccaagctagtcttcaaatggctccttatgaagcactgtatggtcggaagtgccgcactccacttttgtgggatcaaacgggagaacgtcaggtttacgggactgatattctgagggaagcagaagagaaggtaaagatcattcaagaaagattacgtatagcccagtgtcgtcataagagatatgctgacaatcgccgcagggatctaagttttgagaaaggagatcatgtgtaccttcgtgtcacgcctcttcggggagtttatcgttttcacaccaaagggaaattggcaccgcgttttgtgggaccatataagattgtcagtagaagaggtgaggtcgcctatcagttggagttacctcaatccttggcaggtgttcataatgtgttccatgtgtcacagctaaaatagtgtttgagggtacccactgaagaagctaatcctgagcagatagaaatccaggaggatctgacttatgttgagaaaccaatccgtatcttggagacagatgagagaagaaccaggaatcgagttatccgtttctgcaaggtccaatggagcaatcactcggaagaagaagctacctgggaacgagaagatgaattaaagtcagctcatccgcatctcttcgccagctcttccgaatctcaaggacgagattctgtttaagggggtaggtttgtcacacactaaaaatcccaaatttataaattgttgtttaaatggaattgttagaaatgattttaaaagcctagaagaaaagatctaattttaagtaataaattccaatataaaagtgggtaaatttttattaaatacttcccttgattctacagttcctagatttttcggggatttatttgagccaagaaagtatttttaataaatagaattgcatttcatgaataatttataaggaaaaaggtttaaaaatccttcttttggttttgggccgaaagtcagcccaagtctctctctctctctcaccggcctatgcgcgcccggctcaagccggcccagttcgcccctctctccctcctctctctcccgctgacaggtggggcccacctgttagggtcgtcttccacctcccgccgccagccgcgccctagctgcgcgcaagccgccgccccttccagattcggtcgcatcttttccgattcgatcaaattgatagaggggaaatgatccctttgatctcctctatcttttcccctatagaaactttagctaatttcgtttcgaaatcgtcggattcgacctcgattcggatttgatttcttccctccaaccctaaaccttccattgctgctgttggtcgctgtgggcctagccgccgcctcttagccactataaaaggatccccaggacgtcctctgttcgccgccaccttcgccctagcccgccgtcgtttgtagcgccgcttccgcgtcagcccgtgcgccgccgtcgtcgccgcaagtgcagtcgtgcggcaccgccgctcttgtcatcatcgtcgctcgggaaggtcgccatcgggttcgccaagtcgtagccgtcctcgtcccgtcctccgtttccgccaaaggtcaccggagcaccgccgtcgccgtcgacccgaacgtcttcgccgcctcgacctcgccgccgtcgctgtcggttgtcgtccgtcatcgtcagagccctcggtgagttcgccgcgtcgccctctacccgtaggtgttgtccgtttgcgccgccgcgccgtcgttcgccggcgagcatgaggtgccgagccgccgtcggcaatgacgtcatcatcgacgtcagcaccacgtcagccgtagacccgtggtagatcggttagatcttggccgttcgttttgtttagattagatctcagccgttcgttccgtagaccgcttctgtgcacccggtccaccgtgaacccgagccccgctgacgcaataaatcctttttccttttcaaaaataattctttattgcgtcataatcgaattaaaatctatataaatgatttaatccgatttaatctttaaaaattaataactaattcatcttagctcagatttagttggttcaagtctctcaatttttctaaaattgggatctacatgttaaaaatatccacatgtgctgtttatgattgtttatgtactgtttggtgattttgctcttttatgcttagattccgacgttcccggagagtccggttttgcaggagaagactgaagaattccaaggccagcaaggcaagtcacacagatcccaaacaaccctttgagcatgttgatcaagtttaaagctattgtttctattcaactattgtatttatttttgaatgtcaccgggtgggaacgacctatttcctttgttatagccctttgttattgattacctatactttgtcacctggttaataattggattagctaatgattcactattacttaatgatggattaatggtagctcacgatggtcaatcatgataggatgattaattaagaggccaactaaaacatggtaaaggtgggttgtgagcacatggttttgatggtcgtgctcatgacaattaagggccggttcacgatttttggttgtgaaacattaaccgtgccaaccacaagccaacgtgggcaacggctttaccttttgtatagtgtggttcattgtggggcaccagactgagaagtggcggagataagcccacgggggtcgctggggaatccatgccttgttttataagggggtgattatgatccagaaatggtgcactgctttgaattgtgttatgcggagggtattgtcacaatctctattcgggtacttgttaagtatcgcgacgcatggttgacatgatgttgaggttgtgtcttgtgggtaaagtggtacacctctggccagagtaaaactattcgaatagccgtgcccgtggttatgggcgggtctaacaatgtctttcgtgattagtctcgcacctctcaccataataaatgatgctgtaattgataataacttgtttatctcctggtttggaatggtatattcctggtttggagatagaactgtgcagccgggaatggttgttcagaaaggttgggcctatgcaacgggtatgctgtatagcgttggattaatattgtttaattaaatactttactgtttttctaaattctgaagtatttattgaatgccatttatgcaaatgagactattatgccatcctttgttatcccctgcacttgcatatttgctgatggcttgttgagtatgtcatatactcaccttgcaatcattcatcagaggaggagttctacagtgatgctgaaggtgtggaggattaggcgtagccctggtcaagctgcttatgggatggagtcacctgcgctctttattttattttccgctgcttagatctttattgattgagaggaactatctacctctgtaatgactttatattcgcctattaattagagtaataattgcactctattatcaatttgttattgtgtgtctcggctgattcctggatgagggtttacacacatgtaggcgtttggagttttggatagaaattccgggcgtgacacaccaagtcttagatcggctatatttgtttgacatctaactgtcttcaaatttctcatttgtaggccttagccgatctattttcttttgatatcaaagattactttgatgagacagaaga

SEQ ID NO: 58922 - DNA, 5774 bp, Oryza sativa
cgggcgccgtggcgaatcaggaagaatccaacgcacggggacgcccacaacctggttctgataccactgtaacactatgccaccgcgaaactcgccgccgacgagagagagagatttagacgagatcggagttggggacgaagagaaacagagctgaggcagaggagagatagagtttggagagagatagattcgatttcttttgccaggttggccacagccattctctctcttgagtatttatctcctgattacatgggccattggcccaaacgatttaaggcacgcaggccgcattatatttgataaagtctagcccaaaacacacacactatcattcacagttaaacctctttctcagtgtcaccattgccggtcatgacaggtcaggatgtttcatccaatgatcaagggaaatatccataaaaagggaacctttacctcttggaatcattggatgatacagagaagttcttgctgagccatttatatgaaatctgtcaaaaacacacatatcgattgttgaaacagtctgccaaggtaaacaaatccaacaactcaaacaatttcaatgaatcaaccactaaacaagtaacaagaatattacgagaaaggacaggcaagtggttcatcctatggtcatgtggagctgcagtatcacactcgtttaatcattatgtaaataaactcatgacatacaacaatctgattggaaactccaccatcccaagctgaacaaacttggccagttcctgttgaatttgacaacaaaaggctgatgcaatgttaatcctcccacaaaagattggaataaatctaagtttgtcatggaaaactggaaacattgttactccatatacatgatatcatgaatgggcaccgaaccatcaacaaagatatcaaatccaccatgaactggcacatttgtttcttgtttctttttttgtttttctaagcttaacgcaatatgaacattaatgtccaaaacaaaacttatcaaccctaaggtacacctcgaacaaaacacaaccctaacccatgcgcgccccaagtaccaaaatgagccggcaagaacaagaattcgaagcgcacgagaaaccaagaaatcatctcgaccccaaccttaatccctaatgcggtagagcctcgcattccgttgtgactcaccacttagagcggatcagcgaagagggagtggatttgggggatcaggtcgagcagcgcctagtccgcggtggccgccatggggggtggtgcttggcgcgagctcctgctcccgttttcagaaggttccagatccctcgcaccttgctagggtttggggcaattgggggaggaggcaaggaatttgggcgcgggaatcgcgcggttggagggccaatgaccagcaccaattttcccgcctccctactcctaccctagcactagtaatatgccctgctaaacgctacggtgcaattttatttgtctaacaaaatatatttttcaaactgggagatgatgtgatatgaatgaatatataaaagaaaggttatatgcagagctcagatggattttttatgggagagtactcagatcagggcgctaggagaaacgatgctcgctcgggcgcttcatccgccattcaatctgggtcactggaatggtagtgctgttaaaaaaaatcggatgatagatataggaagtgaaacagcatacacgatagtgtcacgcatctcttttaatttttttttgccacacgtttgatgttatgctcagatatttttttggtgggtatgtgataaaatattttattttaggataatgtcacacatatcttttgttttttgccacgcgtttgataaatattttattttaggatttgtttgtattcatgttgaagccgcccattataaagcactataatgtgattcatgtcacatcaccttttttcgcgtgatgtgataaaatagtttattttgggacatgaaccctttttgtatgcgtgcgttcaataattagtttattttaggattttttttattcatgtttaaatggacagtccaatttaattttgttatatatatagccctgaagagcgggactctacatagcccagtgtttatgtaccatactgctggggaaacttgctttttgacacatacattttagtatgctgtatttggaactttgaagttatttgtcctacatggcgagcttctcaaatcttgaatttctacagcaagaatcaaagtatcaaactaatttctaacaacaatgatgtgaaaaatgaatgctgcaactgtatatatgtagagaactcaatttatcatttaatattggcaatgtactgcaacaaatgaaaaataaattaacaatatatctgaatataaataagtgcaaatttgctccatactgagttataccgcagaacaatgaagcagccaacagcaagaacgcaagtcacttgacaaacatgtatctccaggatatataagctgtgctcgaatttgccattcaaaatttgagtaacctcctagaattagcagtgtcaaagtttaccatattgttaatatgcatatcgaataaaccagaacatgtatatgttcaattttcaacattgtatattctgatatatggaaaatagactcctataaaatttgtagtccactactctatgccctgagccacatgtctaactaactgtgcttcccaaaccacatatttctattgtcatagcttcttaatgcttacctgccactgaaaacaatgttacatcgtgtataagcctatctttaagcatcgataattcaacttgagtacttgacaattggatcactgaaggtgggaaataatgtggctcggtaaaataagccccagcatggtgttgacagggtatttgccaatgatttcagcctaggaatgactaacacagtatcagatattttcaacctgctaaacaggatggttcctatcaaatacaacctacaccaacagtccggtgtcaattatttattgcaaagacatatggccatataacttttctttttctcatgaaaggggcatttctgcttaatgttagtgagctatccatcgtgtggactgaacataacatataagaaggcagcacatcagctgtaataagtagctcaaattccttgaaaaagcctgtaagcataaactacttgttttaaaaagaatacagcttttcaattatgaacacagccaagcaatcaagtaccaacatatacatactgctaccgatttgttttattattgcttatttcctatgatagactgttatctgaattctgcctagttcatgtttagcatagccaaactaaagtttaaaacagacaggtcctgatcacccaagcattataattgagcatgaaaaatatatacatacatgctgaaaaactaaggactctccggctcatctgatcaccatggggccttatgccgcctctgggaagccaaccttcaggttgtcataatcaaacatggtatggttggctacttggctcccataaagacatctggcatctcccaagatcctgcagcagcaagcacccatatttagagtgaaggacaatgtctatggggacttgtttttagtgatgtttagcacaacggagattggaaagtaatatcataaaagaggaaaacttgaacatgtcttaatataaagtctaaaactgttgaatgcacttcttttgttgattaacaagtatctagaagaataccatatcactgaagactaaagataccaaacatctaagaactacctcatttctttcgtggtgacatctctacatatcacagatcttcatttcagattttccaggcaagcaggccataaattaattaaggcaatggctaagctatatagcgcccttggcaatacatttgcttgggggtgattagtaataaatgttatttagctccccatgatattaaacaattgtctgaaaacaagcacttgaaaacaaaggttgataaaataggtagtgttacatattgtattaccataagaaactgaggttaaataccactaacaaccaatccatcgtatatgatgttttgcatcctatacattttcttcaatttgaaagttaaatttccttgataacagttggtccttatacatatggtgttatttagagtgactatttccagtgaactaaagaatgaattaaatgcttttaagcagttccaaacttacctcaaatggaactgcaacaactggatagtgatgcagagacagaagttatgcagcatagtgagggcaccatgttaccaaatactgtgagcatttaaattgcaagacctctgaaaaagtagaacaagcagttgacagaattcagcaatagatctcgagtatatacagttagacaagctagagatgtacgaacaacgaaagtaaatagcaatttttgcaacaattcctaaattatatatccaacaactccatgtcatatgcaccaactatcatcctgaatttcgtttccttcctggagataaattgcttggctaagcacctttaggtccatacgctagtgaagcgtataagaggtgtaaaacatgttaattatatgagaagcatactgtttaagcaatccaacttgaaatcccattgcatcagcgcagttattaatagcaaaaggttgtttaaaataaacagaaaagcaatggttaatcgacattatttcttccccaaaatccatatcctggtaaaaaaaaattctaagtagagacgattggcaccacatgaattagctctaatctattggtacactcataaacaaatactggccatagcttgcaatagaaccagaatcgagattatagatttacaacggttattactgaaatgcaagaaagagaaattatgcaacacaaaccagaatcaaacggatcagagtgggccaaaatcgaaaagcaattggtgttgacaggggatcagagaccgtggaacggcggggtgacccatggaggggcgaaggaaatttgtcctacaaagctttttgaatcaaaggaatgaaccctatggaatcatatgaaattcgtatggaatacctcttcccatataagttttggagaaattttaataagaggtagaacctcatggaagaaatcctttgagtctttatctctcatcaatttcttgtggtctaatcaaacggttattcctatattttttctgtgttttgtaatcctctgttttacacttacattcttattagaattctatgtttttcctattcctctgttttttcattgatgtgattcaaagggacccttatcgatcttcgttgctctatggctgcggaattaaatttgaaaatatactgttgattcgtttttttctcacaaatattcgggatgtaaatttattagcagaaatataccctcgatctcgcacaaccgtttcgcgaaagtgacgtggacgtgacgacgcgaacggtctcgcacaacgacagcgcgagaccacacggtgtcgcgcggtaatagggcgagaccgcacagtctcgcacgatgaaactgcgacactatgaatgacaaaatcgaggacgtacgtggtggcggcgtcagaccacacggtctcgcgcggccaaaccgcgagaccaagcagtctcgctcgctcaccgggcgaaagcgactgttgaaaatggttaattagtgattaattactctaattaatgattaaatattatttaatcattaattagagtaattaatcactaattaatcggcaatgatggacaagacattcggtctcgctaattccttac

SEQ ID NO: 58923 - DNA, 6846 bp, Oryza sativa
  unsure (1)..(6846): unsure at all n locations
gcgtcttctttcgaagttcgtactcgaggggcgtcttcctccctagaggagtgtacgcttcttctcccggcctctacggtgagtcctcctcttctctcgcttttttttttctgtttctcatgttgtttttcgattccttcnccgtggttggctcgcttctctctctcgctcgtgttagttgaatccaaggcgcggttgatgatttgattggaccgtagctgatctgcggatgcttagtttttcgtcgggtttggtagagagaggctgcttcgatctcgcgttttttgactttgatcataaggtttacccaatttgaaaccgatggatttggttgcgtggatactatcaaactgcttcatggctcttagtttgtgccgatttatgatcgtcctggatgcaatggagtaattagtcgctgtgccccaataattattcagttccttcttcatgtgttttctctgttttttttgtgtgtgcatgaggtgacctcgtgtccttgtttggtttgaactttgaacacgcgaggacgattacccttgaaaataagtggtggagaaacaaaacttagatgcgtctctctgctggtgatcatctgccacttgttaattatttttctgcaaaataaaaaaaatcggttgctgacgatgaggtcggcgtagtaggctttgacaacgccccctgaattttttaaaccatcctgaatctgtggataacaccattgcataatctctgatagtgaattgaacctactattctacaagtgtatactaatgttaaacctgtcaagaaagtacttgtaagagtagtgagcccttgtgccttgataagggtgagcttcaggtttgcaaaaccgtgcaattaccgaacggctatcgtgggttataacttgtggtaactttttgaaatcacggtataccatacgataatctttaaaccgggagtgactaaacggtttggtaaacctgttgaacgctaattgtttgtgtttctaaacggtttggtaaacctgttgagcgctaattgtttgtgtttctcaagacggcattctactacctgcgtcctagtaacccctcaatccatcccaagatataaggattttgggtggacgtctagattcactgtcttagaatgagatgggattactcattctaggttataacattttgggcaacaggatagtattatgtcgagattcgatgtttaggatgagtaagatcgtaggttataacatttgggaaggaggaagtatggtataatacactatattacactgtttttttttcacggtatgaactggctatacagtattggtatatacagtattagtacacagcattcaaccatgtgtaactaaaacgtctgcaccttcataaatcagtagggcgtaaaagacgccatgggtttttaggtgcacgattgatctctgcatttatctcctggcgtagggtcttaccgtacatcgtacttagttgacttcagcagacacgaaaagaatggacgggggcccacctgccagtcgtggttcaccggttacggttaggttaccatcagaggataaacctgggcgtcccacttaacttttgatctcagcaactgatctagtagtattgaattgtactaccagtagtaattactgtgtggtaggattactagatgaacatgccattcgctcatattagtgatgggggcattagtatctgcgtattgttattacagtcctgggtacggggtgcctgggtactgctatgctggtgaatgttgttaattgttctgtctgttttctgtttccaaacaagtgatgtcaatggatttactatcaaaactttgaccaaacaataaaatttcataaactattcggtcaggaaaaattctactactaagttttagcaattggtgtcagattttgataacagatgaagtagtgctatgatcatgggtattttatacacatgttattggattctatcagccgtgtcgagactcgagagtggccaatacgttgtactcctcttactattttatattatatgtcattttgattcttttatgttttttttaaaatttgactaagtttatagaaaacaaaacatatttttcaacacaaaacaaacatatcataaaaatatatttaatgttagatgttgtgaaactaatagttaaacttgaataagattgacatgtgagaaagtcaaaatgacttataatataaaatgtaaggagtaactgacaatcacagtgatgaaaagaaatagtgctgtttttccaggttcagaaacgtccctgtatgactaatacactgtattagtattcagtattagcagcggtggctactattggttcgtcgaatctattcctctgcctgccaattgcagttaactaaatcactaaccggatgcggtttaataagttggtagcattgctgcatgtgcagcagtatcaatgtattcatagtaccgtagtacaatcaggggaagtgacaggaacattaggggtaagtggcggtatactaatcgctgcaaccaaccaacgtttagtgccagtaattagtactgttcgtgcaacgttgtgatgcgtaaagtggtgtgctagcttaatggaaggctgcactgctgccaatcctggcagtccaccaattgatagtactagtaatcaaatttctgtatggactaatccgtttctttcttgttccgtttttttctggttcttttgtttggtttcatttcatttgaggggaaaagaaacagcatggcctgcagtggttctgcagttgcacgtgagctctgatagtcttctggggaataacagttgcaattagtcatagtctagcgcatctttttgtactatactacctgtttgtgaatatttttttacatgggagtttcaccgaactccctgtttgtctcttgaatttgaaaagataaatcatctctgggagggttagttactgttcttcacttttggtgcgtttcaccaaacaagtggcagcaccatgattttttccaaaagacaaaaattttccggtaaagaagcacgtgatgtcacctaataccaccggtaggatgcagcaccttgtcgacagaaaaagatgtttttgagttcaacttaagtggcatgaatcattgcaaataaagctgagaggggtaggatgttttagtgctacagcacaatagtagcaagcaatgtgctgttaatcgccgtccattccttttcgtttttagtaggagatgagttgcaagtagccatcaggaatgtgtcgctcgacatgcgcattgcacctttctttgcttccactatactctcatctcgtgataattgagccgtggaaaactgtagcaacagatttgttcagctgcacgaggacatttgagttatccttggtgtccgggcttaatctaggttaagatgatgctagcatataggacatgtcgggtttgattagtttatgagcatcggaacatcggagcaaataaactaacccaacctatgaattggctgagttgcttgaatttcattaaggctgtgtttagtctacaccaaaattgaaagtttggttaaaattggaacgatgtgacggaaaagttggaagtttatgtgtgtagaaaagttttgatatggtggaaaagttagaagtttaaagaaaaaatttgcaactaaacacgacctaaaaaagattttgcatgacctcatccactcaggtctgtctttggttggaagttcaaatgcaaaaacgattttggatcctatttggttttaaaatggggatcaggtgtacacaaaacacacatattttagcaccatatactagtagttttgttattttattttatatacccccctgattatgactgacctaaccaatctccaattgaatctagcataaccggagaagttccaaacattgctattgctatcaacaaaaagccattgcctttattaggttcctgccatgtgtgaaccccggaagccagcagcggctagtcatctgtccttacccttgtttcgcatatcaccagcattacttagatttaataaaattagattcagatcagattgccggcctgctgctgctgctgctgctgctgagttgttgactgcatcatgttcatagcacagctccaccactgttggaacacacacgtcacgtaattacttcccatggagcctggaatcctcggtgaaagcgattttgatcagcatgtgataaggtgcaattaatccctgtaattttctgcttagtaatcgattcggtttgtggcctacgtgcaatgacagcgatcatttgggggaggaggggagagagatgtttgtgttgcaagtgttgccacatgttgggtgaaaacggcgaccctccaaacgccggaaaatacagaaggttttgaatcatttggatggaatttttcatcatcaaggtttcttgtagtgtgctggagtacttgctgtttgggtggtagtgaaggatttgttgcgttgctcacaagcttcaaatgcttgcctttgttttggcacgtgtggctctgtgctggtttgtgtgaaacttcccaggatgtcgaagttagagcttaccgtgttttgcctatttttggacataggagtatggcacaatcatttatctattcttttatactcttcctttttcatttttcctctgttcttttttttaattaaagaaattttaaggagatggcagcttttcctatgctttttatggttaggtttagcgtgtgttataggatatgacgatctatatttcgttggatagggtgatctaattttttttgtttggtttatatagatatggcgatccaattttttgttttgttagagggatatagcatgtatgggaaaaaaccaaaagttagtgggacccatatatatatatatatcaaaatttaatcatctgagatcttgttttaaagatttaattgtaacaaatataatgtgtaataaaatcataaattagataaaaggtttaggagaaaaaaatcggttggagcttgcttaacagaaaatcaaacaaccacagccaattaaaataggacacatcacccagaccaaaactaatgacttcatccagccaaatcgaccagatgcacttatccagcatattgagagaatattccttattccggaccgcctcatctaccctgcccttcaaccaaacacaaaaaaaaatcgggcggccatcttccatcaggctcatccacccaacctagcaaatgggatatgggagctgggattggaaaagggaaatgaataaatggctaggattaaatgaggtgggaagaatggatggttagatgcaatattactctttggagggtaggatattatttcccaatcctcaaacaaagcctcagttggcacaaataaatgcttgtttagacacagctcgaattctttgcaatgcttactagaattggaaattgctcaaaattgcagctctagatacagcgtgcattcggtcaaatttcaaatagagagctgaagtgaggtcccattggctttgaatacttactatttatatttgaatttagaaaattgctattaaagcattaaagcattaattatttgcagtatgtttgtagtactactcatcagggcaccgtatcacatcatagtaattgcattatactcttaattaattcagacctgaatcttctccaaaaatgcccatttctatatgcatcaagcacgtgttaaaaaagagcacccaaaaagaaaatagagtgcaaaatatagttagctgtaaaaattaatgaattagcatagtgcccctctaaattctcccaaattatagaacccacccctcagcagtcaccacctcatcgatagcacaaccacacatgcacagtgtcacagtggtcacatcacccacccctatacccccctgcacgccccccatcttttttactttacagtatcccccaaatattcccgcaaaaattaaacccactcctccccattcccccgcaggcagaggtagtagtagtactagcccaagaagaggaagagcaagacgaagctggaggtggaatcctcccgccggcgacgagaggccgctctagatcgacatggacgcgcaaatggcggccgcggcggcgcaccacccgctgccgcatcagcagaaggcggccaacctggcccgcaccttcaccaagctgctccgccgcaagcgcgctgacgctgtcgccgccgccaccgcggtgggagagcccggtgtgcccgatgcggccgcggcgtctgtggttggagatgagtacgagtgctccgtcgaggcggcggcggcgggtgtgccgtcgttgagcaagctgaagctgtccggtaaccttggcgcggcgtattcgctcgacgcgttcttccgcaatgcggccgagaagaaggcggcgggggtggccggggtggcggtggcgcagacgtcgccgcaggtggcgccggatgtggcgaaggattcgttgctggctaacctgttcgctggcgtctcggcggtgaaggcggcgtacgcgcagctgcagctcgcgcagttcccctacgacgcggaggcgattcaggccgcggacgccgcgctggtggcggagctaaccaggctgtccgacaccaagcggcggtatctccgggaccccgccgcggcggccaagaacgcggcggcggcggggcacaccgcgctgtacgcgcacgccgaggagcagcggcatctcctcaagacgtaccagatcacggccaggaagctggagggcgagctccgcgccaaggaggcggaggccgaccgcgccaggagctccctcaccgccgagctccgcgccgagcgcgccatggaggcgcgcctccaccccgggcgcaccctcgcgt

SEQ ID NO: 58924 - DNA, 1693 bp, Oryza sativa
agagtctaagtaggaatacaatttaaaaatagctgaaattcgaaattaaaaataagaaatattaaaagaagagtccatataagaacccaatacgagattaattaaactcaaaataaaaataaaaataaatccgaaattagaaaaaagaaaataaaagaagagttcaagtaggaatacaatttaaaattagctgaaattcggaattaaaaataagcaatattgaaagaagaatccatataagaacccaatacaagattaattaaaattttgaaaaaaaataaaataatatccaaaattagaaaaactaaaagagagttcaagtagaaatacaattttgaaacaactgaaattgaaaataaaaaaaataaaaacattaaaagaacacaatacgttattaactaatttttttaaaaataaattatgaaatttgaaaaggaaaaataagatttcaattaggaatacaatttataaataattaaaatttgtgctaaaaataaagactattgaaagaaaataccatctaaaacacatgatgagataaaattaagtaacaagcctataaagaagtagagtggtagcggttgatacgatatataaaaattgttaataaaacaccaaatagaatcttaatgacgattaaaaggagggacaacaggcatgccgtgaagcaaacgagcaaggtgattgccgggacttctagaaagtaaaaaaataaaccccatttataatcatatttgatttttaaaatgtcaataataataaaaaggagaagccgccgatggttggcgggacctctagaaaataaaaaaaataaattccatcgatagttatattcgatttttagaatcacaatgacaataaagagtgggcggcatatgggccgtagaggagtaaaccggcatcgtttgacgggacttataaaagttacaaaaaatgaaacccaaaaagaaaataaactctaaaaactacaaggtccaattaaggtccagaacttctaaaaagtaaaaaaaaacctaatgataatcatattcaattttaaaatctcaatgacaataaagaatggagacaacgggcgagccataaaggagtacaatggcaaagccgctaacggtttggtgggacttttagaaagtaaaaaatgaacctgaatgataattatgttcgatttttaaaatcccaacgataataaaagagaaaagacagtggacgggccgtagagaagtataatggcagcctttgacaggacttctagaaattataaaaatgaaactcagcgagacaataacctctaaaaactaagattcaatttttaaaggtttcaaagagaatgaataaaaatagtggtacatcgagcaagcaaataaagaagtatatgatagaagtaaggggtagcagctgttgtgacttttaaaaattatataattagaaatacgtggatgataatgtttggtttttcaaagtcttaagacaatgagatagatatttaataaattttaagtaaaatcataccgaaaaatattattttgttgctagccgcgcaattgcgtgggccacccagctagttatattattaaaacagctttgaaaggaggcaccacgttcgctgtggggctagaaattcccacattaatcggagaaaaagaaaaaaaagaaaaggagagtccaagtagaaatacgatttaaaaatagctga

SEQ ID NO: 58925 - DNA, 2226 bp, Oryza sativa
ccgtcaccaccgtcgcagtcacccaccaaatcactttctatttgtgtttgatctgttgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcagcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctggttgtgaaaaaaatatcaaaaaaataataaaaaaataaaaaaaaagttgtgcctctctcctcagcactagagagagcaagcaaaaaaaaaaaaaaaaagaggatccagcgagcacaccacaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgcaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtccaaaggataaagatgaggagggtgcatctcattccccacgcaccaaaggcatcatccaatactttacaaggcaagtgaagcagcacacggaaggacttgatatagatttgcaggtgacaaatgagaagattggacaattggagtccacgcagatctccaccaacactaagcttacagggctggagacagcggtcacccgcattgacactagccttgctgctcttgtgcggcattttgatgctctcaatgctggaggcaatggtggcggtaatgacgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgtacctctcttgggagattgctgttgaccaaaaatttgcatgccatgagtttcttgagagcactagagttagagatgctacgagtgagttcaccgattgtgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcatagactataaagattacactaatatgacccgattgtttcatcttgcttgtaaggctgaaagggaagtgcagggacgacgtgctagtgccaaggctaatttttctgcaggtaaaacttcatcatggcagacacgcaccactcctccggccagccgtactgcttctccatcttccacacccacaaccagtcgagcagcacctcctccatctagtgacaagtcagcgacaaaggctgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgc

SEQ ID NO: 58926 - DNA, 1366 bp, Oryza sativa
agatagcgcgcctgaagagggagaatgctcagttaaagggtcttcccgtgccaggaggagtccggatccgcacttgtcgaaacatgatttcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatcaggttatgtcatctatctctgccccctagagggcctcatgcccaccttatataggatggggggcagaattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgccgtgtggtatggggtacccatagtctccacagtagcccctgagaccttcacagtcggaaggataaccttctctcgaactagattactccaaagccgagtgcttcaatcatcttcgccatggtctcccgagtacttttaccaaatctgaagactgtggatggctaaaaaatatagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatggcatatgtggtataaaatccgagtaaataaactcataaaggatttaccaaccgcctgaaaaatgaccacaatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgca

SEQ ID NO: 58927 - DNA, 2187 bp, Oryza sativa
ctgtaattcggaattaaaaataaggaatattgagagaaaagtccatataagaacccaatacgagattaattaatattcggaataaaataaaaaataaaattcaaaattagcaaaaagaaaaaagaaaagttcaagtaggaataaaatttaaaattaactaaaattcggaattaaaaataaacaatattgaaagaagaattcatataaaaacccattacgagatttattaaaattcagaataaaaaataaaataatatccaaaattattagataggaatacaattttgaaattcaaaaataaaaaaatatttaaagaacattataaggtattaattaaaatttgggggaaaaaaatctgaaattagaaaagaaaaaagatttcagttaggaatacaatttataaataactaaaattggtgataaaaactattgaaagaaacacatgacgagataaattaagtaataggcctataaaggagtagagtggtggcggttgatacgacatataaaaattgttaataaaacaccaaatataatcctaatgacgattaaaaggagggacgacacacaggccatgaagcaaacggacaaggtggttgccgggacttctagaaagtaaaaaaaaaacctcattgataatcatattcgatttttaaaatctcaatgataataaaaaggaaaagcagcgggcgggcgtataggagtaagttgtagagccgccgacggttggcgggacttctagaaaataaaaaatgaattccaacgatagttatgtttgatttttagaatcccgataacaacaaagagtaggcgacagatgagccgtagaggagtatagtggcatcgtttgacaggacttctaaaaattataaaaaatgaaacccaacaagacaataaactctaaaaactacaaggtccaatttttaaaggttcgaaacttctaaaaagtaaaaaaaacaacgataatcatgtttgattttaaaatattaatgacgataaagaagggaggtagcgggtgagccataaaggagtacatagcaaagctgctgatggtttggcgggacttgatgcaaacccgctagggtttgtggcccgatctttcgatgagaggtaagggataactcgattagatgaagtcgacgttcacggcccgactacaactatccaaagacgctgcgccttagcaaccgatacaccgtctccaatggtcgccacgaacttgtggtgcacgtcaacccggccacgagggcactcgtcctgcaagcaatcgaagaacaagcaagaacaagtaggataagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcacccctaatgggcccaacatggatacacagcccattgggccaaaagaggtgacgcagcaccatggacagaaaatagtcgggagtaaaatgataattgcggccgctccagaacagatatggacatgtggctggatccattcgaaagtagacttgataagctttccatgaagtacttgcacgcccaaatcggagttcgcatgaagtcgtggcgggcgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaggacttctagaaagtaaaaaatgaacccgaacaataattgtgttcgatttttaaaatcccaataacaataaagagaaaaaacagtggacggtccatagaggagtataatgacagcgtttgacgagacttctagaaattataaaaacgaaacccaacgagataataaactgtaaaaactataagatccaatttttgaagataccaaggagaatga

SEQ ID NO: 58928 - DNA, 3917 bp, Oryza sativa
gaaacctctatgacaattcccaaattcaatctttcaaattccttgcataattccaatggcaactgtcgtccttccgtagcattgcaatagcctttcctgctaagagcgtctgctacaacattagcctttcccgggtgataatgaattcccatgtcataatccttaattaattccaaccatctccgttgtctcatgttcagatccggctgagtaaagatatactttaaactcttgtgatcggtatacacctctgtacgagtaccgaaaagataatgacgccaaattttcaacgcatgaactactgcagctaattcaagatcatgagtagggtagttctttgtcacaccctaaaaattcaaaaaaatataaattgttgtttaaatggaatttctagaatttattttaaaagtcttgaaaagaaaatctaattttaattaataaattccaatataaaaagggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacccttctctctctcttcccccggcccaagtcggcccagtccgcagccgcccgcgcgcgcgcgcgccctcgcagccgctgacaggtgggtcccacctgtcaggcccgtcgtcctcctcgggccgaaaccctagcgcgccgccgccgagccgccgccgctgtttcctttcaatccggccgctcctttccttctccggccgaattggttgaggggaaatactctccgggatctcctctacctttttcctctttggaatcttcggccaaatcgctttggaaagcttggaatcgagttcgattcggatcgggttctctctctccaagccgcgagtttccttcgccgttgccgtcgccgtgggcctccgccgtcgcctccgagcccctttaaaaggatccccgtgcccttctctacccgccgccaccctcgccttcgcctctcgtcgccggaatcgtcctagcgccgtgcgccctagtttagtcgtcgccgccgccgctccagccaagctccgccgtcgctccagccgtcgccgtcgctcgggaagaccgccgtcgtgttcgccgtcgcgtcgccgtcctcgtccgccccttcgccgccgtcggagaccaccggagcatcttcgccgtcgtcaacccgaagagccccgccgtttcctcctcgtcgccggcgccgtccgttgcctctccgccgttgttttggtcatcggtgagttcgccgtgccgcccgcttcgtcccggtgtccttcgcttgcgtcctcgtgccgccgttcgccggcgagcatgcgccgcccgagccgtccccgtccgccgtcgctccgccgccgccgtcggtgacgtcatcgctggcgtcatcaagcccctctcccgtgagccgccgtggacccgatcaatctcagccgtccatcttggatcggttagatctcggccgtccgttcgcgtgaaccgccgcccgtgcgcccggtccacccaaaccctagcgccgctgacgcaataaatccccttttccttttcaaaaataattcattattgcgtcataattcaattttaagccgatttaggtgttttaatccgatttaatctttaaaaattcataactaattcatcttagctccgatttagttggttcaagtctctaaatttttctaaaattgagatctacacattaaaaatatccacatgtactgttcaagcttgtttatgtgctgttttggtgattttgttcttttctgcttagattccgtcgtttccggagagtccgttttcgccggaagagagtttgaagagttccaaggccagcaaggcaagtcacacagatcccaaacaaccctttgagcatgttgatcctatttaaagctattgttttcattcaactactgcatttattttcgaatgtcattgggtggaattaacctattctttgttatagccccttttgttcttgtttattctattccttgataccttgggttataataatttgactggttgaactttatttatattggttcaactagattttagatacaattgcttagccctgcttagaaacattagctcacttttgggataacttgattcactattatttcatgatggtttaatgatagttcacgatggtcaatcgtgattagttaattaattaatgtgccaactaaaacctggtaatggtgggttgtgagcacatggttttgaaggtcgtgctcatgacaattaaggaccggttcacgagtttcggttgtgaaacattaaccgtgccaaccacaagccagcatgggcaacggctttatcttttgtgtagcatggttcattgcggagcaccagactgagaagtggcggagataagcccacgggggtcgctggggagtccatgccttgtttataagggggtgattatgatccaggaaggtgcgctgcagtggattgtgttgtatgaggggtattgtcacaactcctttccgaggtatcgtggtgatattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttttcaccatagtaaatgatgctataattggtaataatttgattagctcctggtttggaatggtatattcctggtttggagatagagctgtgcagccgggatggttgttcagaatggttgggcctatgcaacagggtatgttgtatagcgttggattaatattgcttaattaatacttaactgttttaaattctcaaatgtttgctaaatgctgcttttgcaaatgaaaccctattatgccgtcctttgttatcctgtgcacttgcatatttgttgcgtggcttgctgagtatgtcatatactcaccttgcaatcattcatcagaggaagagttctgcagtgaagctgatggtgtggaggattaggtgtagccctggtcaagctgcctgtggagtggagccgtctgcgccgtttattttattttccgctgcttagatccttattgattgagaggaactatctacctctgtaataacattttatacgcttatagagtagtaattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccctctaaaaatattggaaaagtagaactgttcttctccctttctcttttaattaaaccaaactaatggcacatgcactttataatctcttttaatggttctcatttaaaatttattccagtgttattagtactgtacatctattactgtactgatggctcatttaccagcagaagtttttattgttttatttaatcttacagcaataaaatgaatttagcaagttgattttataacttttctttttatttcttttgaaacctgttattcaaaagtacaaaattcgtttccaactgtttcaacttatcttgcaaagtttggtttacttaatttatttacccttttactttgaatttccaaactttattaaaattaatccaaaaaattgtgctattaattggatagatgtcttaactccctcctttcacttgcctttagatgccgcgctacaagcctgagtacctgtttggtgttgaagggtttgtccaggagttgcgtacaatgtcctttgt

SEQ ID NO: 58929 - DNA, 21696 bp, Oryza sativa
agggaggatgccgacgtggagggagcgggagaacaacaagcggagggagcggcggcgtcgcgcgatcgccgccaagatcttcgccggcctccgcgcccacggcggctacaagctccccaagcactgcgacaacaacgaggtcctcaaggccctctgcaacgaggccggctgggtcgtcgagcccgacggcaccacctaccgcaaggtacccccagatctcccccctcccctcccctctccgccccaccggatccgccgcgcaggccgccgccgccgcggcgacgatgtgaactgtgattccgtttttttttttttttttttttgcgccgtggagatgcacgtggtggcgactggcaaaggtggggtgaagatgccgccagtctggacccgcgcacgggtgtggtgggtgggtggggcgcgggtggtggaatttccggggggaattttcgcgcggagagcattgcagttcgcggattcgtggaatcctttgctagggcgattgttaccaccactccacccggtgattcccgctttgcttttgtttgcataagcaaaagcggcggatcctggctcctgattggccgatgggatttgtggtggagcgggggatgcatgaactcggggcgtgtgtgtatgtgtggatcggatcggccttatgcttgcgtgatgttgaccttgtctttgcccttggatttggggatagatatgcgcttgtgttaacatagtggttttgtaacgacgattgaccgtgagtatctgctcttcaagactgggcattagcatttgtgttgttgcattagcaagcgttgctaggttgtctcttcagaatttcatggctactgctgatttgctcttctagaactgaaacaatacaattagtactactttcgaatctgctgatgattgtaaattaatgaatcataaggtcatttttagagttgagttgaacaatggggcattggagttgcatgatctataaaagcttggaggttgtttgtgttgttagttcactcaccttgttctgtatcaaatgtgcttgtctgcgtcccaaacatcctgagaaacaatgcatttgacttaatttcagctaattgaataatttgatgaatgattttatttatgtgtaaccgattgtgcctttttccacagggatacaagcctcctgaacgcatggaagtgattgggtgctccgtatcaccaagcccgtgttcctcgtatcaaccaagcccgcgggcatcatacaatgcgagtcctacttcctcctcattccctagcggcgcatcctcccccttccttcctcaccctaacaacatggccaatggtgttgatggtaatcctatcctcccatggcttaaaacactgtccaattctccatcatcaaagaaacatccacagcttcccccactattgattcacggtggttccattagtgcccctgtaactcctccattgagttcaccaactgctcgcactcctcgcatgaagacagattgggatgaatcaaatgtccagcctacgtggactggttcgaacagtccctgcgtggtgaactccacgccgcccagccccggacgcacaatgcttccggacccagcatggttagctggtatccaaatatcatcaacaagtccatcatcaccgacatttagtcttgtgtcatcaaatccatttagtgtctttaaagacgcgattctggtgggcaacaattcatcgaggatgtgcacgccagggcaaagcggcacatgctcccctgcgattcctggcatggcaccacacccagatattcatatgatggatgcggtttctgatgagtttgcatttggaagcagcacaaacggtggccatcaggcggctggtctggtgagggcgtgggaaggcgagaggatccacgaggactcgggatcggacgacctagagctgactcttggaagctctaggacaagagctgctgcttaacaaaaaaaaaaaaaactaacctggaggcattcttgtctgtagcttatttgttcgtgttcattagtttctgaaagagagaccaatcgtgtggttccttcagatagcttcagttgtgatgataattgtgttatttatgtgaggcacgagctagagagaaagggggctttaattcggccaaacccagctgtgatatggtaatctcagctggctgtaattttaaagccccccctttgttgtgacaaatgtaaattgatgtgagaaatcatgcaaaattcatggagcgttcagctcaacgaagcattcatttgcgttccgtgcacggacagcaaggcatccacatacttttgccgaagcctgctgctttcctcgagctccacggcggcgatggcggtggtggtcgacggcgtctcgccgccgtggtccaaggaggccgtcgtacacctcctgtccggtgagctggtggtggtggtgattgactattgtatcatccttgccaactcgtgcactacagggtcattttcaggcttaattgaacgtgccattcgaagtcagcaaatgcagctgtgagagcacacctgtgccgtccttttccactgccttcaaaaccaaatcttgcccttgaaaagccagaccacacttgtactgtctgttctccgtgtgagcataacagcaggagtggtcgagtacctgatagtagtagtaacaaaaatttttttagaccctgggatttgacttaatcaaatgaagaattcagtagccctgatcacgtaagtattagtgtcacagctcaccaaccctgcctgctgaagaacggcttggaggagacagagacaactagggcaagtggtttgccaaacttgcgcaatgattcgatcaaccgtgttctgattgagtctttggttgaaaggtaatttgcattttcagagggttaatcttgacttgtggtgttcgagaaaccgcccctgatttctgaacatttagtacaagccaagtaattagaaacatattatagaactttagttgtgctgtttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgtgcttgctcgcctcgcctggcctggcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcaaccaagcagccggtcttttcgtcacctcggtacgtgttcaatatgttgcgcatatttgatctgttcatgttattctgcgtagtttacatgtgtagatctaatgatgcgttcatactagttttcatctgtaatgtcatgatttattcatggaataaattaaatcattatatgcccataatctcaacactgttgtcttcagtccataagccaagcactagtctccgagctgtctccgagtaggctggactgctgtatatgcatatgaaaagttcgtttgtttttacatggatggtttgtcatgtcctgaaagtctgaatttcatctgttttagtacaaaaaaagagaatgacttgagagttgagatgaattcaattaggtaggaaaaacgtaccagcaagagtatatttgccagattctgattttaaaattcgtgttaatccaacttcagatggctttcgtctttgcacacgcctgcctgcatcaacacactcatggtgctataaaagtctagaacatgatgcagctggcctggactagtctttcactgtctttgtgctctcaattctcaacagattgatagctttgccattgagtcagggagagagatggctgggagagaggatggagcagcagcaggagccatggaagaagggcaagacagcaaggaggtgaagtgtgagagttcagaggatggaagcagcagcagcagcagcagcagatgccatggcaacgacgtgatctccgtccaattcatgcagaaggtacgtatggtgatggtcgttgcgaacttgcgatacacggtctcctggtactaccccgttgccgtacctgaactcgcaaactgaaactctgaacttgacacccgtgtcaaaagcatatggtttctgactttcttctccattccttttcagcagcagtaacacgtttatagtaattccgttggcgattactaccatctgtgactttttgactgtggagtagatttcttcatgtagactaattcagaaacatcattagagattcctagtgactgactgactgactgactaatagggatgaaagcggtcagcctgctatcccgtataagagcccgaatgctagttcattttcaatccactgctacaaaaattagatgcaaaaaatacagttacagttgtggtttaggggacaacaagcctgcaagcccgccctgctttcatcgatccctactgagtagtactggctaaccgttgctctgaatattttcgcaaactgaaactctgaacttgacatccatatgcgactaattccactggggattactgtcatatgtgactttgtgagtgttcatttcttcatgaagactactaactcagaaatggcattagactattagagagggaaatatacggtggaaatcatatatctagtagaaacctgaaaattaccgttggattgaaaaataaacgtttgagattcgtccacatcatcaagagtaaaaattttactcctaggtttactcatgagtaaaaattttactggacgtgaatgaatttcagacatccattttctaatccaacggtagtttttatgtttctacaacatacgtggtttgcgctacatattttccatattagagattactcgcctgaccaactgtaactatgattgatccttctagatcaaattttcaacgaacattgattgctgacacagatccatggtgcatgtgcatgaacaaaaacctgctgattcttgcggaaattctggggacatatttcatgatattcgccgggtgcggcgccgtggtggtgaaccagagcaccggcggcgcggtgacgttcccggggatctgcgccgtgtgggggctcgtcgtcatggtgctagtctacactgtcagccacatctccggtgcccacttcaaccccgccgtcaccgtcgccttcgccacgtgcggacgcttccggtggaagcaggtaacaaagcattttcttggatctgaaaatgacatcccaaccaacgacaatttttttccagctttctgtagcacaaacggagttatcagtggcactgtagactgtccgacaaaaacagatttttggtttcatggttcgcttattggctgaccagccgcatccaaaatttaaattcaaaaaagttgatttaaaggtttttgttatatacgtgtgtataaaaaatatacagtatacaaagtttgtatacgtgtatataaagtttgtatacatatatagtattaagaaataaaaaaccaagaaaagaaaaaaaagggaaagaaaaaaaggaaaagaaacgaaaaaaaagaaggaaaacaggaaaaccatatgtgggaatcagatctactgtttttttccattgcataggaatcggacagcatgtttttttgtcgttgtttttccccatttttaagggaaccggatctacgattttttttgtttttttcgctattttttttctcaaactctttttttttgcttttccctgtttttaaggggaatcggacttcttttttttcggtttttttcgctattttttttatttagacggacggaggaaacactttgtattttttaagtagtagagatagagaagagatatatttttttaaaaaaagtaaagtagtataagtagaagagaagattacggacaagaaatttttttagggagtcgtagcttttctctaggagtcggacctttttttttctttttttcatggtagaagttttttctcctttttttctcgctttttttctccaccggggagttggacgttttttttttgccgattgattttttttcctccttttttgtttttctcgcttttttttttccaaacggacgacggaaatttcttttattttttaaatagtagtagatagaagatagataatatttcttttctcctttaacattggcttttagattgtaaagaacatggatgtaaaagtttttaactgtcaattaaaaacgagaattggaaggagagacattttgctccaaacattttctaagaaggaattgtgatctcgttgattgaaaaccacacacaccacttaacgctgtactattaagtacatctctttctacccgtcaattatttgtggttgcttccttcaatttttccagggcttatcaaccgtggatcaaacgatggatcggattatgtttcggttaaatttactgccaataactcatttgtggtgatcaatgtgtgtgtgtggtgcaggtgccatcgtacgtggtggcccaggtgctgggatccaccatggcaagcctgacgctgcgcgtggtgttcggcggcggcggcggcggcgcgcgcggggagcacttgttcttcgggacgacgccggcggggtcgatggcgcaggcggcggcgctggagttcgtcatctccttcttcctcatgttcgtcgtctccggcgtcgccacggacaacagagcagtataagatcgaacaccaaaactaacaaattaactatatatatatgcatgatgatcgatgataattttgtggtgtacaacacagatcggtgaattggctgggctcgctgtcggtgcgacggtcgcggtgaacgtgctcttcgcagggtatgtgttgaagtaaatcataaaatttcacagttaactacgtgctgttgatgccgcattagtagtagttgttcggtattctttttcgtttatgcttatacttatcagccagtttgaatttttaaaattaaatttgaaactaattttgtgaatttttttcatcaaagtttatttttcagcctttacttttaaagcgctaaaaacctgtatataaaagttttattcacaaattatcttttttttataaacacgtcgtttgatttattccacgaataagctaaacgatgaggcccctcattgttgttgttgctgctgctgctacagtgtgtattgcattgggggtttaatttgcaggccggtgacgggggcgtcgatgaacccggctcggagccttggtccggcgatggtggcggggaggtacggcggcgtgtgggtgtacgtggcggcgccggtgagcgggacggtgtgcggcgcgtgggcgtacaacctgctccgcttcaccgacaagccgctgcgtgacatcgccaacaccgcctccttcctcaggaggagctcgcgtaggagttagtgatagatatatagacagaattgaagccgttctgtctctcgaatttgcagcaaaaatccaatcaccgtgatgctaatgtttttcatgcccgttgcaagtgtaaatgtgtaattaacggcccaggcaggcaggcaggcggaccggcccatccttcggttgatttggtgaaatttgggccgaggcggaatgaagtatcgggccgtgatgtcagagatgcggtgggcccatagtgggctgcgcgagcggctagtggggtcgtcgtgcacgtacgtcggttacacgattctcttttctttttatttttaccgaactaggtaaaaacccagaagttgcaacgaatattataaaagaaaaaaaaatacagtatagtcggtcgattagatatataatgtcatcttcaaaggcagccatactaaaatatgctgctatgctggtggatcatctattcttatcctcttcatatatttccacaagttatatggtcggacaatacaacgttgaacacttctaattcacctgacacccacatatatatttgtgtgtgaaaccccttgcaatttctagagttaacaattctcttattcattcatgtgttgtggggcttatggcccccacatgttagtttgtggtattaaaggcagactcgaataccacactagcatcacttaaagcagtatatatacaccaaaacatacatatactacactcggacatataagaatatataataatacatcatttgacacgatctcgaagatacaaaaatcaacggtagattcatatcatcattgaattctattaaaaacgcacccacgtgcaaaacataataactttggttggaggttcccagtagaattcaataattaatgcgtctttgttttgtgtggatatttattagcttgtgttttctttagctttgctggtgtattttttaaaacttgttttttatgctagtttgtgtgaatttgtataataattggctgtagctccttgagcaaaggctgagattttattccattatctaaaaaatgcaaaacataattgtgagcataagaatcttaaacctggttggtggtggagtcactccatcaacgtaccaatggtgcttcctctacacattttttttctttttctaacttgatgatcggatagattatagatactagatagataccccgcgctttgctgagtgatatttttattctaccaaacagtatttggtatacattgaagtgttattcttgctttgaatgaggaaataatatggaaaagagacatgaatgattaatctaaatggactacatgaaaacttgatagccaaaaaaggcacattcagaattatacatacagttgatctcaaagaaaacaaaaacaaaatcaccttcaattgagatcgatgtacatacagtgagatgtcagtgctgtagccacttgtaattatgaattagaacttgcgcagtgtgcaaaaaaagttatctgaggctaaattagaaaaataaagatcagacataatttgaaacaaagtaggatatattatgaaaatagatgcacaatggagacacgatttttacgtggaaaacccttataggaaaaaaccacgggcgctgaccaacaataatcactatagaggagttggatacaaatgcggggaatacattgggctgttgcacccttcttgtgcggcttacgagggatatatataggagaaatatatgaatcctagtggggaaagatttaagagtcatactagtaaactaatcataatagtcaagttctattagtaaacttatccgaatatattgcaggcctaaatttcggatcacatatttaacaaaatctccaccttgatacgaatttcccaacataaaaatcttcaatctccaaacaacctcacatatgagataaaatcactgcgcggcaaatagcctccatgactatactgtatcaccctcgatccagaagaggtagactatacttcaaactcgccattgggaataaatcctgaatctgctagtataaaccggtgtgaacctagcagagatgcaaaattgatgcacaaactttaaactcaccatgggaataaaatcttgaatttgctggcatgaatttctgtaatcctagcagaaacgcgaaactcttgtgctcaaaacggagtacttagatcttcttattaaccttctgatacactgggcaaacggacgtagcaattccgccgaaaatttgaccaccctcatgtgatttggacaggaaccttccaactccctctcgatgatttcgcttgtgtgtcctgaaacatgtatgcgcaactgatagattggtgcacgacagtattagcatctcctcatcccgcttcaaatcatcacttgccataatgagaatttgtatctcaatcttgaaacggtagatcaaatttcaaactcgtcttgggaataaaatcataaatctgccagtataattcgttgaatcttagcagaaacgcgaaacaccctagatgcataaaacgaagtattttgatctctgtgcagaacctggtagacttggctttgtgaacatggcaattgaattgattccctagtatacacaagcttgggtgcgtataacaatttcccctccgaaaaaatcagactagacaggagctctcggttaattttgccccgggaatcgtgcgtgattagatggcctcctgcttttcttgcgctgctctttctgcgatggctgtgcagcggctactgctcctttttcctgtgcaggaggacggcgacgactcggacttgccgaacctgccgattagtagggctgtgtttacatccgagggtaaaattttctggcatatcacatcggatacacggatatactcctccattttttaatatataatgccgttgactttttctcgcatgtttaaccattcgtcttatttaaaaaaattacgtaattataatttattttgttatgagttgttttatcacttatagtgctttaagtgtgatttatatcttatacatttgcataatttttttgaataaaacgaatggtcaaacatgtgagaaaaagtcaacagcgtcatctattaaaaaacggaggtagtatatttgaaatattaagtgaagtttaataataaaataaattacagattccgtctgtaaactgcgagacgaatttattaaacctaattaatctgtcattagtaaatgttactgtagcaccacattgtcaaatcatggagcaattaggcttaaaaaattcgtctcgcaatttacacgcaatctgtgtaattagttatttttttcgtcgatgtgacagggtgaaaatttttggggtgagatctaaacagggcctagattgattcttcaatcgggagaaacacgccggccgccaggactagtagatctaatcttcaatgctttaataccacttgttataaaaattgatgtacaatggagacacgaattttacgtgaaaaacccttacgggaaaaaatcacgggtgtcgaccgacaatgatcactatagaggagttggatataaacgcagaggatacattgggctatcgcaccctccctgtacggcttacaaggaatatatatatgggagaaatctattgagttttagtggggaaagacttaaaacatatttaacaagatagatttatgccgaaatataaagttgaatgcaaagtctcgtacccacaaatctatcctaacaaaatattgttctatacaatctggcatcgctgcaacctaagcaagttaaaaatagggtgaatagccagttcagtccttcaacttttgctcagaggtcgaattagtacttcatgttttataatgtccaaataggaccctaaagattatcatgcggcttaatatagtccttagacccacttaaaacgccacatggacatgccacgtcatttgtgcatgtaagataacatttaaatgtccattttaaccttcaattttctatcataaaacaaaaaatgttaattttttttatctatcaatgctacatatttttgccaatggtcaaaagctttttttttgtgttttctcaatagtttttctttatttcctatgaaaacataagggtataaaggacatttaaatattgaatttacatgcatagatgatgtggcatgtacacatggcatgtttagagggtctaaggaccatattgaatcacacaatgaatttaaggtacttgtttggacaatacgaaatgtcagggactaaattgatccttaagtaaaagttcaaggatcatgttgggtattcacccttaaaaatacataatctaaataattttccagcatgaagcttggatgaacagaaaactgcgggatgtatactttgtacttcagattcatatatgcaccaaaaatattgatatcttgagctcataattatagttaggaatccatgcgttaaccaaaacaaaacattagcagtaaacagaaggaccatagaaattcgagagaaaagggaaggggagataagtaaataattacctgtgcttgccgtcaatgatcgattaaacagggttgaacaacgaaactaagccaataagattgaattgtaggctacgtttctcagagtaggaccctaaagtaatctaatatctcactttgtggagcaactgtgcgcaggatgtactagtagcaagcctacagaaggagaaagagcaccatggcaagatggtccaaaaaagtatgcaggcaacatgcaacaaatagtctcatcaaataagtaattctatgaaaaatatttgaaggggtctgctttacctcatagtgcagcgacaaacacttttattggctaatcagacagttggattttttttccgtaagaaacattatacatttttatcgaactaagaaatttttgatatttgacggacaatttcagaaagaaatccgaaaccaatctgtagcattaataatggttaataacggtttagtttccaattttttttctcaaaaacgtcacatcgaatatttggacatatgcatggagcattaaatatagataaaaattaaacaaaaatttattgcacagtttgcatggaaatcgcgagacgaatcttttgagcctaattagtccatgattagccataagtgctacagtaactcacatgtgctaatgatcggcttaattaggctcaaaagatttgtctcgtggtttccatgcgaactatgaaattagttttttcattcgtgtccgaaaacctcttccgacatccagtcaaacattcgatgtgataacaaaaaattttctttttgcgaactaaacacaccctaacatacctgatgggaggtttgcaaaatccgagatcaagtaggcgagtaaaaattttgaacaggggctaatcaaattcctgtgcatcactgcaatgatgatcggtggcacttttccctgcttgatcaaatcagttgatgctagagctattacatcctaggcttcaattcaaataacttgatgatatcatggtggaaaccaccttggaaagagagattgaattctctctgttttttttcaacaatgaactgtattctctcataggggaaaacaaattaaatctgcaacttgacgatagaaaatcaataaaataaccttgtcattacggaagagaagcggccagggtaggtagaacatcactcgagccagttgcctattgtcaaatagtatgaacaatgaaaaatgagaaaaatgaaatagaacttggctgcttgtgaggataatgatgacatgcgagagattcatcaagcgatcgatcttctgattgatttcagaaagacgaaacaactgttcgaagctctcaaacatatgcaaaattagttgatctaggcgaggtgccgatcacaacagatcgtggtcggagaatacaatcacgaaggccttcaagatcagatgataaagccaggatgacatgccctttaataactggcatccgttggctctttagtactcccaccgtccctaaatatttgacgtcgttaacctttttttaatatgtttgaccgttcgtcttattcaaaaaaatataagtaattattatttttttctatcatttgagtcgttgttaaatatacttttatgtatacatatagttttacatatttaaaaaaaatgaataagacaaacggtcaaacatgttttaaaaaaatcaacggcgttaaatatttagggatggaggaagtaactggcatccgtttccacttttgcgtgcatcacttgaaggaggcgaccagccacgacgtgggaattcaatggtcagggatgtgggacgccacagtttaatcttccatccagtcaaccatggagatcgccatgtacgtccttataaatgcacacgtccatcttactccaatgagcacctccacgagactggaaacaattaattagctgtaaatacaagcatctcgtgccaagtatatgactttaatttaggtgaataggttccactacaagaaacctaaccatttaagatacgcacacttcgagacgaaaaaactcatatcgatgaattatatattataaagataataacaaataatttagaaaagcactatctgttcaatgcttatgtagaacgtttattaagcatcaatatcttctacaataaaacctttaattatgtgttagctgcccccccccccctcaaagctatcctccatccccgtgcccgatctagcgacgttgctgcgctctcccatcttcatggcccacgaccgacatgctgttgccctagcagcctagctccctctaaattcggcgaacttcccttccacggttccaccctcacccttaccctaactttcaacattgacttgtcagagtttgttgaagcatgtttggacttcgctagagctagaaatcaaaggaggttttagatcacaaacagtgaagcagatatgaaggtcatgaatacaatattttggttggattgttttttctcatatgatgtttagcgaattcaaaaattcttagcaattgttattttcctcatacataagtcttggattgagggtttttttttaaaaaaaaatccacggtccacataggccaccctctagatttgtacacgggtgcgcccctcaccctgaagaattttcttcctgaacttgaagaagagaacctaaaccctcagcaagagttggataaaaattaagatttttgtggcacgcttttcaaactgctaaacggtgtgtttcgtgcgaaaactttctatatgaaagttactctaaaatatcatattaatctatttttcaagtttgtaataattaaaactcaatcaatcatacgttaataccatctcgttttgcataaaaaaaactttatcttcatcttcatcttcaggagaaaagaacaccatcatagctgagccggtggagatcaggaagttggacagagtgacagagagacgattccatgtgcgtcgagttagcgggcgattttattcctgtgtgatgtcgatgtgatgatatgatgcaaaatgcgtttagggatccatggccatggatacatagcgcctcactgttcaagtttgaacggtcttttgtgatgtgcgtacgtgttcatagtgtgtactaatcctagccaatacgtacctagaggagaaatatgtagatggaatattggaattgaagtatcaatagatcacattccttttattttgtactactccataaagccactgctcactccgtagattatacacattctagtatttcgaattagagtttgtctataggtccatggtactgttacgatgtgtttaatttagttataggttactaacttactatattttatgatttatgatttcatgatagagagagtacattattagaccggcctgttcgaacccactggttattcctttagttaattattaggaagggtcaccggcgagcggcggcggccggccgtctgcaagagctagctagctagatagatacgccggctatatacatagctagctatgccgtgacggtggccggaagcggcggccgccggtgccgccctcgggcttgcaggtgaagaaggcggcggcgacgggggcgccgagggcgtggtcgtcggcgaagccgcgggtggagaagttgtggcggagcagcggcggctggtccacgccgccgcgcgccatctgccggaacagcaccaccgccacccggtggatccccgccgctggccgggggctctcgtagcacaccacctcgcgccctgcaatgtgcaatgacatattattaccaatttacctccgtgcaccatatgcacacatatcgccaaatttacttgctgtgcaattgatagtgcatgcatgcagacattcaggcaattaattaacagtactgttagttcgaagatatttgtaagctaattcctatatatatctataaagttcaactccactaagtgtaggtaatactaattctctcttctctcgcgaagccatatcaactcaattgtttttaatctttgaatgattcatcaagggtgtaaattacatctcttcatatcacctcagttgtttttaacttttggatgattcatcataggtgtaaattgcatatctcttccccctaaaaggcacaccatacaatcaatcatttataacttttggataattgataaatataaaaatatatataaacatataaacacttgaaaaaaaattgtatagtaggtaagaaagaaaattttagatatatcacacaattctcccacagcaacgcacgggtacccatctagtttattagggatgatgtacaaggctagcttaactagatatactcccttcgtcctagaataaatttatttttttcctctcatttgttccaaactaagtttattttttaaagtaatcattacatagaagtttgtaaaaatatgaaataaatatattagaagtagataaagagagaaataattgcattattgttatttgataaagtgggggtattcattattttttattttatattgagtgaataatgaatatatattttggggcagaaaagtacaacagaacaatttaaaaagagtattttattttattttatattggtatgtgtgggattaatggtagaggtgaaattgaacgaaagatgattttgattggttaagatgacaaagtaggtgcataaattaaacaagataatatgagtactgatcgtgatgcgggagcagatgccaaaaataacttatattttaaaacaaaatttaaactatataatttgggagggagacactaggaagcacaaactcgagcaaattattgtaataaaaaaagataaattattgcaaacgaaaaagataaattactgtaaaaaggacaattattgcaaacaaaaaggaagataagtactagatgtacgatcgacaaagaaaacgctataaaaagttgaaagttattgtcagggacacgcgagtcctttacatatgcacaactcacaactttcgtattttcagattagctttgctgctgcagcgcggcacctgagtttagcgaaacacggtcatcggctatgtaaagatcaaatatccaattacatggttctatttatgatagttagattcagacttttgctgtatatattcatacagcaaatgatgcattcctgcttatatctataaaggacatttaatttagtatttctaagatcaagataaattaatatactatacactgatgaaacttaatttgcatgataaaaatagttgcaattacaaacagtttagtagtggataaaacatgcatgacagaaatttgctatgacagtattgaataaataactagattgatgagtgtagtatgtgctaccgctaggtgttaagtagggtaatcagggcacttctataaatcagatggttgattttggcatctctacaagaaatacagtatatgcatgatccatttcccattttagcatgcactaacagcatctaacgtactaattgtttgaagatctcatgaccgttttgttttaattgcatattgcattgcatttgatggtaacatatgatatgtagatatattcgatcacgcatctcgcaaacacaaaactgcactaagagatctcatggaaacaaaaaaaaaatgaatgtgcagttatcaactgattcagctgacagtgttaacgaatgtttccccataccatagttcgcatcagttgttccaggaatatctgtcaccaacctgtgcaagcaaacaaactaatggtcaaattccaaataaccatgcttacgtccacgtactgaagttactgatcttcagagtttttcagacatctacatatatgcacgctgcatgcagtacaacaaattaaaaaggacaaataacgatagatatgatagatcgatcgatcaccagtgtaagtactctctcaacgtcggattgcttgggtttggagcatctggatccaccatcaccttaatttgcatgaatcagacatatacacagcaaattaattaatatgtagtcaagaacacagctagcatcatatatacttcaagaaattaaagtaacatatatatactgacgatcgtgtagaactggtggagatcccctccgacctcgacgctgggcctcgccgacaccgccgacggccggaggtcctcgccgttgacgacccgcacgccgttgtacatcacccggagcgtcacctccggcgagaacaggtccaccacgtcgccgatcacccgccccagcaccaggctgttcgccgacgacatctcttcaagctaaataaatcagttgaaactacagagatttcagtatagttaaacaattacccttgaggacgtacaattggattggactctgctcacattatatagaatagatagccaaggctgcgagcgtcatagtcaagaatcgaatgacatcgtcgctgcatccaccttcgaaaaaagatatcttcgatgcatccaaaaaagaatcttattctgatgtatgaagtgctacgtcattccagtgcatgcaagtacgcaatatatatgggccggccggctaactctttacgcatgggccagaattttaactagctctatattcttattaaaacgattttatggagcttgtaaaaaacagcttctacatcatacataggaactcacgatcacaaagttcattttagtgggtaagtgtattggtaagatgaaagtggaacggtatttgtcatatactcccactagtggagaaacccttatttatcccggtttgcaaccccctataatcctgggttgcaaactaggatcaagaattcggtcccgagtgaaataatcgggattaaagatacatagtagttaatatactcccaaatatagaaattaatatgactcaaaatttataccggacatcaacatttccaggccattgattccaatgcacgggaattcaaacatttttgagcaatcatgtgcttacaagaggaatctaagcaatttaaaatttgaacaataagataactaaaaggtttttttttctcgtttaccttaatctttgctaaataacacagaaatacttatatttagaaacagcgggagtaactttcacatgtgaaaatcagattgctaatttattatttttattccaaagaaaagaagccactctcgctctcaagactaaaaattctcacattagataaaaagaaaaagatattaaccgtccaattgtgatatatccaaattataacggtgtaaatatagttgtatataaaatatgatggcatctataaaaacagaagttaagagttctatacaattgtatctatgaaaatatgtgttaagagttgtataccaaatctggtttttctattgtatataaattacaattatatatcaaatgttaagtgttgtatacaaatccacttctacattaatttatctaacctcacacaaagttgtgtgggtcaattcactagttgtatctgatatggattctttattgaataattttacaacttttaaccaaaatatcagttatttctaaattatattttaatgaatactgtagaagggtagtttattacaataagaaagatattacatctcatagatatgatcgattgagataaggttgataagacatccaaaaaaatgaaacaatatatatcccttgtaagccgcatagggagggtgcgacagcccaatgtatcccctgtgtttgtatctaactcttctatagtgatcattgccgaccagtgcccgtggtggatttttcccgtaagggttttccacgtaaaattcgtgtctccgttgtgcatctattttcataacatatcctactttgtttcaaattatgattgatctttatttttctaaattagcctcgataacttagaaaacctaaattcaactacaaaattaagttttaaattcaaattttggatataactatttttttgaacgaattagctatataagaaaccaactagagttcgatgaaaacctgatttgattaattgtcgcaacatatgtaagcaaatgagcagagccataaaatgattatccaattttgataagcaagaactaagaacactactgatttgattaatttatagactgcattttgagaattacaagaaacttcaggaattcgagcagaagaattttgttgaaactcactgaaattggactggttcttgtgaaagttttgtaaaattgctatgttttaaaagaatcttaatttggactaacttacaaattattcaaaaagaaactctgctatgactgcatgtgttgttctatagctatatatctctatgccacaatctctagaagctaagccatctctactctttttttaacagatacatgcagtcacaaagagttcctttttaataatttataagttagcctgagccaatattcctttaaacaatagcaattttatagaactttcacgagaaccagtccaattttagtgaattttcacaaaattcctctgctcgatcgaatgccttagggcctcatggttttccctggttttaaagttgattttgatgttttcaatgtagttttttttcaatattataagtcgctaagaacacatacaaaaagaatttatttttttcaattatttttttatcactaacaaaagttttacttttaaattattttttatcacaaataagctgttaggatccataagcaaaccttaactttctagtaattaacaaaatgtgaaggacggatcgaagacaggaagtctgtcggcactcggctgtcgttaaagaaagtgctggtctttttcaaatgtcacctcggctacctccaaatctactttcactgagctcgcggtgtgatgcacatgctacagtagatgaatcttaaaatatgtacctcagatcgcaggacacagaaacctacgttatcaacaaggttggaggagtcttccgatcgagcgcccaatacccccaaaaaaaaatcgatcgatcaaatgtttcagttaaccaatgagtgaaacatcaagttatatggtgaaacgaaaaactaccaactgaaacatttaaaaattttatgaaacatggtgaagatacacgttgaaacatgttcctatcacatatgaaacaacaaatgttaacggattgaaacatatgtttttctttcatcaaaatataatcatacgatatcttgttgtaaagatttaattacaacaaatacaacggtgtgatcggatcgtagattggataattagtttaggagaaaaatcattttgaagctcgctaaaatacatgcatgcatgcatcgatgaggtggagagagaggagagagtagt

SEQ ID NO: 58930 - DNA, 28307 bp, Oryza sativa
ctgaaatccaagcctcaattccggacgatctggcaaacaccattactccatccgtgtcccttgagcaacatcaattcaagctggagaaggccaagcaacggatagccgatcggcgagagcggaaggacattgaaaccactatccaagccaatcgacagcttgtgcatgaagagaaggctaaattagatcaactctctgttggaccgattcagtcgaatatagatcggcttgaagctcgcaaaattgatttactagctcaactcgaagagtgcaacgccgagttggattttgaaaaacaaaagctagccaatcttccaagtgtgttgatgaaaaacacgaggcctgggagatctgcttaactccagtgcaggtcgaaagctcgccttcgggtgtgttagcgtgccagttgatttgatcctgcaatcaacaagaaaatagagacagagagaccgcggttaaatctataaatgatagccaatcggctatgtgccgatgacatatcatttatctttgagccgatgtcatacgtgaatcgatcggcgggtataaataaataataaagaactaaacctactcgatcggctgtagatattaccaatatatagttcttatatcgatatatatttaaatcaagtgattgggatagatcggtcgccatgctgagacagtataaatcacttagatcgaaatatatattaataataggactatatatgtttatagcatagccgatcagatagatctagcatatatcggctaatactccgatactactctatatcaggatattaaaacaggtatgatatatcaaacaaaagcttaatatacttagatgcaacaatatcttggcataaaagacggatttaacatctcaatgaagcatatagagcgaatatagttaaatcagataagatcggctgaaacttcgatgctaccctgatcagcaaccaaaaggcaagctagagattgacattctaagcacgacttaatagatcaaatccaactagtgcagcattaagtatgaaaagaagaacaatatctagacaatcaagccgctggaagtttcatagagtggtagatatcttatataatctaaaccaatgtcgatatttaacctaattggctaccttctatcaacggatgttagccgattgcaggttagatggcgatattgctagagattatgtaagatatatgataactcgacgaattacataaacaagattagagtatcataaagatggaagcactaatcccgagaacacaagccgtcataacaagttttacctcttgttgaagatcaaaaccgatgcagctcaacctgaaagcaagaactcgtcgaaataaaactaaagcaaaaaggtggcgatgcgccgaaattgtattgaacgtgtgttagaaattacatatggctcggggtctatttatacccgagaattacaagatatgtccctaccggacacgactattatctctaacaaactctaaaataccataagtctttgcggcagacttttgcccatatttatctctaaggaatttacataaaatatcttaattaatagatacaattgccttcccaggactctatccgtatatggcaatcatcttgaagtacgtcgactcaaacccgatatcggatacaagtcgtattatcggaatcggctgtatcacttaacccagtctgactcggacttagccgatcctaatcgtagctgatccgaacctcagccgattcttactctgtttctgcgataatcctcatctttgattctgcttcaatccaatcttgtttctgatgcaactattaccaaatttggtcgttaacaaagtgccgttgaagaacagtagtccagattgagatcagctatcaagaacgtggctgacatgactaagtctctcaaggtcatccctggaaccgacgcccaagacatccaagctatcgaggaagtagatcaaattagacaacgggccgtgtcggctatccaacgctatctgtctcaatgacattttgtgtaatagaccctaagaatttttgtaatcggctaagaaactttggctaatttttataatcagctgcaaactttggctctttgtttactccatcttgatgtgccgattagtataactccatattttgctaaaaaaattgcaaatttttcatatatgtgcccccctaaatttacaatgtcaaaagcattgataaaattataacttgaactaagggcgatataacaatatcggccattgtacatcggcaaaccacaaccgattacaattaaaacaactaagggcgatataacaatatcggccattgtacatcggcaaatcacaaccgatcacaattaaaacaactaagggcgatataacaatatcggccatcatgtaccggcaacactagccgatcatgcattaacccagacacttgggtaatatttctttaaatacttgccatttagcgctcgtccatagacttctccatcgagtccttgcaacatgtaagctcccttagacacaactttgtagatctgaaacggtccttcccaattcggtgaccacttgccgaatttggtatcccgagtcccaatcggcaaaatcaacttccatacaagttcaccttctgaaaaagtcttgggcaccactttcttgttgtaatgtcgagcaacccattccttatcattggtaacctttgcaagggcccttaatctagactgaaccaagtcttccctttcatcggccatgagattataatactcatcggctgtcaaatcattttgcaactccgttctccttgagccgattctaacctcccatggtaaaacagcttcatgtccataaacaagcttataaggagggacttggatcgatccatgacaagccatccgataagaccacaatgcttcggccaatcgagtatgccactgccaaggatgatcagaaatcttcctcttaatcaatttgatcaaactcttgttagatgcctcggcctgcccattagcttgcgcataatatggtgaagaattcaacaatttgatacccatgctatcggcaaactaaacaaactcatcggacacgaaggttgaaccttgatcggtcgtaatgttttgaggaataccaaatcgatagattatatgccctttacttgatggtggattaatcatatcgatcatatcaattccccatcctctaaatgaccatggtttaatgataggattcaaagccgatgccggtgctctctgtattgctccaaatttctgacaatcttgacatcccttgtaatacttgaaacaatcttccagcattgtcggccaaaaataccctgcacgaccaagcaaccacttcatcttatgagccgattgatgagtaccacaaattccttcgtgaacctcaccgattgcaaccttagcttgattggcactcaaacacttaagcaacaccccatcaatcgttcgataataaagctcatcatccaacaaagtatactttaacgtattgtaacgcaatttccgagaagccgattgagatggattctgtaaatattgatgtacatcatatctccaatgatcggctgttaatgcagcaacttcaaccctaatgtatttgatcatcggcttataccctggtgccccttgggccaaatcattagcttcaatattttgttctcgagacacatgtttcaaagtcaccagccgaaactccatcagttcttggcacttctcattataaaccagtaatgtatcatttttgcactcatactcccctgccaattgactgatcactagcaaagaatcccccataatttcaatagcatcggcttcaacttccttgagtaactgcaatcctttgagaactgcctcatactcagcttgattgttggttgcataaggtttaatggtataagcaaactcaaaacatgctccccaaggggaaattctaactaagccgataccacaaccatgagtacatactgatccatcaaagaataaagtccatggcacaatctcaaccgagccgattgaattatcacgatgatcaacaatgaaattgactatagcttgccccttgactgccttcggggactcataccgaagatcaaactctgttaaggaaaatatccactttccaacccttcctttcaaaattggagccgataacatgtacttgacgacattggctttgcatatgacagtgcattcgttggacaatagataatgcctaaaccttgtacatgaaaaatataaacacaagcacaacttctccacaggggaatatatagtttctgcatctaagagctgacgacttagataaaatacaaccctttcctttccttccagctcctgaatcaggaccgagccgattgacttcccactggctgacagatataatctaaaagttacccctttcgatggaggaatcaaaattggaggagagctaagatattccttaatactatccaaagccttctgttgctctgccccccaagtaaacttttgatcggctttcaatcttaataatggtgtaaaaggctctaaccttccagacaagttagaaataaaccttcgaacaaaatttatcttgccgatctctcttgcaattctgtcatattctctggaggctgaattttcttgattgcattaatactcctttgagttaactcaatccccctctcacgaacaagaaatcctaagaactggccagccgatacgccaaaagcacactttgtcgggttcatcttcaggccatacttcctagttctctcaaaaaccttcctcagatcgactatgtggtcctctatctctttagacttaacaaccacatcatcaatgtagacctcaactaaccaaccgatcagatcatgatatatataattcatagctctctgatatgtagctccggcgcttttcaagccgaaagtcattacaacccactcaaacaagccgattgcaccaggacacctaaaagctgtcttatggatatcttcttcggccatgaagatctgattgtatcccgcatttccatccataaaactcaatatcttgtgccctgaagcagcatcaaccagctgatcggctactggcattggatactcatcctttggggtagctttgtttaaatccctgaaatcaatgcacaccctgaccttgtcgttcttcttgataacaggaactatactagaaactcactcagcatatcggcaaggacgaataaaaccagcatcatatagacgttgaatctcagctttgacaggttcaagcatatgaactttgcatcttttcggaggttgttggtgtggtctaagccctggtttgataggtagccgatgttcaacaattgatcggctgagtcctggcatctcataatactcccaagcaaagcaatctatgaattcctttaacagctctatcaacttggttctaaattctgaagataaattcttactaataaatgtcggccttggtcgatcacctggacctatgtcaatttcttccaaatcgtcggccgacatgaaaccctgtccttgcttgtcatcgagatcatctactgtgtccttggtgtaaacgtttgaaccctccacgacaccctcaaaataatagcttgggctctccgtcttcaattggctgtatatcagaatcggacacttttagaaaatctccatcccaaacttttccagataagcaatcgagaccatccatctcccaaagagctaaatcggcactagcaacattaactaacctgtcagttggaacaatttcaatcttctgccttgccactgaatcaagcattgatgcatggttgaaggaatgcaacaattagcatgaatccaatcgcttccaagcaacaagttgtaggaacccttcccatcgatgacaaagaatgttgtagggatagttttgctgccaactgtcagctccacatttaaaactcctttggtttccgatggattgccaccaaaatctttgagcaccatgtttgtattgatgagatcctcagcatttctgcccaacttcctaaatgtagcataaggcatcaaattcactgcagccccaccatcgaccatcatcttggacatcggcttcccattgacatagccatttatatacaatggtttaagatgccgattctctgtcccttcaggcttctcaaagactgcttgttctggtgataaaaccaacttagccgattcttcttcaacttcatcgacatcggcttgcttgaccccaaactcagcaggcaacgtgaaaaccatgttaaccgacgcagtcacaacacttttccctttagccaatctctttgcttcatcgactgtggcttcatcggctataggagcttgattcttaacacgccactcctgcttcggcttcgtcttctttaaccgatgattgatttcttgctcaacttcttgaaagcgctccctgttcctcaacctttgaaccctcctcttctaatttttcgtaaaaataccagaaggacaccattgagtcttcctgccttcattgtcctcttggttacaatattggttcaccgggcccaatctttgatgagcaggaactcttgcttgccatagccgattgcttctattgaacgatcgacttgaattttctgcaacattactgcacccaggatagtcttgaatagatggcagcctcataccttcattccagcaaaatctaaagaactcacagccccaatgaggatcaaaaccgccatcatcttcttcataatacctctccagctgtttgtcatacttcttctgatacttattgataattttagccgaattcacctgaaaacctcttgcacgacctccatcgactgttcggccagctgtatgcaccatattgacaggaaaaggattgccatcaaccttcatcggcctcttagaatcatcaaatttgattttgcctccctcaatagctgcctggatctgttgcctgaagaccttgcaatcattagtagaatgagacccagaattatgcaagcttctggatcttagctttaacagagccatctttaccagtcgaagacggcgatgctgttgtgattctgacttctaatcggtcccactgggcgtgccaaaaacgtgtttatgtgaaaacacgaggcctgggagatctgcttaactccagtgcagttccaaaactcgcattcgggtaagctagcatgctagttgatttgatcctgcaatcaacaagaaacaaagacaaagaaaccgcggttaaatccataaacgatagccgatcggctaggtgccgatgacatatcatttacctttgagccaatgtcatatatgcatcgatcggcagtcattaataaataagacagaactaaatctactcgatcggctgtagatattaacggtatataatccttatatcgatatatacttaaatcaagtgattgggatagatcggtcgccatgccgagccagtataaatcacttagatcgaaatatatattaataatgagactatatatattcatagcatagccgatcagatagatctagcatgtatcggctaatactccgataccactctatactaagatatcaaagcaagtaaaatatatcaaacaaaagcctaatatacttaaatgcgacaagatcttaacataaagggcagatttaacatatcaatgaagcatataaggtaaacatagttaaatcaggtaagatcggctgaaaccccgatactaccctaatcggcaaccaagaaacaggctagagattgatattctaatcatgactcataagatcaaactcaactgatacagctataagtatgaaagaaggacaatatctagacaatcaagccattggaagtttcatagagtggtggatatcctatataatctaagccaacgtcattatttaacctaatcggctgccctccactgacagatgttagccgattataggttagatagcgatattgccagagattatgtaagatatatgataactcaacgaattacataaacaagattagagtatcataaggatggaagcactaatcccaagaacgcaagccgccataacaagttttacctcttgctgaagatcgaaaacgatgcagctcaacccgaaagcaagaactcgtcgaaacaaaacgaaagcaaaaagggtggcgatgcgccgagattgtattgaacgtgtgttgtttgattacatggggctcgggtctatttatactcaagaattacaagatatgtccatatcggacacgactcttatctctaacaaactctaagataccataagtctttgcggcagacttttgcccaaacatatctctaaggaaattacataaaatatcctaattaatagatacaattgcctcctcagaactctatccatgcgtggcaatcatcatgaagcacatcaacctaaaccgacaacgtatgctgtgtcatattgtcggattcggctcaatcggctaaccccgtctgactcgaactctgccgatcttagccatagccaattcggactccagccgattctcactctgtttccgggacgatttccatctcgatttcttctccatcttcgatccttggattaccaaatttgttcattaacatacccacatgttagtgggccccacttcctcacctcatcccctctcttctatatgtatcctatcccctctctcttctatgagagcagggttgagcggagagcggcggcagacggagcaggcgggggtggagcggcggcgcgcctgggccatctccattgcaccacctctctccactggccgagcgcgctgccgaggtgaggcgaggggatggcacggttggcagctagagggggttgggcagcgatcggagaggaccgacggtaagaaggcccccaaggctacgagagttgaaaggattgaataaggagaggatagaggcgaggagaggggaggggagtcggtgagctcgagctctctatcctactcacccatcctcgccgaccaccacctgcaaccacttgctctgccgcctcgacgtcgacccccctcatgcatggcaccagcgcgtccaccgctaccccgacgccgagccatggctccgctaggacaggcacgggccttgctgcgaggtgcgacgatgaagactgtgtgaccgcctcgcccaccattaataggtttaatcttgttgattaagtgttcctatcatgtgagtgcgtgtagtagagctgtactcagtcatgtgtgtaagtgagaggtgtatgtgtgagttagttggatcggtgatagctatgacctgcatgcaagtgattacacagtgcacattgccttggaggagcggccaagtcaagtgaagtgagagtcatggtgtgtgtgtgcattagccgctggtgtgcagccacacagaaatttacttgtgtgtgcatccagtgcttgtgtgtaaaagttcttgtgttcatctgttagccatttcttcagcgtataaacaactacgtgagtgtgtgatcttgtgagctagtgccaacagtggtatcagagctaggttcgagagatgccgaagatcggcgacggcagcaaggctattgccggtgacgacgacaacagcaagctagtggtgcagcaagtgaaggatgcgggggtgacactatgttaccccatgctcggagggaacaactatggtgtttgggcggtgaaaatgaaaattttcatgcgtgcacaaggtgtgtgggctgccgtggagggcgatgtgtgggctgccgtggaaggcgacgcggccgatgagaagatggaccaaatggctctcgtcaccattgtccaagctgtgccatatccgagaaggagaaggcgaaggaggtgtgggatgccctcaaacagatgaacatgggtgaagagcgtgtcaagaaggctcgagtacaaaccctcaagaggggagcttgatggtatgtacatgagtaattctgagaaaattaacgatttcgctttaaaggttaccacgaaaatttcatagagtatgttagttaatgaagaatttaagaaactaacttggaccatgatttattaagaaatatttattcccttgtttacttcattactttaattaatttgcacattattttaaattctaaaacaagctaagtaatttttaaattcttacaaactcaatacaattgaaacacttgatttgaaagaaaaataaaaaagacacttatgatgaaccaacattgtcatgaacttacgatgtttgtgggttgatctcttatgacaaaacaacaattgtcatgataagccgtgggattagttaatgatgatttgtccttaattttgtgacgaacatcttattttcgtcattaggccacaccgccctccaccaaacgtcataaatgaaatggtataatgacgaacaactccgatgtcacgagaaaattgtcatagaaggtcacatgtgttgtattgcgcctttccctcttctcctccgcctccccccttccaataaatgttcccatacactcgttttgactttggtcaaagtcaagtttaactaagttatagacaaatataataatatttataatactaacttagcttcatcaaatcaataattgaatatattttcataataaatttgtcttgggttgaaaatattactactttttctataaacttgatcaaacttaaaacttaaagtagtttgactaaaacggagggtgtatataatataaaatgagccacttaaataaatgttcactgcaaatgacacgccaaaaattcctgaaaattttactgaaaattagttcgccttgtagcctgtcccataaaattttcatcaatgcaggagtcaatcagtcctcactcctcagtttgaaaaatgaaatacagtgtagtataactatacatctcattttcatatcaacaaaatttaaggacgaggtcttactgtagatggccataaggcccgaggcccgaaggcctggcccacagtacgtcattttgtcttggcccaagtagcccggcccgactgccggactgtgcctgggcctccccaccggcacactgggatggcccggcacgatcgggccagcccggcacgatgggccggcaggctaggcccgacacacaaagtatagggactaaaaatagacatattaatatcacggtccaaagaatagggacgtaaaatagacttattttagctatttatatatcacaacccaaaaaagaggcgaaatccctaatacacgattagtcgcgcgccccctccccgtgacatcccggcccaataaggattaggcctgtgtggcccatgtgagctgtgtgcacatgtttagtaccaccttgcaagtttagcacgagtggaaccgacttataaggcatcttccctccaaccatatcactcccgggttaacccttttacacgaaacgaggacgaaagtgtaaatggggtggtatgtgtaagtgggcccgcttgtcgattggtctgggctacacggttctggagagagggctgttacactcccccgcgcgcggagatggggccgcaggcgacgtgttttttttctttccgtatctttttctttttttggttttttaatacatatgtatacaaactttgtatacacgtatataaattttgtatgtgagtacctttttatatatagatgtacaaactttgtatatatacatacataaagttggtatattttgtatacatacatatacaaattgtatatacgacgtatacaaactttgtatatgcgtatataatttttatacatatatacatattagaaatatacgtatgtatatactttatgtatataaagtatatatgtatatacatgacgtgttttttttctttccgtatctttttctttttttggttttttaatacatacgtatacaaactttgtatacacgtatataaattttgtatatgagtacctttttatatatagatgtacaaactttgtatatatacgtacataaagttggtatattttgtatacatacataaacaaactttatatacgacgtatacaaactctgtatacgcgtatataatttttatacataatacatattagaaatatatgtatgtatatactttatatatatacgtataaactttataagtatatatgtatatacatgtataaagtttatacgtatgtatataaagtatatctctactacttaaaaaatcggtagtggtggtcttgattcctaacacagcagacgcatttgacagacacacgtaatctcaaccatccgattgccatatccaactgcctcgatctcctccccaccgcgcatcgctcctctccccttctctcggatcgatctcctctccctccccacgccgcgtccttcgccctcctccctgcgtcgcctccttgccccgccgccgcgtcgcctcatcaccagacccgcgatcaccgccgccctctccaatctaccgcaccgccatcgccgctccctctctctccccgcgtcacgccaacccccaatccgtcgccgtccccacaccgcgccgccgcccctcgcctctccaccacgccggtctcctctgcgagcgctgcccacgattcgccgccgtcgctcacaactcgtcgccgccggctcctcgcctctccgccgccgtgacaccgatgcccgccgctctacccttactctcgttcgcgacgccaccgatctttgtatgcccgcctccgtgccgccagatcgccgtcgcctggagtcttcggggaacagcctcaacgaaaatccgagcaccgtcgtcgacggccatctccgcccagcgtgcctgatccctggaacagcctcgcgcggtgccaaaaccacctccgccgccgtcttgaagctggccgtcctctcgccaggtgccgtcatttgcccctgatgtatggtttagatacccacggacaaaatcccacatgtactagctcactgcatcagcaccagctccgaagctccgatctggcggcgtcgccggcatccaggcaagacatcaagcctacgctgcaccaagtaagctacccgatctcttatttttctctttaatttgctttcttcagctcctgttttgccatctttgtaagaataagaaatcattaggggtggctgcagtggtgcaggggatcgatgtgatccatgctgtcgcaatcaggttactaattaatatctagctcgctgaccaaacaaatttgtgtttttgtgtatcaggcttgtgctgtggagtttaaacatgctaaaagtgtttcattgattctttgattgcaccaatgtgatgtccctgagttatttgtggcatgggtttcattttttctactgcaacaatctgttggaatatatggaaaacggtcccatttcaatgccattttttaagatgcagaatggcgtaatgtagtatctttattgcaaggaatgaatcacactcttacagtattttgaaaagataagaatgttctcttcttgctgccttaattttggcctgcatatttgtgtccacatgtatcccattattaaatggtgttatgattcctgaattcctccgtctagcatatccgttgacaaattggtcaaatttaggcatgattttgcatgtttcagaccttcagtatatatagtacggttaatctgatgcagaatagtcgctggatttaaaaccaagttctatcctaagtttacatcaaatagtggttatttagagaagcgggtagactgaaacaatacaatcaatatatcttacttgcaaatttgacctccctttatagcatttgcttgattgtggcaacatttttagctgtagaagtactgggaagtatggcagattgccaagtggataagcggactgcagattgtttttttgcttctgcgtagcaggctgaaaaattgagcatctcgcaggttaggggactctgcagccttggtgctgcaatttgttgatcaaggagcagctgagtatgcaggttaaggcaatgtatcctctgttcctagatcctcaaacaagttaataaagattttattgccaaatttgatttggatcttttactgtaaatctatgaagttgagcatactctgcataagatgagaggaaggcacaggggagggaggctgaaaatgaagctcgacgttaagaaaatggactttgatgagaggacgatgtggaaaatggactttgatgatagggtgatgctgaaaatcgactttgatgttaaagaaaatggttgaaaatgataggatttcaaatggttcaaaatgataggatttctctgcatacactgcattttgatggagttatatttacaaaggattaggatgaaaaagcattcgcactttatttccttcgatgagataaaatagctaactgtactttatttcagacatttgcatatgggttcaatttgtgttggagcaaagctgctagatcgtgtgaatcaccctggtaaatctggagctttattttcagatgtatttactctacaaaaactgtcaaagaactaactcaactatcgattttaataacaagatgctttcagttttatcatgggttattatgttttgttatatttctaactacaggtcagcatcacttagttggtgcaagcaccgtggaacatatttattgagttgaaccctaatttaattctaatccgattgattgcaaaattatgtttttttcctcgacggtagggtgcgggtgcactatttatgccgcctgagagcatatgctgctccataatggaatcaacattcttgtaattgtatccagttaattcttcctaaatttaattggcgccaccagttagtactattttctacctacacatagtggcacgaaccagcactaaccacggctgaagataattcttcaggttatatatatatatatatatatatatatatatatatatatatatatatatatatatatgtgtgtgtgtgtgtgtgtgtggatattccctaatggcagatccaagggctgtgtttggtgctgaatgaatcagttcttttttataaaaggtgtaagaaagtctgtaaaaaagttgtaccagaactgactgagcttccttttgggtgaaattggtttgctaccacaagtccttactttaacaaaaatgatatttcctatgccaacctatctcattctatagttagttgttaccacatcttattttgactatttaatatgttttacgacatgttaccgtagcgttagcacgggcatgctactagtacatacgtatatacatgtagtagagaggagagactaaagggtcagaaactgaccgcgcgccacgccaggggcgcgactgatcgccccttaggggccccaagtagagggaggtaaaatagactttttttacctatatatgacacagcccaagagagaggaaaataagacttattctgaggaaaagcacgatgggccgtcgtgccttcgggccggcccgacacagcccaagtcgtgttgagccgtgcctgggccatgtgtgcggcccgtgggctggcacggcacggcccggtgcatcggccgggccccgacaagcctcggcccaggcacggccggtcctgggccgggccgtgccgggcggcccagatggccatctataggccttacattccagacacgtaactgtacatcgatcaggagaaagtgaaatggtttggctgcaccacaacttatggtagttatagatagtcttttccgtcggaggatatagatagcatcaatcagcgccctttgtcctggcaatgcagaaagcctggaggctcatgaagaggatgagcagggccatcgtgatgcacgccacgagctccctagagccaagaacccgcgccttcaagaacctgttgatcctcaccttccagcagctgtcgtgatgccgattcaggtcgtcgatcaccctgtccaacgccggcaccctcgtcagcctcaccgacctcgtcatcccattccacagctccgccacctccctgtcgctcttgaggtggttcaggatcacccccgactccctcagcagccgggcgtcctcgtcggtgtcgatgatcccgttcatcagctcgacgtacctcgccagcaccagcgctctgcgccctgttgacgcctcgaaggcgaccatgttccgcagcacgacctcgctgttcacgtcgacccggatcaccgggaggcgcagcgtcgcggcttccgcgcagaactcgatcgtggagatgccgccgttcgccgggacgaacctgacgccggagtaagctagctcggcaacacaaggcaccgcgatctcctcgagaagcggcgatacgcagctcttgttgttctgaaaatccttaatgggttgttgtccttgtgttggctgtgaattcagttgttgcgcgatcattgagaggcatggtattctggtgaggagcttcagtatgatcctaacaccgagatcaaccagcactgaaagaaacttggtgacacgcttgatgagcaggtctgttaatgaacgcagagtactcttcatgtgatgcttcgattgatcatcatcatcatcatcatctgcttgttctgtggcatcatccaaatccaatccttcgacatagcatggagccatgttagagtagaggaaatcaagaaggtgggcgtgtcgtgtcgtgtcggtgcacggagagcccgtggccacgagggaggagacctcctgaaagaacccggacaggacggagctcaggacagattccgctgtcgcacgcgacgagcctcgcatttccgtcgccttgaggagcagaaacagagggatctggttctccagcatgacaacgtcgtgcagcaccatggtgtgagaggatgtcctccgagatggatcaaccaaatgcgacatccttgacgggatcctctgcagcgctgcccgctggctactgtcctggctaaacgtctgcaagaactcgagaaggaacgacacgtcgatggccatcatccatgctagtgcgtcattgctgaggcctagatgcctagagaaaaaaaagaaattaacaggtacttccttcgtcccaaaataaacgcagccatcagtttccaatgtccaatttcgatcattcatcttatttgaaaattttctgaaaaagctaaaaaaaatataagtgacgcataaagtactattcatgttttataatctaataataacaaaattactaatcataaaaacatttcaaataagacgaacgatcaagattagacacgaaaacttatggttgtgcttattttgagacggagtgagtatattgatagggatggaatatgaagttagtcgaatcctttcttttacatgcaaactgacctgtggtagtaagctcgaatctcgaattctagcgtagcgaagacagccacgagctgttggaagctcatacctgggaggtggcgttgggctctcctggcagcagagagcttgtacatctccatgtcacggagctcttcgcgacaatggtggtaagggccaagcgcaaccagctgaggggtgtaggcttcaggtttggtgcatagtaggggctttgggacatcaaagatggagatgggttggctgtcatggacttcgatctcctcatcaagaatacgtttgatgcgaatgatccattgtgcttcgtcgaattggagatttggacaaatccccattaattgttgaatcgtgttaaacggatcggaagattgatttaagatgatatgtagtaagaacgagatgagcatgcaaatcttgttcagttttgtcaccaaagaaaccaaacctagcggagacagcaacataaggggaaaaaaatatgttgactgttactgcatttttttcctgtagttaattaatagtgtaaccatgacaccagcagattaaagcttcaattatggctgaccggttaacgttacactagaagtaccatccgtgcgttgctatggatctaacaagtaatttatttgggaacaaagagaacatttttttaaaaaaaacactatacaagttggaactgattttccgaattagattccagatggttgtatattttctgtgaatacatatgcttctgcatacccaataagccattcttatatatttattttagtaagaggaagaaaattatgtctatatttatagctaataataaaaaaaatacataaagcttccggtttttgttggttcatccttttttttttttttgccttttttctgattttttttttgcacgtggaaggtttttttttcgcacacgcgttaagtccgttttttatctcgtctggtctgatccgcacatgtgcgcagcacgcctccagccaccggtgggccgaaccctatcgccatcgccacatcgatctacttcaccgtatgtttcctcctttaatttattgcaaatattaattctccactcctccatcattatttttccataattcccctttcaattcggctttaattcacggaatttaatctctatttaacagtttcgtgtttgcagctggatgagccaccgctccactcgtgaagccaccgtctcgccccaccttatgccaggtggagaggaacttcagtgagctacaatctgtgcccctagtgacgcagacgaggtgttcagggtgcgctgccgcggtgctagagatgaaacacatatcattgccgccaacgccacaatggaaaaagagaaaggaaaaaaaaaagagacaagagaaatgaaaagggagcggatgagaaggaaaaaaaacaaaagaagaaaaaaaaggaaaataaaatgttttaggtgggtcccacttgtcagtcaatgtaaagttagtgttggtgtcacatcagcatccaagtggcatgccatgtcagcaccaagtaacatcccagagggcttcgtagcaatatcagaccagaatgacacactttaacatgttttaagatctttttttttttgcattttgggagtttgacctacatgacaccgacgcacaagtttagagattaattgtgcactttacttttttattattgtaatacatgattttttttattaagataagtctttgactaataatggctttatctcatagtactagcgtgaccgtgcattgcaacggcctatatagagatgggctgcatgggcatattggtttacttaaacgctgtgggaatgcttggaatttatagcgccacgtcatgcgattttttcagaaaaaccctcctgctttcgtaaaataatgcccacatccgagtttgtgttcaccgtacgatcgccgtgaggctcgatccgaccatccgtgtggctcagctggcggatgtttcactgccctcggatcggtgatttgggaatgaacggcttagatatcatgctttcaccctcccccacaaaaccctagcgctgcccagccgcccccaacctcgcgccccacccccacgcccgatggctggtgccgccgcctcgccctctcgctgcaagacgatggtggcgccgtctcctttcactcgccctctctccgcgggatagcggaagcgccatctcattccccggccgcgccctctcgccgcaggcaatgtctccgttcccttcccctgacagtttgggtgtcgccgaatctcactgggattagttcgccaccgtagggagttgccgggactggttcgtcacctctgcgacctggcgacctgacgatctgctaccacgcattctactcctccccaggtcaactttacactccctttgcctaatcctcttaatcaatatatatgatcgatccagcctgcttgcttgcgctgattccatatttgttgttctactcctctgctgaagccatcagcagacacaatttggtacactactacttaaatccctattatatgcatatatacatatctgttctagcccctgatctctattcttgacttgctgctcattatgagtttcacatgattggtaggaaggaaagaaaaaagggagtgcaggctagaatgctagattattcagtactaaagtttaaacatcaccgtccaggtacagatcaaatcctctccttctgtcctgtatatattgtattggaatttaatatatgttttcaggttgctgacatcattctgttgattgctattatgtctacaaaagtttaaggattactgcagctgcctatatgatatgattaagatcttttgcactgtaatagttgacagattttcttggtcatctgtatatgttttttttacactatatgaatgtcgtgctaaatcaaaatagctttatataggagcagcaaaattttactatgaaaatattattatagaaaatggatttgaaatgtatattattatgggttctcaaccatcttctcctaacagcatttgtgcccctcaccaatagcctgctacgatggcccactagatgccatggccgcatgtgttgttcatgctggtggcagcgatggtggcatccaggcccacatcaaggcctgcgccacgctgggagcaatctgctcctccgttgtcaccgcacataacaccatagtcgttcaggtatgctgctgaatttcttccttttcagtttgctctcttcggctgatcggctcctatgcgggcttctgagataaggaggagaagaaatgattaggctgacgccagtaaaatttctctctttaacaaaagcgttctatgtgcttggtaaaatttttagtggcaaatctaagtttattctcaaatacatttgttcctgcaacttttttaattataatgtcgtataacttttatgccagctaacttctgcgtaaaaaacttttcactaataatgataaaatattgaagatgacagtgcaccatctatgtcaactaccagaaatgtacaggttaaagatgtgtacatcatccttcataatgaaatcctgatgtacatcggtacatatatatgccaattgtttctggaatcttaacaaattggtctacaagaatatatacttaaaaaaacctttttttattattatcaattacgctcattcaggattgtagataaatgtatatgatatagtactacatggcagatgtgattttttccccaagatatatacttcaaaaatataaaaagttagttggagagttcaagttttgatgttctttgcttagttgtcattttcctgtaaatgttaatgagtgaattctgaagtaatgtcagtattccttcattgtacaatactggtaataatattttgtgggcatgtcaatgagttttcttgctgtcacctttctatgcttctgtttttaggtatggatgttttcttattgtcttcttttgatgatatatgtggtcttcatatttcttatcagataatttaggtttagttccacgatagcatatcatgtttatgctatcagaaggttttgcctcaatttccttcctctccaacaaatcatattttatttgttaattcgtcgtgcgctaattcagtacacataatggtaacatacgcatttgcattgatggtattctttgtcgacaatcttatattggctattgtgatgcatacatcatcagaaattcactgtaagcctgacaatcttggcatattacccttatatttggatcatgcagttaattttctatgagacaaacctcagggtctttacggctcagtatagacagataattgtgccgatattaaggtaatgatatgatttcatggtgcaggtcttttagcctcctatctggaggaagctccattattctacgaatcatattgtaaccaatacattgggtcaatattgggtctataagtcaaggcagtaatcacagattatgttgtacatctagcgaacaaatatttatttggttcgattgaagatttcagtatttgtgaactttactagaccgcaattactacatttttaaaatcagtgctggccctatgtatgttagctaacatttttcttgtgctatagtcatttctatatctgctactattgtttaatatttaatggaacattgatttcataggttagcgttgtttgcagggtgtttcagtgacactgaaaccatggttgcctgagaggattaaagccacaggtacttctgagttgtaacctgcatagttccattctcggttgatctgtgtagtccataccgattaacaatacatatgtgctattccaaagaatccaacccttagtatctctagctatacgtactgtgttattctcttttctgctttgatcataaagtattatttcaatttatttgtgtgtgacgaagtgacatgcacttcaaacaattttacatgagacatgtcatatgttccaatagggcacactggggtgtaattttttcttgacaagcattattcctactttcatttttttttcagcgctgcattgttttggaattttctaataacccatccttccaattgaattttttctttgcaaatatacttatagagttttcattataagctgacttcaaaatatgattttataacttttttaattcatgaaatgttatgtttgccccttctccaaagctacagagatatttcaacacggtttcttatatgagtatttgtactacctactatatactcattgtgtagcaatatatggatgacatccaaacatgccctgtattctataggggatacctcaaaattctgtgccattatgcaaaggaggtaccaatcgtctactaatctgttgtaagtgatgtactgttgtttttattaagctaaagcactaaatttttctttgtgctgcagtgctatagatgagaaaagattcaattagttcatgacgaaggtatctatgagaaaatgctgcaattctcatatcacctaatgattgttgttttttctaacctatactccacattatgtaagatccattctcctctgtcattgctacttttttgtaagtgtacatgattgtacaaacaattatttgagcaaacagattgtattcacatttaaatcttggtgatagtcacaatgtgtacatgcatatgtgggtatgcttctgacataaagttcttttagacaatgtttatatataattcttaaaagttacaactgtagatactgtggctgtgttcgtttgggtgtgttgggaaccaatctcctgaccacagaaaacggagtggtccattagcacgtgattaattaagtatttattattattttttgaaaaatagatcaatatgatttttaaatcaactttcgtatagaaatttttttgcaaaaaatataccgtttagtagtttgaaaagcgggcacgtgaaaaatgattgagttgagttgagaaagttgggaaaagaagtcacctgtgttgttttgatcttaataacacagcttgaaacatttatacccatgcacgcagcgtagcgcgtgattcttgctagtatatattgaaataatctagccggttatttttttaaccatcaactttttttttatgattctccttttaaccaacagcatgaatttttcagagggcggtgcttgcacacatgagtagggatatgacgacgcactaccggacaatgcctaatctctcctggttcgcacctttgtagtcccggttggatgtttttccttttttttttccattttttccctcttaatttttagtcacggttggtgttcccaacatggaataaaaagagtagagggatggacactttttcaaccgggactaaaaatgatcaccaaccaggactaaagatcataaaaaggctatgggctttccaaccggggctaaaggtgatttttagtcccagttcttttttgaaccggggctattgtggttttgggtcgacctaataaagatcagttctccagtagtgacgcctgcgcatttattgttgtagagatatgtgataaaaacataatcataagtaaatacttttgaatagggatttaataacataaattttgtgtcaggtagatttatatcctaatagagtaatttttagtcaaaatctcgtcctaaagaaacaaaatacatctttatttttttttcaaaccaacgagtaattgcaactaagggcacttgatcggtcgataacatactcccttccatagtagaaaaaaaagaagggaaccagaggtaagcggttaggtttccttgacatgcaatcgaaccgctttgagccggctgcaccggccgggtttttggcgaactggaccggcagccatactaacgggccacaaatgtgctgtctaatggcccatttgttaacaactagtgcagctggtggttttttttttggcaaaaatagatggaaaaggtgcactaggtggaaatcgaactttggtcctctggtccaggagttgaaagagcaaagtcctatagccatcatactatccaacaacatataacataagggaatatgtaatatatatacatgtagactgtgaccacggtttgaccgcccgggtcaccggtcggaccggcggaccacttaaccgagaaatcgaccggatcacccaccagttgcattagtatggctgcttgtccaactagttccagtttaatgtctggtttgccaaaaaattggccggttaagtcggctcaaagctattcgattgaatgtctggtctttgaaggaaaacaaaccgtgcttacctctggttctggttttttcgttcgaaccatcggtccggtccggtttttctactatgctgcagatctaggtacttccatggagacccagccagagttgaagattgaaaaggaataaaaagaaacagagagagaaaaggataaaaggttgttattttagtatcactccaggttcctataagtttatgatgaaacaagacattaatagagttgttggaataggtgtttctgtggtagtgatgtatttgataagcaagtatgtagtgtgtgattgattattagccacattttgtcataaccaaggttagataagttgtggtagtcacaaaaatatagtggataaattgctaatcacaaagtgtgacaaagttagcaagaaaattgagtctatgacacgtgattaacaaactgtggtagccaaaagtatagtgtggcaaagtgtggccataaaccaaacacccctataggacaacatcatgcacatgagcagctatacatgatgcatgatacatgagagaaaaatataaatattcaccatacgatactttgacattattgtgagcaatttccataacaatgtgtgacaaactagataatatgttgctctcattatatttcttctactcccacgtgttgtatcggatgtagataaagatctctttttctagagacggtcacgctaaattgctcctccatgtccatcccatcatgtgttacaccgtgagggagatgccaatcaaagtggtatagaagagcagtgagagccaactctattgttgcatgtgcaaatgtcatgcctaggcacatcctccgtcctgccccaaatgatataaactcaaaatgtgtacccttaaaatcaatggttgtgtcctcgaaacgctctggtataaacacttctgcgtcatcccaatatctatggtctctgccaatagtccatacattcacgatcaagattgttccctttggaatatcatatccaaggattttacatgactcttgacactttcttgggacaagtagagatgctagagggtgcaacctcatggtttccttgatgatgttctttgggtactttagattaatcaagtcatcttcagttaccctagactttccttgcaaagcatgtcgtatctccgcttgtgccttctgcatcacttcagggcccattcgagtgttgttgatgttgtttcacttccacccgcaaacatgtcctgatgcatgtcatacgtacatacatacatacatacatacatatatacatatatatgtatatatatatatgtatatatatatatgtatatatatatatgtatgtatgtgtgtgtatatcacatcattgtaagaatagtaagatttattttatccactttatgaatggtggcaggaaataacaagatgataaaaaaatcaatatacaaatatactctctttattctcaaatagattgtgtttagaataatgtagtgccactgctggagaaaccatctttgttgggttcgccaaaaacaacattattcctggttccaataagaaccgggactaaacattatttttttgtcccggttgaaaagccaacgtcacttttacaccaatcaggactaaaaatcatttttagtcccggttcaaaaagtgaccggggccccttactatctttagtcccggttggtattgccgaccgggactaaaattcaacacgtcgtatataatccctcgcacttatcctcccctcctagatcacaaacactcccccctccctttcatcctctctccactctctctttcctctctctcttattctctccttttctttttctctcttattctctccttttctttttctctcttatcctctccttcactttttcttgtagcaatagagggagcgagtggcggcggccccatgcggcgacggcgacggtgaggcagtggagggaggcggcgcgagaagacggggtcccggtagattaaagtgttagatttggttgatttatctgtgaatttgttcatttgtgatgcatttggatctgtaaatttgtgatatggatgatttttgtgaccgtggatgattttgtgatgtttatgtgaatgttgatgattttattatggagtttggctagaaattaatatgcaaacaacaaaaaacaatgaaaaaatgactaaagatggtagcacctgccacgtgacactaccactaaagatgggcatctttagtgacactatcactaaagatgggcatctttagttccggctatttcaatcaggactaaagatgggcatctttagtcccggattcggggtcccggctatgtacgcgggattaaaggggttacgaaccggaagtgaagatgggttttccaccagtgtgctccttaaaatcataacacgctgcatgaataaatactaagatttgatatttcaaaatgacattacttggctgtcgtagaaatatttccattttttatgccaaaatgatcacattagtacataaaactactttcatcttgttataatatcaaaattttcaggaatatgtgattcaaaatggcaataatcaaatatgtgcaccagaaaccaaaatatatatgcgttgatcccctaaaggtcaagtaaaaaggaccaagaattgacctagctatatggcttcaactagattttgtttgttgcagaagtaacaatatgtgaagtagaaagggaaaaatgttgccatcagcaagatattctagtggcagaggtgatgcaaagagggagacaatgctttactttcaggagatccttttgggccgaaagaggtagatgaatggcatgtgattagttcgctgattaattaccaacctaaggcccaacgatgatcctgacaatttgatgtgtcaccggaaaggctaacgcgcggttgatcgctggcagcgatcgttttcttttcttatttttttctctgttagtaagtttatacacctaaagtttacatatctaaagtttatccacctaaagtttgtaaagagaatgtttataagtcaaaagtttatatacccaattcaaattcaaattcaaattttttatattttcctcttttagtaagtttatacacctaaagtttacacatctaaagtttatccacctaaagtttgtagagcgaatgtttataagtcaaaactttatatacctgattcaaattcaaattcgaattcaaatattttatatttttctcttttagtaggttgatacacctaaagtttacacatctaaagtttatccacctaagtttgtagagcgaatgtttataagtcaaaagtttatatacccgattcaaattcatattcgaattcaaatattttatattttcctcttttagtaagttgatacacctaaagtttacacatctaaagtttatccacctaaagtttgtagagcgaatgtttataagtcaaaagcttatatacccaattcaaattcatattcgaattcaaatattttatattttcctcttttagtaagtttatatacctaaattttacacatctaaagtttgtagagcgaatatttataagtcaaaagtttatatacccgattcaaattcaaatttggattcaaatattttatatataaaatatttctatacacaaagtttatgcgtgtaaagtttacggtataaagtctgtgcacacaaatgagagtattagaatttttttctcctaattttcttttacgattttttttgaaatttatgatgtaatagaaaagtaaaaaaagagagatgaaagaggaggtttagggggga

SEQ ID NO: 58931 - DNA, 17648 bp, Oryza sativa
  unsure (1)..(17648): unsure at all n locations
agcgaccccctaattattggcgccggccactcggccagggcatccgcgatcctcgtcggcaggcactgcatgccactctccccaccgtctcacatcacatgcctctccaacctgtcgtcgtggcgcgctcgccaccgaccgccgttgccaccgcacgccacgctttgactctacctacgtgcccaaacacagcacacaccgtcccccccggccacatttgccgttgttttattacgcgcgcgatggtccagctgatgcgtgtcgtaggcgtacgtgccactgttcgccgtggtgcgtttcgatcacgagccagtaattaaccacggcttctagccagtcttcgtctatcgtcgtcgtcgtcgcatgtgcagggtggattaggtttgccagtcgctggcatatgcatcgagctatcggtttggtcttggggataaaatgtcagcagcgtgtcactagttttttttttcttttctgtttgttcttcccgttgtttttagatttgcgtggtcaaagtggcagcagttggtgactgtaccgaatactgacatcgatcggcgtggtggtggtggtgatggtactgttcttttgttatccacggtggcagtcaaatcagctgctcgtccaatcatgcatgcgttcaaagctggattagttgagagctcagtagttcaaagtagttttttttttccctagggttcatctccacttgtcatttgctgcttctcatcgggacactttcatactgcatgctgaaaggacagaacactaattatagtagtactttcttctgaacctcatacgctcccaatggaaatggaaacgagccgttaatttctcgtgaacttctttgcaaaaacgccacaacgtacgatttccctgcgaaacttcaccggaattctgacaagcaccaattctactagggctctaggcatagcgtctttccgtgagaacgcagttaattaaccaattaaccatgccggaaaactggaccctttcgatcgggaaacccgggaagccaccggactgaaacgaactgaaacgaagtagagtagctcgcagcctctcagctactactacgttgtgaccaggaaacgcataggttttgacctgaccaccaccctcattcaaagctcgcactggcctggacggcgctctgcctgctgggctagctagtctctctccgtttacggtagtttctgatagctgcagcttctcttaaaacctctcgctgttagaaactctttcaaatagtctagattttcacttagattttgataaggggtgtgtttagttcacgccaaaataaaaagtttggttgagatttgaacgatgtgacggaaaagttggaagtttatgtgtgtagaaaagttttgatgtgatgaaaaagttgaaagtttgaaaaaaagtttagaaataaactcggccaagatgtatttgtagaattcagaaaatgcattagaagtcggaagctaggtttttcatttttttcatattctcacgtactacttcttagaatcttaacctacaaacagtacctcgatcactctctgtactgcaaccaagcaaagccctgtggccaccggcctgtgccaatggacgcgctgcacagtagttgatgctactcctcctcgatctgcttgaccaagcctcacaagagacaaggaataatgtgaccaaaggtaacaagaatcacacacgattttcgccactagacactatagttagacagtgccatggaaaaacagcactcgacaaaattcagatcatgtacagtatcagcggacagctagtagctcagctcaaacactagccaaatttgacagatctcgtgttgtttctcatcagtcatctttatcctggagctcgaggctaaaagcaccagattcctcgcttctttgattcgattggatttgcttaattcagggatcaaagacagagaataaaaaatatagtcctccatttaacaaccagtagcagcaacaaacaaatgggtgcctacctggaacaaaaaaaattgcacacactgatcggtgcgcctgaatgattgagagttgcatcctcttctttccgttattctttctccaaatagaatatgttcgggaacaagatttaacatgctggatgccattattatcgaacaggaatgcaaggatcatgtggtggggccatggatgccgtggagaggcaaatacaaagacagcctatgtcgcatcccacattgaccagaatagggacctcaatcatcaagtgtcgatctctcgggcttaatagtagtagggagtattatccaatgtaaagccaacgagtaaggtacggcaagtggagtatcttctgctaatctcagctttcatagtaggagtactcgctttgagattctatattaattgacattttggacaagattgaagttaaatttttataactttgaccattaataactaaaaatatttagtttaaagaaactagaaaaacatatacatttatttattgtatatattataatagaaaaataaggtcaaaggtatatcttatggaacgtgtaattgtccaaagcgttaattaaaatgaaaccggagggagtacgttttttagggtatatatttgatttttaaaacacggcatttgtactaggttttattcttcaatgagtactccagataaaaacaatagcaaggtgcctaggtcataataaaaaaaatgaaaacaaaatatatgttggtgaaattataagtgcatgacttcacccactggaatacaaatacaacatcgatgaatattcggttttactatattacttgcggcagtttttaggcgtaaaaactttcaaattgtggaccgttagacaggattcgtacagaccggatgataagaaattgcataaagcgcgcgggagaaaagagcaaacgtatgacctccccgtttatgactgaacagagctaaccgattggacgaatttggattttcgtttaattacataccaattccatatttgttacatactagttacggtaaccctaactcattgtaactacattataatttaggcataaagatttttatatgtttttaataattgcatatgttatattatagttataatatagttacggtggaattatattacagctatacaatatactacagttagatctaaaagttttccacataaaaaatttgcagcagttttttaatagtcccaaaatattagttatacgcggttgcaaatggtgggtgtacgtagaggtgagcgggcgtgcctaaacactaagggtgtgtttggatagagggatttaagtggataggacatggcggcccatttttgtgggtgtttggttcctgggcggaggtgggatagggcggtccggagggaaatattccgcccagatgtaggatggagggatccggtcgattcggccgaatgcagctgcccgagcgctcgagcgagcgggggcgagcgacgagtgggtcgcgtcacccctctcaccacgacacgagctcggcggcggctacggcgagcggcgacacgagctcggtggcgaccaagccacgcgacgagagaggaggcaagctcggcggccggcgcgggcgacgagcacggcggcagtgggacgcgagctcggcggcggcggcagaggaggcgcggcggtgaccggtgagagaggaggcgggaagaggacgcgccgacgacgaccaggacgacgacgaccggatctggggcggcgtggcacgccggcgagagaggaggcatggcggcggcaggggagagaggagacgggctcagcggtggccatgggggaggcttggcggcgggattgccggtgagagagaaggcgaggggcgatcggggaagataggaggcgagggacggccggcgattttgagaaggaagattttttctttttttttgtttttctccttccccttttatttctttatgctttttttatttatatttagatttttttagtatattgatattttttttggtttggagaatttggaggggtatactcactatctctaatgaaaggatgattgcaaccacttattcatcccactcccccaaccaaaaaaaaattagatcaccatatccactttcatccctgcaaccaaacaaaaaactggatcgccatatttactccaccatacaaaaaaccgaatcgccatatccagtaaaatatggaccgccatatcccatctaaccttgaccgggaaccaatcgcaccctaacagtaccatgcgatcatacttaacagaactactccgagcagtagtggtgagagggagtagtagggactatcatttctgaaagcacgaatagtacgtaactggatgaaggagtaatgggcaaacgatgtgctagtccagccagcagccatacatcaacatcaataagcaacaaatgttctcaggggcttgggcttttttgtccagcttgggatctagcccaggtccatatggaacaggagcggaaaaagtacattgaaggtccctcaacttgttacaaaatcatcccccaaccatgaactcagatattcgacgtcccttaactaatcaaaataggtccttaactaatcaacatgtgagacccacatgggtcccacgttgactcagccgccatgtaggacaaaaccagggtcaaaaccaccgaaagacctattttgattggttttgattagttaagagacgtcggatatctgattttatggttgggggatgattttgtaactcgatgacaagttgagggaccttcggtgtacttttaccaacaggagccaccacaaaagaaaggaaatatcaaatataggccggagtgaacctgctactgggctaggcggctagcaaatgttaacacaaaaaggctaaggtggtgtttacttccagagacttaactttagtccctgtctttagacactaatttagagtattaaatatagactacttacaaaactaattatataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgataggaacttaaaagttttagtcccatctaaacagggtctaactagatcccgcgttgcaaatactgtactctcttcatccaaaagttttaaaacgtattttagtttttgggttttccaaataaaatgattatatttgttttatccatgcataaaaaaagtaaatgaagaaaaatgtctcttcgtttagaagcagattattaattactcattgcatgcattctctttctttgttgcacgaggagtaaagatggatgagttaatttctccttatttttttggtgaataaagaaatacatcttagacttttgaatggagtgagtaaaatttaacaaaactggcattgtcgtatgatacaatttcatttttctttctaaaccaatcctaagtttccaaccaagaggcaagcaaacgtctaaagttgttcgaagtttttaacgctatctagtttgttatggcttattattcggtttggaggaatagaaacgcatgcacacttttaatcgtaggaattcccaataggtttgagtggatgaaaaatttcttatatcaacttgtatataaaaaaagaacttcctttagttttcctgtacttatatttctacaaaccaaatgtcgttcgtaagaattagtctttacaaatccaaatcttatgcgcccgcccccccccccccccccccccaaaatttggatactttagcactgagaaaagttgctgttttgaagatgacttgtctgcaaacaaatcaattaccgattaatagcacgcacgcacctacgttccgctcataccttgaacgggaatgtgaactcatcatgaccataataaacccatacttcctccgttccaaaataaatatatttgagattgacattttctaatataataaatccagaagagatttatttagattcattgtaatagaaaatgtcgcatattttttttcgaacgcgcaaaaggattgcatgtcaatatattagaagaaaatagtatttgttacacaacgcaatcagttagactgacttatgccaagaaaggagggaaacaaaagaccaaagaaaaaaaaactaggttattatgactccaaacagcgggaagggggcagagcccactactctccccataaaaccccaaaattagcaatgccagctaacggctatagatgaccctctgagaggatggactgaaggacctccaagactgaagataatatagagtcgaaaaccctagagtccactgttgccaggagaccaggagaatcagagaatcgaagccggcacggagatgctcaggcaaagcatgccctagacgatggccaccaatcctggaggcagctaccacggggaggagagagggcagcccaaccaagaggtgacaacacacggagccagacctgtcgagcgaacacacaatcgaggaggatgtggtttgccatctaaagctcttgagtgtaaaaggggcagaccgagtgactatcaatgctgcgcttctgggggagatcgggcgtgcaacaacatcgttgaaatgcaaactagaggaagaatttgtatttagcaggacccttcgcgtgctacagaagatcagcacaagcaaatgagggctggccataaaagaacatctggtacgccgaacgtgttgagtagcgttggtcactcgtctaacactgcaacaccaaacaagacgatccccgaaacctggcgagagctgaaagtgaagcaccaaatcccaaaataagaagaaattgggagatgaattgatttttttggatggaaaaaagtacgtactcaattactcatatgcatggtcgttttaactgctctgttctgccgacacgaagcatgctagctagtagcgtgtacattatcaagcagctcgtcttctatacttctataaaatcaaaggcaaagggaagggacttgatgatggcgcatcgatcgatccccattccatatctgccgtgaacttaaagccttcacaaaccaaggtggacactgataaggtcgtagtaatccagaacctctgcctgcctccatcagcgccggccggccggccggtctgctcattactagcagcacacagtttaaactctactttggtgtagtacttctcgtacacgttgttgcttgttgccattatcacgcgtagtttattcggagtagttctagtctggagctttggaagggggccggccgcttgtccagacatgcgcaggcccagcttgcaacttgccgcgtactactgccccgatgctcgctgttggttggtgccacatcccacgctgccatgccatgcacgtatgtgcacgcacacgcgacgtacaacaacgtcgcgttccggtggccattggtccgtgcgctcactgcgtcctgcatgtgtgtgtgggcgtgtcgggggtctcgaccgccgtgcgcgctcgggccgtgccggcacgagatgccacggttcacatgaggcgcaacgcacgcagcgcatctgcgcatgtcccccactcggttggtggtggtggtggtagctttggggcgtttggctcggggctcgcacgcgacgcgaccgagacaagcaagcgcggtctgcctagcttgtctccttgcgcgacttgtagatagatagatagatagatagaaatagaacggcagacggtgcagcagtagctggaaactcgcgcgcgcgcgcgagcggcgggcggcttttccgtgttcggtgtttcggtgcggcggccatatatacgcgcgcgcgctcgcgtactacgtgcagacgacggactagtgcgtgcgtgcgtgacgcgagaggctgagaggagcattttggcccttggtttctttcggttcttctgctcttttttgctggcgatggggtggtcgtcgtcaagggctatgctcgtggcgcgcgctgtggccttggcggtggtgttcctcgcggcggaggctcagctgtcgccggggtactacaacgcgacgtgccccggggtggtgtccatcgtgcgccgcggcatggcgcaggcagtgcagaaggagtcgcgcatgggcgcctccatcctccgcctcttcttccacgactgcttcgtcaacgtaactacgcgaaatggatctcttgctcggccaatgtacttcgccttgttgagtttaatggccgcgtgcgtgtgtgcaggggtgcgacgcctccatcttgctcgacgacacggcgaacttcaccggggagaagaacgccgggccgaacgccaactcggtgcgcgggtacgaggtcatcgacgccatcaaggcgcagctcgaggcctcctgcaaggccaccgtctcctgcgccgacatcatcacgctcgccgcgcgcgacgccgtcaacctggtcagtatctgcctcgtgtttttctgcacccatgtaatgctggcattaatggcggggcgcgtgcagctcgggggcccgaactggacggtgccgctggggcggcgtgacgcgcgcacgacgagccagagcgcggcgaacaccaacctgccgccgcccggcgcgagcctcgcgtcgctcctgtcgatgttcagcgccaagggcctcgacgcgcgggacctcaccgcgctgtcgggcgcgcacaccgtcgggtgggcgcgctgctccaccttccgcacgcacatctacaacgacaccggcgtgaacgccaccttcgcctcgcagctgcgcaccaagtcctgcccgaccaccggcggcgacggcaacctcgcgccgctcgagctgcaggcgcccaacaccttcgacaacgcctacttcacggacctcctcagccgccgcgtcctgctgcgctccgaccaggagctcttcggcagcggcgccggcaatggcaccacggacgcgttcgtgcgcgcgtacgccgccaacgcgacgacgttcgcggcggacttcgccgccgcgatggtgaggctgggcaacctgagcccgctcaccgggaagaacggcgaggtacggatcaactgccggcgagtgaactcatcatgaacatgaaatggattcttgatgtacgcttcgtgaacgccataaacttattatcaaatcttgtttttaccaaaagcaaatggaaaaaatgctgttcttgcactgatttttctccaaatttcgatcgaagcgagcagcacacacaaaactctgccatgaaccgattcatggcggagtggggttttagtccggaacagatctcagccgctgattactagatcgacgatgcgatcagaacagggaatctgctgggcccgtggaccagtggaacactgcagatgtggcagcccaggatggcaatgtttgattggctgactgccagattatcgctgtcttttccaacgagctaagcagtttgtcagttgtcacatgagttaactctgaattttcaatcattttcaagtcttgaaccatgctttagatatactattaattaacgcaatttgttggctttctcaactctataaaaccgtgtgacagtggaatcatctctctttctgagataataataaagatctaattaagcacattaagcaaaacaaagcatccggtttccagcgatgaatgcatcattgaataaaaaataaacataaaatctagcactgaatgtctgctaaaagtcctgaaaacccatggctctttcatcatcacacattggcatttgcattgacgcgcagacacttcacgctagccgacttcgtcggtgctgtttatcggcgactcgtcagtcagtacactgtgaatctgtgatccatagctactgatgattgagcaaagcccctgcggcgacgaagccggcaaagtagccacaggttgggccacagcccacatggaacggacgggctcacatgctgtgatgagcctgtgacactgtgtcccgatctgtgtaccttttctctttctggtttttacaggctaatcatcatctcactctgctcacccatcattgcagattaagcatcacaggaatgagaaagaaagtaagtataacactcgctttacacggctgaatcctgatcagaaaaatgcccagctggcaggtgtgtctgagaagttgttcccctttgcatcctgctagaaaagtcttttgctacaggttgccacgcccatctgttcgagtccgcggcggcgccaaaatcgctttggtgcgctgcagaaaaaagcgtcgcacaccacagtcacaccatgcccgccctccatgcaacgcggcgccagcgcacggggaattcgcgagagaaaaccgcggcccataatacaacatggcacgaacgcgtacacgcgcgagcgcggcaatgcgatgcgtcacgcgtcggcgcgacggcgcgtattagtattatcctccgcacggggcgtttgctgatgagacgcacgcgccgccggacgcacgtccacggggatgacaaaacgcaggagtcaggacgagacggagacgacgtgtatgcgtggttgtgtgcagggcatcgcgccgcgccgcgcgcggcatatgctgcatgcgccctgtgcgcgcgggggcagttgatccgcggcgttttggaatggagaagggagaggcgcccgagctggcagcctctgcgtcgtgcgcgcgctgccctcgcggccacggcagccgcgcgcgcgctcggtcacgcagagcagaggcaggcgtacgtgaacccgccgtgcacccaccatgtggcccatgctggtgctgcggctgcagtagcgtggtgtacacacaggacgatctacaatggcacgaaacaatggagcatcgcattcgcaccgcatggcggctagatagatatagtattcttttgtcttgtagatcctctggtcctcgacatcctcaagagtctcggaacctcatcaggattcaggacaaggggaagcgaaggtaaacatgaaaacatggtgttggaagtggaactgtaacaccaggtctgtgacgagggagggaccatggaattgcctgcatctgcggcggggataaaaaaaaagcggtatattctctctattctaaaaaaaattaacctcatactacgacgtgacacatactactacaatgaatctggacatagagtatgtctatatcgtggtgccacatcctagtactaggttttttttagaacggtggaagtagcatttgtccacttcagtttttccagagatgctgacagagtaaagctgaacaaaacctgcgactctggggcagggcatactccattattgagagcggctgagatgggagcatactatgatggataatggcagcaattttgactcttttactaaacttgttcgaaaactagatgtcgacaaaaatataaccaaaaatatatctttatcccgtcaaaaaaaaagctctttaccttactagatcttagcactaaggcccaacatctcaacgccaagctcatcagtgataaatttggaacaaaattatcgaggctctatatatgtaaattatctaattattaactaatataaattaatatgatataatttagttagaatttgaataatctacaacgtaggtacgtccctgagacccattgatgcggacctcgtggaatacactataaaacgttgatagatccaaatacacatgaaaacttgcatagtgatcagtgactagagatggcccccaccgaaaaatgcatccctatccctacccccgtgagacaaaactttcccgtgcccgcaaaatacaacgggaaataagattatcatttatcaaagaggatcacccttgcccccacgaacctgacaggggcatgacttctcccattataattcccttatgaagaatcaactatagccatttccgtccctaataaaagaattcctcgtaggaaaagggaaaacggggctcattgccatatctagtagtggcgtagtgtagtggtaaatggtgtttgtatcaccatgaagaacatggttcaaatcacgaccactaaaatatttttaaaaggtgaaggcacaacaaagaaaaaaaaaagggaggggaggggtccgaagtggcaaaaaagaaaaacaatgatcacgaaatgggcttcaaactagcaccttctgttataataagggagtatcttaccactagactactagatacatcttgataagaaaacaacttatagtatttattaatttgtattatattactctgcgctaaactatatgatgctaattttttaatcttaacactaaggccaaagcccatgaggttgaggtagaggcctaatgttggttatagttcttctggtctatttatagaatacgttttatgaaaaggttaaaatgtcaatatttcggggataatggagtagcaagaagggtaatacagctcatgagagatttggagcaaggtgcagcctaattagtgcacatcaagcgatgccgagctccataatgttatcgacgaagtcatgcggatgcagatgactagatgaggcgctccctgttcgtcagattatctcggttaaacaaatgccggagcggttttaccggccgtaagcgcctcttcttaccttggacggtgacgccggggacgtggccggggtgcggtgccggcgacccggcgaccatggacccaggacatggcggtgcctgtcgctttgatacgcggcggcgacggcggcgagagcccgccagcccggcattcgcgggagactacggagtggccgtgtggggacagaagtcttgcatcgttagcgtggcgaggtctcgccgtctcggtgcaccagcccacgatggcccaagtaaagcccaaaccgtcctattttggatcgccaccattggtagcggcccatagggaagggacgtatgaccttttcatttggatcccggttttgagggaagctctgcaaatggtagagatcttaaacatttctgcatctagattttaggcccctatttttaattgtcctcaccaattgcggtccttttctgtgcttagttggcggctcatttggctgatgcagaaatgaaagctttgctgtgaccgagttgctcatcaactatccactagtagtagtaatagtagcttaattcgtacctgttccagtaattgcatcttgatgtaggagcgtgctcctcataaaagaacatgcattaacttgtgtcgactgaagaatcgaagtgcactacatgaatgccatgatagtccatttccagttcacatcagaaacatcccaggtttatcatgcataagaaagtacagcagagctggataccaaagttaacgcgcccacgcatcaagcaaagggacacagaacaccaagtttgggcattgagggtttaatcaggttacgaatcaaaatggaaacatgcagcgcagcaccagcaaactacactgacaacgatcagaaactacggctatcaatcagtagatgaagtggccgaaactacagtgcaaaacacttggcaagactaggtttcatgagcatcaagcgagatcgtcttcttcttaatcatcaatggaacaatcagcagggaccttgctcttgagtctacgtgctctcgctctttggagcagcgacttccttgtcgagacgggaaacctctgaatggcactgatatgtaactaatcccagcaatgaaaccgtgataatttggaaccacccgagctgctttagtccagcctcaactttctcaatccttctgagttgatgatccataaccttagccacttggcaatcctccacatacttgtattcctgcagaaacacactacgtcatgtggtctgaaattgagagcaataaggatcactcaacagcatgcatctaggggcttgacagaaacaaactcagggtattctcaaaagaaacataagtcagggttggcagaatggtccactccagttctagcttcaggaacgtttggattttcaagaatgaccagggctagctatgtttacctacagttagctgatcccacacccatgggcttcctgctgcagttggacaatgagctgatggtgacatggagctgttattttgcaggttattagctatgcacagaatgtagcaacttgcacggctgagttcaactcacttttagcaatttttcaatttttaagtgttgatttagaaatacttaataaatgtaactatatggcctggaccactggaagcagttagaagacaagagagaaggttagcagcctctgcatgatgccacgatatactccttccgatcacaaaagaacatcgttttagagtgcgagtcaacacacgttaactttgaccataaatatcatttacgatataggttttgaacatatgaaaatgatatatcctagtttctcataacacatgtaatatcatattgattttgaagagttcaaaacaactttcttttgtgactggagggagtacaccagatactatgaggataagcagcaacaagaaaaacttgtgatggcacatgggcacagcactatcacacctaaatagtgaacaatgtggaccaaacactgaaaaaggtaatcattgattcagtatgagctggatgttatagaaaccttctttgcatggaaaatgcaagcctataccggactgttctttgcttctaattgccaggtgttcaacaaaatagcagaaagggattatctgagtgcatgccatgtatgatggatgttcaagagaccaagaaactcatagataaatttgaaatagtggggggaggattttcagtggtctcctttgtttagaagtaaaatatgacaattttctcgttaataacattattcatggcttccaaaaatggcctaaccgaaaccatacaaaccaagtacaacaattttaacacataccgcaaggcgattgtatccacacacaatcccatttccataagccatccgttccaaattaatggcaggtagaaccatggtcgtctgactgacgcctctgggctctggtggttcatgcttaaggccaatggcatcagacaagctccaatatgcatattttagttgggtttgtggagattggtgcttgctcctttttttaaccaagtgcatgcatcggtctatcactcaacatgcatggtgattgcaaattctatgcaaaccacacgtttattggcattagtttccaacacatattataaaatcactggctttggatcaaatgtaacaagcggtggctaattacgcccaaacagcttttcctacaaggactaacactaagacaaaaagcacaggcttggatggatctgtggttacctgaccagaagaatacccatcagaagaatactcatcagaagaatactcctcagaagaatacacacggcggcggcggggcacaaagaggggaagtggagatgcacggtgaagggcagggacgccagcggcaggggtggcggtagcagtggctccctgtaagcggaacatttctcggttaattagcggcttcagaattcagtcaatatgtagaacacacctcagaattcagtgagtagtggcactaaatgtggccaccttgaaaccttaccgtggtggagccgtagcggcgtaccagagagggtacctggagcggggaggcgccgcgagcagggcgcacggcggcgtatcctccctgcgaaaaagtgcaatttcggtcagcaagcaagcagcagcggagcaagcttacgtaaggtgaaacggcgaagaggtcgaggtcgatgcttaccccggcggagcagtagcggcggacaacggagggcgcctggatcgacggagcgggcgcaccgcgcgtggcggcgtgaagggtgaagncgcccccaccgccctgggagcaagaaatttttagggggggttggggaggggttttggtcgggtgatcaccgcgaaacccnacncaagtaggcggcggggggnatggctcataccttggcgcagggtccaggggacgagtacggcaggaggcgggccaccgncnaatagtcggcgtgncgncgncgaaggacggcncggagcgcgacgaccatggcgtcgccgcgagggttttgggtttgctcgcgtctcgtctccacccactccggtgaagcgtacgaagnaagcgtctgtggactgcgtgtagtgcaatgaatggaagaaggcaataagccaagggagtctttatgggccgggccgggcctggctcagtgttggaaatgtaaagaaaagccactgaaagcaaaatgctttcagtttttttttttttggagaaacaaaatgctttcatgtttgtgtgccattactagaaacttatattgctcatctaataaagtttatacaaaatgctttcttgtatttgggttgatgaaccccctggctatattctaaatcatctggtaaatgatgtaacaattttatcatatcaataaagctagccgaatggcattcctccctcccaaaaaaaaagtttatatggaatcatgcagcactaatcatgggattgctattatatcaaaaaaaatcatgagattttcagtgtaagaatgcagtttgcatttgaccgaagagctaagctagaatacataatttcagattggagaacccagattaatacgccagaaattggaaaattgtttttggacattagtagtgtcggtcacactcttcatttttacgctatattttgatattttcccgatctctgtgttggatctgacgtgtaacactaaatctcggacatacactttcttccctatccattttccctcttatatatcatgaggtattacgggcattgcaaaattgtttatcagatattgaagttttcttttgtatagttgtgccaaccaatattaataacatcaatcagaacaattcccgtatcatttttctaagcttttagatcatttcatcgtggcttgcatgcaacactacgaaaaagtagttgctgtgattgtccaaattatgaggcttaaggtcgtgtgtttggaaaaattaaggagattgggttaattacttgtatttacactcaacaagaattgccccatggactcttggagggttgaaatgagaatttgacaattggaattatttcttcatctacgtacgttccaggagatcagtgaccttgttgaaactaaaagggcactgtttttgtttattggactccagtcgcaagttcgataatatataacatacgttttatttgacgatctctctcgagttaaaatcacatatgagcacgcgtgccacatgtacacaccaaataatggaagaaaattttaatgcttttccatgctgaattgagagaattattcctgaacaatgaaagagagcgatggcgcgtgtttatatttcgctatgtagtcaggactgtgttgcttttatgttgctcaaactcagtacattttctgcttcaaaaaacaaaaatgttgtggccatcacaagagtttaaatagtaccagtacatacaggtggcatctagcaaacatgccagtaagtggttcccaccaaccattttcctacgtggaggatagcaacaacgtgcccgtaaagtgttgaaaatgtcatactgcaccgactttccagtccaactcagcgcagacaaattcagaaaca

SEQ ID NO: 58932 - DNA, 28409 bp, Oryza sativa
  unsure (1)..(28409): unsure at all n locations
acaaactaagagccatgaagcagtttgatagtatccacgcaaccaaatccatcggtttcaaattgggtaaaccttatgatcaaagtcaaaaaacgcgagatcgaagcagcctctctctaccaaacccgacgaaaaactaagcatccgcagatcagctacggtccaatcaaatcatcaaccgcgccttggattccaactaacacgagcgagagagagaagcgagccaaccacggggaaggaatcgaaaaacaacaagagaaacagaaaaaaaaaagcgagagaagaggaggactcaccgtagaggccgggagaagaagcgtacactcctctagggaggaagacgcccctcgagtacgaactccgaaggaagacgcggcgccggcaaccttgcaagtcacttcctccacacctgacgtcgtcgtcgtcccctttccttcaccttcaacttcagtcggtcacccaggtcggcgcagtctggcgccggacgctaccccgtctccaccggcgccggcttgccgccgtattcgccggaccagcgggggaagaagaggaggaggaggcggcgccgcggcggcaatggcgagagagcagagaagacacaacacaaaaaaaaatatttctgtaattttccacgccttcctcaaaatctccggctcaatttatttcgggggggaattcaattcaatgcacccagggtggtgtaccgaaattgccctccccgcccgttccgggtttccggccttccacgccacgtggcacgcgatggacgagggtggagcacacggcaggaagcgatttcctcgttctttctctctctctctctctttttcctatatatgtttttaagctggtaggagtacatttttttattcagaaaatctattagacggcgtttctgaatctttagaaataaattttaaaactgaaccgtctattcccacatcttccaaacacgtttctcaaatttctattgaaaattagggccttatctttttattttttgacttatgtttatgcttatcatccaaaatttaaattttcaatattaaatttagagctaattttgaggtttttttcatcaatgtttatttttagtattacttttagaatactaaaaacacgtatataaaagttttatttataaattattttttatttataaatatgctataaacaatggctcctttaatctactttttattttttttaagtatacttaattaattagatgttaatttgttgctcctttttagagcgaagggttcttaaccccaaatgaacacaagctaaaacgtcactgtttttgtttcggccgtgccatccttcttgtggtgccagagaaatgttactgtacgttatttgtgttgttccactgtgtcatattgaagatctgatcttacatcactcaaatcattgtatcatggacagttgttctaaggcactgtttatagcatgacaccatgctaatggctgaaacatctatttctctgtaagaaaaagaacaatcaaagttgtttgaaggtttagtttgattttttttactggaaaaatattcaagaaataatcacgtttggcctcaattgttccaagcaaatttatcatttatgccatgtggtgatcgctgcagagaagaggatgacgagtacttgtcattgctgtgatgttgtgttgcctggtttacacacacatttgcttctgatacaagtatcaccgaggaaaaagaaaatcaaacctccatactcatcaatttgaccagatcagttgttgagtactccaactccttttctttttctagaccagtgcttcttaagcatgtgctttctcgtttctcctttctacctgcttgctgctgctgcatgagagttgagatagtaataattatggagtcctagcagtaattaacttaaccaatgggtctttttttaaaaaaaacaactgggctgttttggtcattccattttacgttacggcctgaccgcaatgtggtccatcagtggacgaaagctggtggtaaaccaccagccacttttatattgcactcctacctcacttttgacggtgatagtacgtactactcctatatcaatacatattactgacatgtgggaccggataggttgtgtccaccttcaagtaacagtactatcgactgttacttgttgaaagtcatgtaacactggtctcacatcatcacattgtctggagtacgaccgtggagaaaaatgtgggttcgttcccaacatgcacgattattttccggtccctgttttaatagtactcttttttgtcgtattaaaatacatgaatctcaagccagcattaatctactcgatattacgatctatttagagtatattttaagaatcagctgatgagttcggagaagatagggaaatcagattctgacttctaatttattttctaaatgttataactatatttttttaaaatctaaatgcaaagcaaaaatgtttgtgaaaagatctgattataaaagaagatgcaaccgctagaagcttcctttaacctacttccaagacattttccataatcatactccaaaccaaagagatgtgactaatacaaagaaaataactttaagataatacctgtatggttgtatcaagtttgcgtttagagttcaaaacaaccatccatatgagaaacaactcaatactactctgtcaaaaaaaaaaataaatcctagctacaaatctaaacataaatcaaaatatgtatatgttaagattcataattagtattgaattgcgaaaagacctgtagcctactggttacaacagcctcagtagcacctgagatcctgggttcgactccctatgggagcaaatttttcccgacttaacggcgttgtgcttgtccagatagacgacgtacccttggacaactagacgtctgtggttatttcgtcaatctctccagaatttaccggccctgtcttcgaagatgttcatagggatagggtttgcgtgcgtgtgttcataggcccagtcttcgaagatgctcatagggatagggtttgcgtgcgtatgtttataggggtgagtgcgtgtgcgttgtgagtatctgcgttgtactgtgtaattctaaaaaaaataattagtattgaattatttatgggtagtactgtgtaattctaaaaaaaataattagtattgaattatttatgggtagggtttacgtacgtgtgttcataggcccagtcttcgaagatgctcatagagatagggtttgcgtgcgtgtgtttataggggtgagtgcgcgtgtgttgtgagtgtctgcgttgtactgtgtaattcttaaaaaaataattagtattgaattatttatgggacgaaggaggtaagtgtaaaagaaaatgagagggagaaacacgagacattgtgtcacagtcctcgaatcagagttcgtactgccaaactggactgttgaacctatgacctcccaaaacgggaacgacggggtcactttgctggaagtacggggtcccaagatttaagattcttggcttaatcttcccctgtttagctgcttctcacctaactaattttgtttggcacttgtagaagaaagacaagacccaaaaaaaaaaaaaaggaaagcagaacggcgatacgcatgcaggagttggaaacatgatgcggtgtgtaagactgacagtgtggcaccgtcgtctcttctcttgtggtggtcgctttcgtgctttgacatgcacgcgtccgccattgaagggatccaaccgggaagaatacttcctgtctgttgctggctgatatatagcctgatactgatgctgatatgatacacccagcttccccgacatattttcttttcaaatacaacacggggattttctgaggttcgatttcagtcgttgtgttacattttgttaactttaaagaagtactacagtattttcacacagggacggatctagaataggatagaggaggactatcttcttcttcctccttttccctccctccttcaatacccacgctatatccgtccctgatttcacgtgaagaattaagccattgccttgtccggcatcaaaccaaattaacatggacgcttgtatttgtaatgtgttttttagaaaataattttgatagcatgtttgatttacaacacggaaatggattttgtggtgcagcttcactttgcttgttatcttattcactgtaaccagattttaaattttaattttaggtttgattttaaggtactttttatcgtatttataaatattaaaattgtgtcggttgttttgttttttaataatagaaataacctacatcttcggtctaagtcaacaaagaccaataaaccaagaaaagttatgaaagaatgcaaaccagtggcgcactgtcgctcatatcagtgatggggacctaaacgtgcgagcttgtcttgtgcgattttggcagcctttcgtcgagttcctccccgtgcgtgcaactgcaactgcaaggagcttgccaggtgaagcgccattgatggatcatggatgcatgccattggtcgttggtcaccttttgatgagctatctcggcaccttcatgcatcttgcaatgcaatgctccttcaaaagaatcaaaaaggggcaaacccctcagcatgcatgccagcatgccatcgattcattcaccaaactgttcatcagccaggtgtgctcatgatcatacccaagatggcaaaagactgacggctgagtttgattcagatacttggttgagcgactccatatcggcggaacatatcctatgcatataagtttctagtacaaactctgtacacaccaactaccaaatgttatagaaaattccagaaaaaggatacatatttttaatagtactgcacctacgtatgaaatcttatcttcaattcattatattttagccgtaacaataaaacaaaataccagcagattattactcttaaaattgtcagatttttcacttttttgttacgtctagaatataatgaattgaagataagatttcatactaggtgtagtactattgaaaatatgtgtctattttttctagaattttctgtaacatttgatagttggtgtgcactagaaacttgtgtgcataggatatcttcctcttcatggggtcaagaaagtatgcctctcaaactaataaatgatatattttacatttaaagtttttaaaacaaaattatataaatttatttttcatgtttaaaatagttactagtaatacttaatgaataattcatgatctgtctctttttgcgtgaagcaaattagccaagccaaacggacagttcaaacgcaccgactcatcattcacactcacactgaccaacaaactccctgaatatcctaggctcctagcgtgaatcttgtgaattgtgaggttacattagtggagtatccaacattatctaaactctaaaccaatgcaaagcccccctttttttttcttttcattcgtgtttctttagagagggcatgcatgttcatcttcacctacctctacccctacctttctttgtctttgtagccaatcaagcttaaaagccatggataaatggagaaaaataaaaaagataaacccagcatgatggcctacgagatgacctgcaaggtgggtcctcccaaggtgagtgcacttgagaatatctcaaagcggggctctcctacgtgtgggcccaccccataaaatgtggtactttgccttttgggagcctgtcatgtggggccccgacctacctctcgatcatgaccagctagcttaagactaaaaagcaatcaaaaacatatttttttaaaaaaacacttggaatccgatcaaatcattccatgcatgggctttttcatgggtgagtgtgtaggtgtttttacatttggtcactcatttcgcttgcgattcattcatcacaaccggctgctttccgttgaagtttctcggagccaaaccagttttaagctttaggtgaacagaacgaacatttgtgtacacatcaacacagctgtgttgcttacttgctttgatgggagctagccgccatgtgttaattaattaatttcttgaaagcaatactccctcgtcctgtaaaaaaaaagatacattctaatacaacaaatctaaagagagttatgtccatattattaaattggttttttatatgacggatgatctaaagagagtcatgtccagattactagattggttttttatatggtggatggagtacgtagcattgtgtgtacaaaagaaagattagagatggtgttttttatatgttgattaactagaacgtgttgtgatcatcgtcttcgaggtcgtgagctttctgatgtgtaaatacagctcgttgtgtcaaagatacagtatttttcatgcattgacaatcactaccttttagattagtagatttattggaaaggatcacattaaggtagctcgatcatgaacttgcaagcgacaccgtaactaatccaagaggacgaaacagttaaagcctaaatttgttgtagtcggcaaagcaactttgtcataactgttgtagtatttgtgtctatatatatacagctccaaccacaaaacaaatatgcaactttgtaaatcaaaatgtctgcatcgatcgtgattaaagggaaagcacacaattccttcctgttttattaatgcgggatacttttatctcttttgtctgacatggactgaaagcgagaaatgagtgtgactctcgtgcaactagatggaaaaagattaaattatttaactagctagtttctttgtgattgataacttctgataattttattttcttaacaaacgtgtactccatatactataatctaaaccctttaaaagtaatgcagtaataatatatttaatataatgtatacttgtaaaaggagaaagaactcttgctcagtgtgcctgccaatcgttagctcagagaaaaagttgtgcgcaaattaattttagttcattcccaatcttgaaacagatcacaacttagttaatatttataatgcatttgctttcagtacgtataatcatgttcttgttcttttttgaaataataataataatcatgttcatcatgtgacggcgtgtgtcgcattttagtttaagtactagtactaaccagtagggggcacttcgaattattagtcggtccagtggtttacaccatgattacctccgtaagagcagggctaagagacaggattaattagcctattatatatgctttgactgcaaggtacgtgatcttggagaattatgtgcatgaatctcacatctgtgtggctgatcgatctcgtcgagcatatcacgcaacaaccagctgctaccaacctccccatgattaggtcagagcaaatcatggcttccattcagattggatatatagattcaggcaaaaagagtttgcagttttgtcacatttgattttgtctgatgacatgcatatgcaaagcggccggctccatgttttgattaattcgatgtatggctttatcagcaataactgattgttaatctctctattgttacatcatatattcagctggcaacgagctacgaagaacaagctgtcatagtcgtaaccaacaacatttttagttttgaacagatacatacataaacaattatgaagaacgtcgaacatcataaatataatacatcataaatgtaagacatcatagtgaggtggctagccggtgagactagcaggaacagctacccaggatcgtctggaaatcaggacactaacttgcaaagtctctaagctcaggattatgccattttctttttttttttaaaaaaaggattcaattaataatacataaaagataccctagtttgcccgagagaaaaatcgaaggactaaacggtatgaaagttgagaggaattatagccgcatttgagtcgtcaatcatgaacagatggtccaaacaaggggagaactgaaaatgtgatgagaaaagctggctcctgcctagttccctgtcctgcgttttccactttgtatgtgtgctcttttttttttctcttttaagaatttgcatgtgtaattggttgtcctaagcccaaaaatggcacacgctctctttgctctcatgcatgaaaagcgttgcaatggtacaatcacgtcccaagccatccgtgcatcttgccattgtcggaaaaatggtctaggaagcttattggttgttcatgctctctggtaagtaaaaaggtttattagaaaataaaaattaatttatagataaaacttttatatatttatttgtagcgatttaaaagctaatataaaaagaaattacattgaaaatatcttaaaatcaacttcaggttcaaaaatttgaattttagcttttgctttggcttattaggccaacctatgggctctaaattcacggcacaatcttgaaaagtgttgcaacggtacaatctctggtaattactttctccgttccattttaaacgtagtcatgagttttatttgaaattttttttatgattagtttttttattgttattagatgataaaacaaaattaatattttatacgtgactgatgttttttatttttttcaaacaattttcaaacaatgcgtataattaaagttgaacacagaagctcgtgactgcgtttaaaatgggacggatgtgtacatgacattgtcgcagaaatggtctaaattcacggtgacttctcaactaacctttgattggcaccgttccaacttccaaacaccgggtatggaggttagctcttttgacgagaagttcgttgccttcgtaaaatttgattgagacaaaaaaatattaagggttttttattctttacagatgtgttgatagactgtcctcacttcagtttttccacaagaacaagtgaacaacctacgtcgtttaatagtctttcaagacgcacactcaggcatgcactgctaaagtatcacaccatagaacacacattacatatgcgaaaaacgtagaaataggaaaaacgtaggattttaataggaatgcaagtgtaaaatagaggattgaaaaacgcaggaaaaacacaggaatgaccgttttattgaaccacaggaaaaacacaggaattgggtgagagagatagactcaaaggaaagttagcaagaggttgaagctcttgctaaatttcctccaaaatatttataggattatccattccataggaatttcaaaggattggatagaattgaatcctttgtttcaaagggcttcataggaaattttcctataggattgaaatcctctaaaaattcttatgtttttcctccaaatcaaaggggcctttaacatgcttgaaattacccccgttgtccattcaaaaaaaaacatgcttgaaattacttgaaagattttgagatagagcccaatagcgattattagtcaattgctccctacatcctactagctatttgttgagtttaaattaattgaaaaaatatagttattctccatatacacacactctcatctcaaccaatctaatcattcaccatttaattttacatgctaatttcatagtttcttataaaaacctctacttcctccgtttcacaatgtaagttattttaccattttctgtatttatcttgatgttagtgaatctagacatatataattatctagattcattaacatcaatatgaatgtgggaaatactataatgacttatattgtaaataggaggaagtactttttttatatttttggacggagcagtacatacctgattacatgcggcacaatgcgacaactaaaatagacaaggctcaaacgagggcccacctgctagggtcaaaaaattttggggggcatcatgtattcatgtcccctaatccggggcgtttaacctaacctaacctaacctacgtggctgtctctttatgacacatggggcccgcgctctgaccgtcctggcggcactaggcggcccatgtgcaaatgcaccgctctgacccatcacgtgtgggcctgacccggggggtccacctcccaactcgtgggccagcgttcccaccgcccctgcccaaaatgatccagctcagcgcctctaggagtggatgacccacggagagatatgtgtgtgccccacctgtcagacgggattaagggcctcgctctgtagtgtaatctgccaatgggattactctgtataataattaatttatgtgaaaactaatgttttcttataatacaatataagcgtatattatcacgtgtgcatattcatctatacgaacgtataccctacttatatgaacatctctaaaagactgagccggctatcttgagattaacgaaactaccacggacatttcattatcctaaatgctccatgtaaaggtaaataaagtctagctatgagtatgagtatgagtatggttctttccttcctttaaaatttgaaaggcatgtagtgtcgttttttgaaaaagtaaaacttgtactggtatttaccgccgtagaacttcctgtcttcgacgatcagaggaaaagaaaaaaatttcttgcacggcacgatacgggtgacgtggccgccaccgggacccacgtggcatgggctttgtgggcccacggacagagttggtcgaagcatatccatccggtagcccacagggtggcgatcccaaattgagtttaacacttgagtgggtcccagagtgcagggcccgatcatcatcttcatccgttattacatgctactccctccgtcccacgatataaaggattttcagtttttgccataatataagtaatttttagtttttgcttgcaacatttgaccactcgtcttattcaaattttttttacaaatataaaaaacgaaaagttgtgcttaaagtactgtagataataaagtaagtcacaaataaaataattaataatttcaaaattttttaaataagacgagtgatcaaatattgtaagcaaaaacttaaaatctcttatattatgggacggagggagtattaattagtaaagcctatagattgagttggacagatcatacgattcatccaaagtcatcatgctaatctcctccaatgtcatcatacaaatgaattgattattaccatgcaaagtttgggttaattacatgttcctcttgagtttgttaatcctacctcagtcctttttctcctaactacgctatatagctcgtaatcttcctcgagacggttcgttttctgtaacctaacacaaggacggacacgcaggtctcactctagtacgtatcatgtcaatgtagtagaatccaatcgagttgtgacgttggtgtctgtctctctctacctagaatccaaattcctctttccctgattgctctgccgttttgctgccgtcttaaggcaccatctcgacgatcgacgacgatgatgacagatcgtgttcgttcataagtagtaaaccggcgagattaggatcggtgtttaggtaggattaacatggcgtaatcatgggaagacatgatcatggcaaacggaaaggagaggagaactggagaagaggctcgatcacacactgtcgtgctgacaaagcttgtcttgtagaacacgcagtgtacatgccgatcgaactttcagaggaggagaaaagattaaatacgagacggcaagatcatacttctgctgctggtatagtagtagtagagctttacttacgttgtactcatctgctttacttgttggcgaccagagagcggctatcaaaccagatataggatgcaaaagttattaacagatgactgtttgtttttaactttctacatgaggttgacctggtatgtcatggatgatggaccatgcagctgacaggtgatgtacagtgcatgtgtcagggaaaacaagcaaagcatcccatgaactagtacacgtgtacacgtactaggctacaatgcccatacctgaatctgaccacacggcgaagtgacaaaggcacggccgcacgggtgcctggatgcatacagcctacagtacaaacttcacaagccatgtcgttgccatactcatccagcagcatcttcagaattcatacagaattctgaaaaatgggtagtagtaccagtacaaaatcacacaggatatgtacagcaagtgagcttctgaattctgaaacatgctggtctgtttacttgaatcaattaatactacagttgcctgggagcttggcacggtagctttagccagggcaacaacagatactccttcctgaataactctgtcagataagcgagaaggcttataccttcttgaagaatgacataatgttgccttgcttggttccagccttggcaggtttcttgttgccggctgttttactcgaagcattgcttttttcggtctttgctactggctgcggcttgcttgagagagttgccctgacagaaaatgcaaggagaacaatagttatcagcaggtccaatcggatcaggtacgttggttttgtgagggagttctgttaaaaatgacacgctagctgaagttgcctagtcgtctcacaaactaattaagatagagacatcaaatcaggaaaaatgttgaaatcagattagatggcatacttgcatgcaccaacacagctagtacttaggacttgaagagaacaaatcaatcagatgtctatttttacatccgatgctagtttttagatttccactacatatatggtttgcaatacatattttccccagctgtgcaaagagatcaggaaagcaggctgaacaatatttcacaaacaaattggattgctattgtagataagatataggatgtaaaagggtttaaggtaccaatcagcaggatggtgattagatgactacattttctcctactactctatggccagctccataccatacctacagcttcatactggacagattatttatggctacagggccaaacatttccacaaaacggaagaagacctagggattaggtaatactccatgcccatagtggcaaatatagtcagaaccacgttgtctttaattcaatggagattaatacatgaaaactaatcaggtcgttagtggtacaaaaatataaaagaaactgacgctgaatgtggtgaaactataatgagctatcaaatttcatcaaacacggcagaagacattacctgtttgcagcaccagtatcgctcacattcttctcagccttatcacctgcagaagcttcaccctcccagacaacctcggttactgaaacagaaaagcaagtaagaaaatcaatgtctccaattaatacggatgtaaagcagaccagggaattaaactaagatgcatgttacaataatattctgacaatacatggtaacacatatcagtgccaccttaatattctgtaggcattgtgagcatgcagcactgcagccatgcacccaaagtaatacccaaagtaatacggaaaaaagcaccatttccatgatttccttacatgagcttaaaactagaagattgactataaataaatctggacatactaaacgtcactatagtgtaaactatttcgttcgtctatattagactaaactacacttttctgtactatccttactatttcaaaagaactgcatactgcctttattcccttgttatataggacaacatgtcaacacaacataaccatgctttccataaaaaagacacaaactagccacaatacaggaaaaataattttttttactgcatttgtattattatagttttgcctttgtttttgcggtagccagtaaacataagtaaacaatattggcatattagaaacatgtgtaatatactttatgggattagagtataatgcttaccttctcttccccgctcatctattcgtgtcttcaaaactttccttcttttaggtgagttggaagcagtctcagcagcatgatcctgcttattgtcattaggtggtggaccattgttcttttcttttaaggtgatcccagaatggctgacagtgttgctacttttggttttacactcaggagactctgtccttcctatgcaacatttcacatccttctcaacctcttgtttattttccaagttttcttgtttggggttactttcttgagcaacctcatcaataggatttgtaatgcactgttccggtggctcaggagatgcaatggctacaacattgtcatcttcatcatcatctgaaagatcaaagactgctcttctctttctgttatttgcactagagccacgcttgtagtgtacagcttgttcatcatcactactatcagcatttgcttcttcctttgcacatatttgtgcatcagctgtaactgaaaacagcaacaagatgagaacttcagaagtatgcttaacttgacatatctgattttacatgattaggtatgcatttgaattaacatgcaagaaaatataacaaagaaaagaaacatgaatgtttgtatgcaataccagcaacacttggtaaaactgtaggattagtggtagctggagtcttgggtttagctgatgcacgtccccacatcgtagcaagtgatccaccattactgggcagcgccttcccattctgagccttgtttttgtttccctgcagagcaattgatggttctttgacaacaggagcattggtggctttatccaagaccgaggaaatatccttctcagccttattacttgttcctttctttggactggatgatccaggtagaccttgctgttgacccttagcagattgttcttttggagcactactagttttcaacggtgcagctgcagcaacactatttataggctttggcggaaatgaactcacaagcttcccattagcagttcgcttgacaaaagaattcaaaacaccacaaaacctgcagaagagaagatactgaattcataatcctgatgagggaaataagtggcaaacattgggatacttgtaaattttttttttttgcaccatatagttcttatttatatttttgctgtttaatataagtatattacatccctccctcccactctgacccattctgtactgctcctatctaattatgtcttctcttgattttgggggctaagcaaggtgactaagaagaacaatacctattatctctcaaacaattttcttcatcaaatggccggttaaaaagctcctctgcctgtacaaattcaggattccaaagtacagcagtatcttttggaatacaagcctggatactgtacacttgaactgaacaagaatctttaaattcttgccttgcttctgcatcataaagaaaaaaaaaacaaatgctccacttttcagtcaaattcaacatttatcagaaaagggtatactgtaaattgggaaactatactatgataaacctgaggcaagacattaccttcaagtttatggcctgaagtgagttttacacaataatttgtggggttcttctttaaccatccagacacactgtaaatcactttaagatcagccccatgtttgttgacgaactcctgaagcaacctaaaaagaattagtaactagttagttgtggttaggatgtttcatttatccaatgattaagggaaatatccataaaagggaaacctttacctctttgaatcattggatgatactgagaagttcctgctgagccatttgtatgaaatctgtcaaaaacatacataccaattgttgaaacactgtctgccaggcaaataaatccaacaactccaatggatcaaccactaaacaagtaacaaaaatattaagagaaaggacaggcaactggttcatcctatggccatgtggagctgcagtatcacacttggttaatcattatgtgaataaacacatgatatacagcaatctaattggatactccaccatcacatctatgtcgtgtttcccaagctacacaaactaccagcttcaaaattgttgaatttgacaaagaggctgaggcaaatcttaatcctccaccaaatgattggagtaaatctaagtttgtcatggaaaaatggaaacacttttactccctacatacacatgaataggcaccgagccatcaacaaagaaaagcagacgtgtcaactcagaacagtaaatccaccgcgaactggcacatttgttgcttgtttctttttgcttttctaagcttaccgcaaaatatgaacattgatagccaaaacaaaacccagcaaccctaagtttcacctcaaacgaaacgcaaaccctaactggcaagaacagtaagacaagtcgcacgagaaaccgagaaatcgtctcgccccccccccccccccttcccccaaatatttccttctttcgaatgccttgaaccgagaaacagataaagcttgtttggtaacacgagagaaggggaccagtttatacgaaggaattgatgatgagattaagatgggaatttgatttttaatcccaatatcttgtttagtagaggtgatggaaattgatagggagtttagttggagattaaaacggatggctgagatttgtttagacaaaataaaggagaaattctctcctaattacctgccactacccaagtattgaaaatgagggagttccttccttaattcctcatcccaatcttaccaaaattctcatgtctcccaaccaaaccaaacacttaataacctcatccctctgaactaccaatccctcctaaaaactccctccaaccaaacgggccgtaacgcggtagagcctcgcaagagcaagacaacgcgaaatcagacgatagagtcgtactaatcaggatggggattatttccgctatcactcaccacacggagcggatcggcgaagagggcgtggatctggggaatcaggtcgagcagggccgggtccgcggcggcggccgccatgagggtggtgcttggcgagagctccttctcccgtttccagaagattctagagccctcgcgcctcgctagggtttggggaattggggggaggagaagaattggggaattggggaattggcgggaatcgcttggggggataatgaccaagcggcggttttcccgcctccctcctttttcctctaggcggcagcccgagagaccgggacgcaggggtaggccccacctgctctagatacatccatgtcactgacagtgggacccacgctggagcggtccggttaacccgatgggccacatatggcgcgcacatcacactcaggttctggcctgttccggcccaaaacgcattgccgtcccaacgtaagtcgtatgaccgttccggcccatcatatatcaacattcctattttaggaggaaaaagttgaatttaacttggctttctcagatagacctgattcgtatctctcaacactaaaaccggatatatggatccctctaactattaaaatcatatataatgactccctcgattgattggggagtgattttggctaacgtgacattcatgttgcagtccagtcactaggagaattaaaagtagacatgaaacccacatgtaagtaacaagaaaagcaattgtgaagccaatatgtcagcgcctactcatatcctttcccatctttcttttctctttcttcccccggacccaccccaagctttgaggttgctagccaatgtgccggtggccgacgagcccctcagagcgggcagcgagggtgacggaccagtttagtggaggctggcccagtgcaacgcgaggtggtcaacaagagagcggagtccgcgcaagggtcgatcttgtcccgggcgacatcgtccaccttttcctagtggcggtagaaggggcaacctaggagctccaccgccctcacagtcggatgtccggtccactctccgctcgcaacggtgacagtcgtggtaggggttaggggaccgatccttatggctgtggtaggggctaggtgacggatcacagcggcggttgcgcatgcgggtttgcaacgaggaccaggattgacggcattgtagggagggggtagttgcttctgcttccgcccttcgttgaggaaactctgaaagaatttgtctctttcaaccacttcccttaccaggctagcaaccccaaggaaatctaggtttcaagcaaccacctaggattagcaagtctccaaacgactcaagatccaaatatggatgatgagcgctgatccaccggtgaagcttgctataacatgcaatctcctagaaaatagtttggtttccactaaattacctctttccttgcggaggtgagggaaaccttcacaaacttggaagttcaccgaataacgctctgctaactagaaagcttaacctctaagagtaacaaacacaatcgaagatttgcttgctatgaatccaagtgctcaaagattggagtaaagctcactagctcttaacttctcttctcaaccactcaacccccaaactcttctcttttcaaatcccttctcaacttctaactcacaacacaaaggtataatattggggagtggttctttttgattttggatggatatactcttgcacaaagtcagcaaccatggatggagagggtggtactctttcattggttttgcctatcgggaagaacaatatgcatatcagcacaaagtcatcaaccatggatggagggtgttggtttattcagtgtaacaacctgcatacacttaagtgtatgagcagtccctaaaacttgtgagagtgtcatctaagtctctgaaatctcaaaatatacttttttttgtctccgaacttgtcgtgagtgtcatatagatctaaataagttccaaccctccatgtgcggacgtggcacaccacgttgatgcctacgtgtcggtggaccaaagtgctagtcataaaaaaattaaattaaaagagaggataaaaaataaaaataaaggagagagagagagaggagaaaaagatggttatttatttattttttactaatatgtgggtcccactaacatatatgcaccgctgtgctatgccacatcaacacatgaagtaagttgaaacttgtttagtcatatacgacacaaataataaattcgaggacgcaaaaatacatcttagaaatttaaaacctagatgacatgtccgtacaaatttaaaaattgcctgtacacttcactccttacgagagtgaacatcgggtgcttacaaatattccccttgtccttaaccttgtttatccatggactttcttttgccttatttatccatggactttcttttgcgcgagtcaacatcgggattcgagtgcaggctgccggacatatacacacacaaaggaatatggttccagtgcagttgtaatagagactgcaactttgcagttgtaatcatttttcaccgttggattaagacgatcaacggtttaaatctatgccacgtcgtttcaaacagtaactgctacagtgctcgctacgggaaatacgcagctacagcatttgtcaaatatgcccagtaatatcttggccattacttcccaatccaacggtgcttatatgactgctcaagttgcagtggctatagcaagtgcagtatgcaggtgatctcaattccacacaaagtgaacggacaaaggtttttaagtacaacgatctatacatcctaacaatttttgccttgtccttaacctttttgtacatggatttatctgcacgagccaacatcgactgccagatagctgagggggaactgtacagggagttcatgcacaaaggtcccttcgttgaaagtgtaacggtctatgcaaggtttaccttttcgtttacaaaatgaaaaccactccccactggtataacgaaaaccgaccaaaagatgataaaaactaacgactttaagtcaaccccgtaaaaaaccgctggccgttggtttgtgaatcttccacgggccacatgattgatagtcggagcaaagtcggggagacatcgaaaacacaagccactttggtccttgttgattggtcagttaaccccgtcccacacgataatactccattagtaagcttcctatagccatatccatcaatgtgactcattgccggcctgaacactctgtcaaggaaaacaaacaaggaattagaactcacagatgacagataaagcaatgctgcagattgcagtactttaatcttcaaaatacaagcatgaaaatctagctgcaccctattgtctgtaccaggcatggccatggctcctgtaagcttcctcctcatcttcttcctcaccaccgctggtctcaccctccaaacctgctgtttcgacagcccaggacactccgcgaacctgtccaccatctggacctgcacttccccaacaaccgatgttctcgtcgctaaccctctactcagccggcccgtaccagacaatcacaaccttcattttgctgcaggcttctacaattaccccctggttaacacctacatctttggagtctacactgttactgacgccggtgaatttgcagacatgacctcttggcgcccagaacccgtggcagatgtatggtcggccaacagggaccagttgatccggcagaactccaccctaagcttcacggctgagggggacctggttcttcagcatccggatggcagccttgtctggtctaccaacacttccggccagtctgttgcaggaatgaccctcacagagtccggcaacctggtgctgtataatcacaacaacttaccggtctggcagtcattcgaccacccaacggattccttgctccctggacagagattggtgcaaggaatgagattgaagcctaacgcattggcagtaaatctgattgccagcgacctgtattatttaactgttcattcggatgggctctatgcatttgcaggatctagcaactcccagccctactatgagttcacagtgtcaactggaaacaagtcacagaatcctccagcgtatttaactctggcgaacaggagcttggacatatttgttccatcctcttcatctgcaaatctggaacacttgtcccttcaatcaccggctctgtctctccagtacattagatttgaatctgatgggcaactcacgttgtatgaatggcaagcagaccaaaatggtagatggctatatgtgcaggacgttttcccatttcagtactgtgattacccaactgtctgcggggagtatgggatctgcttgaatggactgtgctcctgtccaactgcaactgaaagtcacattcgatacttcagaccggtcgatgacaggagaccacatcttggctgcacactggagaccccgatctcctgccagtttgtacaagatcaccaactcatatctctacctaatgtttcatacttatactacgatagctccagagtttcagaactaactgatgaggagagctgtaagcaagcatgcttgaccacttgctcttgcaaggctgccttgttttggtatgttgataataaatcagctggagactgtaccttggtatcacaagtcctctcacttaagacaagttatccaggatacgattctttagcattcctgaaggtccagatcacaccttcacctcacctggaaaaacatagattagtacctttggttcctgtgcttgtaggagttgcttctttctttgtcatgctcaccattgtcttggtagttgtccaaatacgggcgtcagcaagacaaagatggcgaagacgagtttgctgagctacctggcatgccaacaaggtttagttttcagatgttaaaacttgcaaccaaggatttcagcaacaaactaggtgaaggaggatttggttcagttttcagtggacagttaggtgaggagaagattgcagtgaagtgtttggatcaagcaagtcaaggaaaaagggaattctttgcagaagtcgagacaattggaagaattcatcacatcaatttggtcaggttgattggcttctgtctagagaaatcacacaggctcctagtgtatgagtttatgcccaagggatcactagaccaatggatctactacaaagacagcaatgatactcttgactggcgcacacggcgcaatatcatcaccgacattgctagggcccttgcttatcttcatgaggagtgcacacataagattgctcatctggatatcaaaccacaaaatatcctcttagatgataacttcaatgccaaagtttgtgattttggattgtctaggctgatacatagggaccagagtcacgtgacaaccagaatgagaggaacacctggatatttgtcccctgaatggttaacatctcatatcaccgagaaggttgatgtctatagttatggagttgtgatgattgaaatcatcaatggaaggccaaaccttgaccattccaatcttggagggggtattcagctccttaaattactgcaagagaaggcacagaacagtcacctggaagatatgattgacaggaagtgcaatgacatgtccttacaccaacaggatgtgataaagataatgaagcttgcaatgtggtgcttgcagagtgattgcaacagaaggccttccatgtcattggtgatgaaggtccttgaaggagaaagtgatgttgaagccaacttgaactataacttctttgatnnnnnnnnnnnnnnnnnnnnnnnnnnnnnnnnnnnnnccatgagattcatggttgcattacttatagcttccttatttgtagacaaagcggattcggaattgtctttccttccaaggataacttgtatccatgcgcttcagattattagcctgttaagtcctgcgaattatgttcccgttgacccattcaagatgtcactgcatggctccatgcctccacctgaagcaaatgcagatgtagaaaaccatttttgtgaactgtattactgcaatcatatcattgatatcacacatcgatcagtgcatacccaagttaatctgtgtattgactagaaatggtagtactgtttcagttcagttattttgtgtcttttgttgcaccattttgttggttgcccctagctaacaggtttaacttctgctgatcgtcatttatccatctcgcaatgatattaagatgattatgtcaataaaagcactgcagtgattcaaattttgaatgtacgtaagatgtaggttggaaatagggaactcttttagcatgtgaaatagacatctgtgttatttggatggtgaatatagtcgtcacgcgtcagtagtatgtaaattatatccactgtgcccccaggttaattgacaaacctcatgttttaagtacgagttataaacgttcacatctcaggctagaaattagcagcaatgtgtagggggagcgcacatggaggaaggagaacaagatattagagattaattatccttgctgatctttattcatacgcacagcaatacttaaattgaccgactaattaacaagtcctacaacttatttctactgcagttaaatcaactattgtaatcctaagccaactaacttgcgaccaatgtggtggcctgcactggctatgtataggtgtgctcaactcaactgcatattcgtgaaaagataggatggctaatatgtcatataatcataggttttcttcctcacagtaaagagaacgaggcacagatgacttcttcaacattacctcttccagaatttcggtatagtatttcactaatcttgtgctaaacattttaatttcttgctgttacttagatcaaaacattcttgaaatagatgttccctatttttcgccattccaagagatattttgatctgatatctactccctccattccacattataagacgttttggcctctacatccttcgtctagattcactaacatctttattaatttggatgcatatataaagcacaaacatagatctatgcatgcatatgttcataacccaaaacgtcttagaatgtgaaacagaggaaatatgtactaattgtataattcattagatggatcataccatcatgatctaaatccaatctgtgttcaatgtcatgtgccacctttaattccaaaatttgaatataaaaattagaaaagtgtagctgaggcatatttttattttactttatttaaactgctgtaactctaaatattaccaacatattgtgattaatattttaatgtttataataatagcccatgctatgcaggggttaaagactagttcttaacatcagatgtggaaacatatttattctagtctacatcgatatctgttactcaatttaatgttttgaaaacaatctgtattttatctgttccactagttctgtttcttgactaagaatattcaaagtcaatgctgagataaaccaacatgtgatatggacaaggaactgaaatgtacctggctctcattgctttcctctgtcctctttaaagacgttgcctttagaccaatacttctatcatacggcacacgacagtcgacagcaatacaactgggttagtgcaatggtcatctgaccttagatagttgtacaattttgaaagaagaaaaacacaagtccttataaaaaaaagaatcagcagcatccagagaattgcagtcctcttcttagttcttatacgctaattggggggttaaggaaaaaaaggagtgggatttgcgtgcacatggttgttgctgtgtacgagaatggctcttccaggccgcctcctcctcctctttctcactgccgcacatgcagccctgcaaacatgcggtggtgaccaaacccctggccccgttgcaaatgtatccagggtctggagcagcaatacctctagagacgtgctcctctgctctgtcccaggcaatggcaacgagaaactgtccttcgctgccggcttctactgctcctccccttgcgacgccatcctcttcgccgtctacatcacctcaggctccggcgatatccctgtggtcgtgtggtctgccaaccgtgaccttgcggcacaccagaacgccaccctgagcttcaccgccagtggtgatttggttcttgcaaatgcagatggcagcgttgtctggtccaccggcacctcagggcagtttgtcattggaatgaccatcaccaactctggcaacctggtgctatttaatgatgcctacatgccggtgtggcagtcgttcgaaaatccaacagattctttgctccctgggcagatgctagcggagggaatgatgttaaggcccaacagctctgccaccaactggactacaagcagacagttatatttcactgttcggtctgatgggctctatgcgtttgccggatctgaccaacctcaaccatactatcggtttgagttttattcgtcatatctggttaaaaatgaaagcatcacacagtatcagtacaaaccaacctttgtgactctggtgaatgggagcctatcaatccctggatctgatccactggagaccaaattgccacctgcacactcacttcagtacttgaggtttgagtcagatgggcatctcaggctatatgaatgggaagagttcaaacaacgctgggtgatagcaaaggacatctttgagttaaactactgtcaatacccaactgtttgtggggagtacggcatctgcttaagtgagggctgctccactgagggcatggactgctcgactacggagtgctcctgtcccaataccacatacttcaagccaattgacaacatgagacctactcttggttgtgcggtggaaactgagatttcctgccaagctatgcaagatcaccaactcgtagcaattcctaatgttacatacttccatctctggggcgatagccgtggtgcaccaatgaccgatgaagagagttgcaagaaagactgcttgagcaactgctcctgtaaagctgccttgtttagtttgtatctcaaccaaactcaggctttgctctatccggatctatctctttctatgtcatatctgaatacgtgttacttgctaccagaagtcctttcactgcaagcatatcttgatccaggctactactcaaaagatccggtaaacgctaggtcaacattgtacgtcaaggtgcagagtacacacctgcttcctccatcaaagaaaaaaaacacttttggttatgcaattggagcaaccgccgctgcactagtgacactcaccattatctcaatggtcatcaggaagaggtgtaatcgacaaagagctgatgaaagcgattttgcagacctgcctggaacaataacgaggttcaccttcaagatgctgaaagcagcaaccaatgatttcagtagcaagcttggggaaggaggatttggttcagtttttctaggaaaattaggcaatgagatggttgcagtaaaactgctggatcgagcaggtcaaggaaagaaggacttcttagcagaagttcagacaattggcaacattcatcacatcaatctggtaaagctgataggtttttgtgtggagagatcacacaggctcctggtttatgagtatatgcctagaggatcactagacaagtggatttattacttgcatagcaatgctccactagattggggcacgcggaagaggataatcaccaatgtcgccaggggtctgtcttatcttcatgacgagtgtaggcagagaattgttcatttggacattaaaccacataacattctcttagatgacagcttcaatgcgaaagttgctgactttggtctatcaaagctgatcgagagggagataagcaaagttgtgacaagaatgaaagggacacctggatacatggcacctgaatggctgacttcacaaatcacagagaaggttgatgtatatagctttggtgttgtggtcatggaaatcatcagtggaagaaagaacattgactactctcagtcagaggagaatgttcagctcattactttactgcaagagaaggcaaagaaaggccagcttgaagatctggttgacaagaatagtgatgaaatgcacttacacaaggaggaagtgattgaggtgatgaagcttgccatgtggtgtttgcagagcgatagcagtagaagaccatccatgtccgtggtggtgaagaccatggaaggagaaagggcggtagatgacaatttgggttataacttctttgatttgagccctgcaatatctgttccagttgagcagctcaacagttcattgcaccctgaagcatcaattttatctgcccctaggtgaaatcataggtaaaaaaaggtccagtgttcaacagtagtgttgtttctaattatcctatgatgaagtttgatttagttcgtgattgtcatgtatgtttcagcaatgtagctttaaaatgtctttgtctaagttaaaatctgaaataacatgcatatatgcattatatatactgagattttaaaatggcccttgaaaaacagcgatgtactgaacatatggccactcagttttaataaattgtacatggggcttaaggccctgatattattatggttattatagttattgttgttattactgttattgttgttattcttgttattaaatatttgattagtttgagtatttcattgcatcagacaatcaggttgatgccacatatagccaacagtgctgatttatgagctaatttgttttttatctgttgccattcagggtgtgaggaatattttgaaatatgtcttcacagatgatatttgtttgagatttttcccctgttagtattcagggtagttggcaaatatcatgtcaacagatgattattgccctcccttctgacacaagatcattctcttcctctatactccctccattccataatataaggcacgaccacttttttttagagacttagatgttccataatataaggcatgcatgcaagtatgcaattaattataacatcttctctattaaattattactttttaaaattcttcactctcatgttatctaatcctattggacgcatgcattatatttattaggatgatccaaagttccaaactacaagatgataataattatttcttggtctttgggttaagggtggttgtgccttatattttggaatggagggagtatatgttatatatttgagtgatgagtgcatgcagacattatttatgtttgtacagtacattttgcatgctacctgtgtcattagtatcatcaggagagaagtacctcagaacccatatgacgccttggggagattgtaatggcttcactggtgctcagatcatctcatggagatgtccacgaggagaagctcgtaggaggcgttgaatccctatccgtaaggctggctccatgaagatattcccaactagaaggggggaaatttcagaatagattagaaccacgaagagcaagagaatttcaagggaggttggatacctcactaatgtctcctcgagagatcggcaagct

SEQ ID NO: 58933 - DNA, 30530 bp, Oryza sativa
gtgtctagctagccatcgcgatagcggttagggcagccacaatgattgttatatatatatatatatatatatatatatatatatatatatatatatatatatatataaaagagatgtatgtcagcatattttcctacttaaaaggtattaaatgaagagagagagcaaaactatctactaacttagagatagtctatagagaaaaacgaggcaatgtatgagagagctatagatactaatgtagacatacttactatcaatcgagtctattgctgagatgtacatattttatagagagcaccttactttactattgcgggtgctcttagccggccttattgttcgattttaggattcaagacacgttccaacgtttaaaaagatctttaaatatggtctgatattgatgtcccgtgtttctctttttttcggtcgttcagatgatgtccggacatgttcatatattgagggcatttcggtaccgcatatcacacctttgggtaaaatcatggaaaactacagaataaagacgatgactataagataaagaaaaaaagacaaaactttcactaagcgatgaagttaactcataatttattttcatgatacactctgttaaaaatgttgtaataattttctcaaaaaaacgctaataagttttttaaaacatttacctcgtattttaaaaatatttgaaagaggatgtgtcgatatacaactgtagttatcatgcacttaatattttcctcgtgtaataacaaggagtcaccgactgtcaccaaaacaatgtagtggcaaccggcagcacatgaataagaaaaaaaatcacctctaatatatcgatgtatttgtatcatgctgaaataaaaagtagttactactaaattgaatatataggcactaatttatgccgaatatgttcaatcgcacttttagaaatgaggattatcacggaatatgttatttcggtaactttgtgttaataaagacattactacttaaccatgattgagatataaaaattaagcatctataaaattcatagtatcacacctatattctgttctcaaccccaatttttttatcatgatcattaatattacacactccttctaaataaataaattcaagattttcacatgacttagtttatatttcaaacaaatcctctaaaactgaaaatgtttcccacgataaatctattagtatcagtgaatcatcttgtccgatggtttgtttagagagatcaaattagtggataatatctctgcaatctaaaacagtagcatcaattgcataaaaatcatagataagtagcatcagtagccttaaaaaagcaactaatacgatgaaacatataaaactgcttgttaattaaaacattgctatgcaaccgtgattgaaatatacaaattaagcatccataaaattcatgctaaagacttaccgcatctttaatcttcttagtttcttttggccctagttttttttaatctagatacaacaaaaaaaaacaacaattataatgaaacgaatacaatcacattttaataaaaatatcgctatgtaacatgactaaaatatacaacttaagcatccatacaatttattctaaaaatgtaccacatctatattcttcttgactactttcaaccctaacattttatcctgatacaaccttaagaaagcaacaatcacgatgaaacggataaaaccacatgttaataaaaaattactacgtaaccgtcgttgaactatacagattaagcatccataaatttcatgctaaagacgtaccacatttctattcctcctgactattttcagccccaactttttatcctgatacaaccttaagaaagaaacaatcatgatgaaacagataaaaccacatgttaatataaatattactatgtaaccgttgttgaaatataccaactaagcatctataaaattcatgctaaagatgtactacatctctattcttctttatttattccggcccaactttttatcctgatacaatcttaagaaagcaacaattacgatgaaacggacaaaatcacgtgttaacaaaaatatttctacgtaaccgtcattgaaatatacaaattaagcatttataaaaatcatgctaaagacgtaccgtatagttgtttctttctgtcccaaccttttatcgtaatacaacctaaagaaagcaacaatcacgatgaaacggataaaaacataaaaccatatgttaataaaaatatttctacttaacagtcattgaaatatacaaatgaagcattcataaaattcatgctaaagatgtacaacatctctattcttcttgacttattctagcccgagctttttatcccgatacaaccttaagaaagcaacaattacgatgaaaccgataaaaaccgtacgatgataaaaaatatttctatataaccgccatttgaacatacaaattaagcatcaacaaaattcatgccaaagacgtaccacatctccattcgtcatccatacccaattctttatcctaatcaataccaccaaagactccttctaaactaagaaactcaagattttcaccttggttcatctctcatgcaaatcctctaaaattcctcctataaaacatcccagttcatgaaagaaaacccttcaaaaatatcatactgagcacagttattagctggaggagtcagcacagttatcggtaaaaccacttccccatctgtccaaactccaaagccggcctcaccggcagcagccacaccacaccacaccacaacaccccgcagccttgctgcctcccctccctgaccggtcaaaagcacaccaccaccatccccccgcaaagccaagcaccaacgctcagcagcagcagccgcctccctccccagctcagctcagctcccccccgcatggaggcgccgccggggccggagcccatggagctggacgcgccaccgccccccgccgccgtggcggcggcggcggcgaccgccggcatcagcgagaaggtaacccgtggggaggggggtgtccagatctggggtgtcggggtggatctgggctggggctcggtgccgatctgctggtttcggtggtcgttgggctaatgctggttttctctccggtgtctcgcggcgccgtttttttttttttttttttttttttggttggaggtgctgcaaaaaaaggaggagggcgggggcgaccccgtgacgggtcacatcatctccaccaccatcggcggcaagaacggcgagccgaagcgggtgagcttttttcggggtctttttggtttctgttcttctttgtgtacagtggaatgtgctagttttggcgcccttcgcttgcttccttgctcgtaacaatcacttggttcgctaaggatttgtgctctcttaagccgtttctaagctgttggtagtgttcggctgatcaagttagctatctatgtgctgattcgtcggggaatcgcaattttgtgggtttggggctgactagatacagttgtcgttttgatttgtaaacaatttagcatttgactgataaaattacgtagtgtattcctcaattaaatgtttggttattcaattacttgaggataatgtacattttaggaagcatgattttctttttctgtccgctatttcatagtctatcctgttgtttctagggggtaataaatgcttcacttctaattttagttagtcatgataagctggaactctgatgcacaacatagaatccgtcaatcttgagatattgtgcgcgatttctcatgcgatttttttcttaccttaactgcagacaattagttatatggcggagcgagttgtaggaactggttctttcgggattgtgttccaggtacgatgcttggtcttatggaaatgcatgcttaccgtgtattgtacattttttgatatgtttgaatcaaactgatttagttttcacatttaggctaagtgcttggagacgggggaaacggtggccatcaagaaggtgttgcaggaccggcgttacaagaaccgtgaactgcagcttatgcgcgcaatggaacaccccaatgtcatctgcctgaagcactgcttcttctcaaccacaagcagggatgagctgttcctgaatcttgttatggagtacgtccctgagacactctaccgtgtgctcaagcactacagcaatgctaaccagcggatgccattgatctatgtgaagctttacatctatcaggtttgtcagccaccatgttaacacctctctgattgccactatgcttctcattgcttctctaaagatacttttgctatgcttgcagcttttcagagggttagcttatattcatactgttccaggagtctgccacagggatgtgaaaccacaaaatgttttggtatgacttatgtgaacaaggctacattacttctcttgcttggttgtttgttttgaactggtctctaattgcttgctgatacaggttgatcctctcactcatcaagtcaagctatgtgactttggaagtgcaaaggttctggtatgttgatttccacccttaagagtaatttctcagtggtttgatgtatgctgaaattattctagtggtaggctagtcataatgttgacagcataagtggtttatttcgtcatgttgcttttacgtgtagatatgctgcttttgcctttcatgattgatttgtgatagaagttaaaatttgcactgtgctgggatagacttttttagatagctcaatagttaataaaagaaattgcctatcatgatcaatatttccaaattggttttatcatgtgctgttattatgtcgaaggattgttaagtttattaagttggatgcaaagttgctgagctaggactataatgatgaattcctgagcttggattataactgttggcctctcttccctagttctgttatttcttcattttgctattttaacaaatagattgatgatctccttgtactattccaccaggttcctggtgaaccgaacatatcatacatttgctctcgctattatcgtgctcctgagctcatatttggtgcaaccgagtatacaacttcaattgacatatggtcagctggatgcgttcttgcagagttacttcttggtcaggttagtcactatatctttatctaaggaactgcaacattcaggttccttgattagattatgctgtgatgttattctgattatatttcataatgtgtatttgtcagccactgtttcctggagagagtgctgttgaccagctagtagagataatcaaggtattgcatgatgttgtgcaagctacatttttttttttgccacgggtatttcttgtgttaacttgatattatggcaggttcttggtactccaacccgtgaggaaatacgatgcatgaaccccaactatactgagttcaaatttcctcagattaaggctcatccttggcacaaggtagccatgttttcttatattggatcaccttcctcataccattttacttgcagggcattgtaggccacttcaaaaccagtttctgcatcatgtttaatttgaaataaaaaaaatgtatctgcagctgcttaactgatccatctgttgttctttcgcttaccaccagattttccacaagagaatgcctccagaagccatagaccttgcttcccgtcttctccaatattcaccaagtctacgctgcactgctgtgagttttctttcgtttgcttagttttatattatctataaatctattgttttcgctaagcgctaggataatgattatttacatggatttgcttattttagcatttcatttcaagtgttgttagctgttacagtcaaatattcatagaccgtgtgtcaagaacaataaacgaaatgtttctgttgaggtcccttatggaagtagattgatggatccctggtcctgcatggtcattgtaattataatatccagtggtccaaaaccaaattggtgtgttggctggtgaagagtgagtgcaactttcatacagtcgcatgtgcctgttaaatatagttgttagtgctccacttgaaaaagttgctgttaattgtttaaagcttatgctttagctggaaaacagtataatctctaaagcagcatgctggacattttcaaagagcttagcatttggttgattatatgcagcttgacgcatgtgcacattccttctttgatgagctacgagagcccaatgcacgcctgccaaatggtcgtccattccctcctctgttcaacttcaagcatgaagtaagtaaacgagaacattttcaaacagtcgctttttatggtacatttatatttacctgtcatggatgcttatcaatgctcatttctggtatgcagctagccagcgcctctccagaactcatccacaggctcataccggatcatatcagacggcaacatggcctcaactttgcgcatgctgggagctaaagggcaccgcgacgccaccgttttgttcgtttatttttccatgagctggacattgcaatcctagatgactccattgtcctggacttggactccatctcagattgcaccatccatgttccatgatccatccatccgtcaagccatttccgcaaggactcagtaccagagaagaagtacaattatgtaaattatctaaccatggagaaatgcgtgctgctgctgctggtgttaagtacgtgacggggcatgctggttgagtagtaggtaaggttaaggataaatgtagttggtggagactgagagacatgttaagctagggaaccctgctttccttcttttttttttctcctttcattttggtttcttcccattttgtgatccttagcattgccctacagtagtgtagctgctccctgtttttgtttgctctttcatcatgtaaatgccaatcccaatcgcaatgaaccctctttccttcacatcctggtctactccctgtcttgattttgcagctttgtttgttgatgatcaagtagtgaacctgaacatctctgcaattcagtgcaagaacacaagaattcagcagaatcatgtgatacaaatcatgcaatcctgcgaggatacatttgcagcgcaccaatcttgatgcagcggaagcatacacgatacaacatacggtaaggtagactacagcagcggccgtggcggcggcggcggaggctcgtcggtggcgtggtccttcaccttggcccagagctccggccaaatcgccttcctggtctcggccacgatctccccgtcccatcccctcgccgcgagcgcctccgtctcccggacggcggcggtcaccacgtcgtcgacgccgccgtcgacggccgcgtacacgatgccccgccgcagggcgtcggccgccgtcatcttgttgccccggaggactagatccctcctgttcacggcgtcggggaccttctgccggatcagcttggcgaagaagtcgacgatcttgaggccggcgtccacctcgctcatgtacaagaagccgcgggaggcgcgcatgaccacggcgtcgtgcgcgagcgccagcgcgcacccggcggccgcggcgtggccggtgacggcggcgacggtgggcaccgggagagcgaggaggtcggcgacgaggccccggaaggcgccgcccatggaggcgtgcagctcggcgggcacggtgcgcgcccagtccaggtcgaacccgttggagaagtacttgccctcgccggcaatcaccagcgcgccgccggcgccccggcggcggcggcgcggacggcggcgacggcggagcggagcgcggacaggaggggcgggccgaggcggtgctcgccggcgccggtgagggtgatgacgtggacggcgccgcgcttctccacggtgcacaagctcgccgtgtccatttggggatttcggcgatgaatgccgtcaagacctggatgtctggactcctttggcgtttcagttcacgtttatcttttcgacatgagcttcccagcatcttcgttttgtttaatcagctgtcaagagcaagttcaatagtatagtccactactagctccaatttatctatagctaatctaatagccaattaatataatagttgcttactatactattagcatatggtcccactgtcatacacacattgcgtcttgtagtccgtgctgcagctggctacagatttgtaacccgctgctcttctctctcatcttttatctcattaaaatatgtttgcagctagcttatagcaggtacaatagcaggctacaaacaagctgcaaacatattttaaggagataaataaggaaagagaaggacaacgggttacagatttatagccagctgtagcacggactccaagacacaatatgtgtatgacatgtgggaccatgtattaatagtgtagtatgtaactattatatgaataagctattaaattggctatagatgaattggagctagtagttagctatactattgaacttgctcttagtgtgctaatcgtcgatttgattccaagtccagtagctcatgagtcatgacgcgttaccggccaatcgtactggatagtactttttttaaaacattttgtaaacgactcttgcgtcgaagatcaacattacaatcacatttatcttgcaaacaaattgtagactgaccggttttggaaaagataagcaccgtgacggaatgagaagaaatttacaaggtaaacatcatcgtacaattcgcctaggcttggagggcaagattatagatttatttttacaggaacgagttcccaacttccgtatccgcttggagcacacggattttttttaaaaaatacgttgtgatttcacatgaaagtgcacgattaccatggggattcctggtattctactaaattgccagaagggtttgaactttctgagttacatttattggatcattgccaaagaaacatctgtagtgacattttctttttctaaaccattctcttttcattttatcaacattgacagcagttcgtagcatatgtcaaatcatatatctatctctgctaagagagtaaatagatctgagcattaagatgaaagtacataccaccaaaactgatccaactcaaagttgacaaaataacaaaacatctttagttttaagaagcatacaaatccaacatccaaataactcaagttctaaagagaactaggcactagtgacgcttaggaggtgttggcttgggccttgttgaggatgacaccctcgtacttgacctggaaccacttcatggcatcctccttggtgaccctgtgctggataccaacacgggacttgcacctacggcgccgcgcaacacggtacccagcacgctcaagaacgacgtagaagtccataccgtaaataccagtggatgggtcatacctgaaaggcaacagataggtcaatttacttgtgaatacataacttcattcaatgatgatgatggggtgatattgaggggttagtgtgcagtcaacaaaaaaaacagacaatgtgtcagcaggtctatgtacatcaaggaactactatcaatagaacaatgtgccttgacaaatactgtgaatataattagttaacatgggattccaagaacatatcaaacaataacaatacaatgatacattagctggaaaacactagcaaacattttgcaacagtgcacgagagcatatcgtactaaaagcaagagcatatcgtagtaaaagaagatactcaataacctgctacgagtccaagaggctagcacactagtgcaacattggatgatcaactacgtcgcatgaaacatacactgaacaaaatttaggaaccaatgcatagcacgactgtttctgttatacatcaaacattacaaatgttgaaagatgagtagcatttgagatttgaagtgaggattttgatacagaaacaacaaatgtagtaaatacacagatcaaactgattttaaaaactacatttcacccaaataaaaatctacgcatgaagaaaagtaactacatttgggcgttgaaaaggaagtttagtaacaaatgctctacattgaaataatacaagattatgggattatataatcttacttgatgccaagatcaatgtgctcctggataccaaaaccaaagcatccagtctcactgaagttcctcctcagcagctcgtactccttcaccttcaggccactctccaggagctgcattgccttctcaccacgcactgtcacgtagcacgcgatcttctcattacgccggatgccgaacgacctcacagtgtacctcgctgcaatatcgcatcatcgtcactccaagtctgaaagccagcaataaaccacataccactgataataacaggccagacttcagaatttacccttggagaacaccggtgactgcccactcagctgctccagcacctaacagaacaaacagcagaatttacatacatttgagtatggacgatcgaaaacatgatgcataaaactcaaagtcaaaacaaaatgttcatttgaggccaatgaggctggactaatcatgcccaatctacaaattcgacaaatggaataaattgaaagtccaaaccagcttctaatcgtaatggcttcatgctagcagcatcagtaacacaactttataaaccatccacgagcaaccagacaacagctagattggacacacatcaatcaaagaataaaaatgcccagaaccaaacaatagctagccgctacacaatccggactggaaagctcaccattgcactcagcctatctgaaaccaacaaaccgtacagctctacatgactaaaccaagccgaatctgacatgacatgaacaggtgcatcgtgattattaccttcgaggcgcgggtgaggcgatctccgctctcgccgacggagatgttgaggacaagcttctgcaccttgatctcccgcatcgggttcgcctgcttcttctccgacgcctgcgagcacagaaaccaaccaaaagaaaacgcatcaaaaccacgcgcgcccgagcggacagaagaacgaatcgaggagaagacgtcgccgacggcaaggcggcgcgcctctcaccatggcgagatctgggaggcggcggcggcgagggggaggcgggagcggcggagatggggggtttagtgttgctcgggcggcggcggggaaggagctttgtaggagtaggggaggaaaccctaaaattgttgtgctgggtgtttgtatggtgacaattactatattgccccggtggaatggaaaagaaagggaggggcatttacgtaatttcagttaataaaagggattagaaaaaaatttccgttgccgggactcgaacccgggtctctcgggtgagagccgagtatcctaaccagctagactacaacggaagcttggtttctctgtaattctaattttatgtatatgttttgtatatgtagcaatttacaaaaaaaatgtctaatcttctgtttgcttgttcattggaagattcgacctgattatcacaagccgtataaatcgatgaattcttgtcgtatatctgtcatatatgggaagaaccgaagaagcccaacttttcttggcacaaataatatcatctctgtgttgctgtctgataaacttcattttatcggttattagtattactgtttgtaatcatgtattaggagtaacagtttttaactactttttatagtttggtgaatgagccaagacaattactcgggacttggtttcagagatcctaaaacatttcaatgcaacagatggccttaaaaaaaacttatcatagacaggggctgaccataagaaggtgcattacatgtattctacatttctacagctttcaacaagtgaaagagggtttcagagtgaacaaaaactcaagaggtactcttagaaagtcagagattgctgtaaaaactgctataacaattcagtcactgtcagcaaagttgctggtagtagcctggttatctgcaagactgcaactgcgtgattcttggtcttggccaggacttgacaatcagacacccttcagacgatcaatcagctcactcttcttcagcctcgagtaacctttcatccttctcgccctcgccaattctctcagctcagccaccttcatatcattcagatccagcgcctttggctccccatctgcatgttcctccgaaacatcagctatgcctagcttgtcaacaagaagcagatgatcagttctgggatgtcaaacagcctgcatttgtttgatgtgttcttggaacagcaataaccagttctttttctgaaatacaacagttcaatccacagtgaacagcatcagttctgtacatgcagaaacgagtgcaagttctacgttttcttttttcacttaccgtatgactgcttcctcctctcaacctcttcgaacgggtcagatgattgcttcctcgtcctcctcgaagttcttggcgattcctcggcaatggaggtctggatgcttttgaagaactcaatgagctcttctttgctacgcctattaaccgttcttggcaacggagatccatttgcttctgacctgatgctccccaacgatgagcatgagaagctattccgtggaggacaaagcagaatcccatttgcaaagtctgcaactaattgaaaagatcagttacttaacaagaagtttcttagttcatttcgccatgatttgcagttttagctaactgcagtttcaaaccaggtgttataaaagcagaaagagaaatgatggcatgctgcaaaatcatagttaattacttatgtttatgtatgtaaattaaggcatgtgtgtaaatttcagaatgaactgattcactgtcacctttgtggagagcaaatgatcctgggaaggcagcctttgcgagataatttggagagatttggtgatgctgcaagagaattcctcccattttctccattttttcttgctccaccacacaacaggtgaagaactccctgtcctccaatggagccaaaagtttgttccttctgctctctgcttcaatccactcacagccacatgaagaaaaaatgagaactgatactcagggaaaattttcattgataccctcaaagtaatattgaaattttttaggcatcattttggaactagtacagtagtactacaacacaaatgcgtgatgtccttttcatgaaattttcttaaatgtgaggcgtgaaatgggaaactttgcaacccaatccagaaagctatccatttcaaccaagcgaagccgcggcaacatcgcgggatttcgcggcaaaatttgaactccccttcttcttcttcttcctcctgctcccatggcgacgcctccactcacctccgtttccagccacctccgagcccctcctccatggccgcctcccaagaacagcagcccaagaacaagggttaggtgcgacgtcctcgcggcgtccggtcatatcctggaggcggcctctgctccgaggggcgccaagaattcgcggagtcgggcaccgagaaccgatgtggacgtgcagattgagaggctctgtcgggcgggtgagttagaggaggcgttgaggttgctcggctcggatggcgtcgacgcccggagctacggcgcggtcgtccagctctgctcggatctgagatctttggaggccgggaagagagcccatttcttggttcgcgcatctggtgttggaaaagatggaatggatagtgttctcggaaggaaattggtgctgatgtatgtgaaatgtggggatttggagaatgcaaggaaggtgtttgatgaaatgcctcaagtgagtgacgtgcgagtttggacttcactgatgagcggttacgcgaaagctggtgagttccaagacggcgttttgctgtttaggcagatgcactgttctggggttaggccggatgcacatgctatttcgtgtgtcttgaaatgcattgccggtttgggcagtattgcagatggtgaagtagttcatgggtaccttgagaagttgggtttgggggtgcaatgtgcggttggaaatgcgcttatagcactgtactctaggtgtggccatgttgatggttcactacaggtgtttgatgggatgcctcaccgggatgtcatttcttggaattctgtgattagcgggtgcttttcgaatggatggcatggtaagtctattgagcttttcgccaaaatgtggtctgaaggcctcgagatcaatccagtgacgatgcttggcgttttgcctgcttgtgctgaattaggatacaatcttgtcggaagggtgcttcatggatactcagttaaaaccggactactttgggaatttgaatctttggagaatgggatagatgaaaatctgggatccaaactggtgttcatgtatgttaaatgtggtgaattgggctatgcaaggaaggtttttgatgcaatgtcatcgaaaagcaatttacatgcatggaatctaatgatgggtgggtatgcgaagcttggtaaatttcaagaaagcctcttgctgtttgagaaaatgcatgactgtggaattactcctgatgagcataccatttcttgcctcctaaagtgtatcactggtttgtctggtgtaatggatggtttggtggttcatgggtatcttgtgaagtacggttttggggcacagtgtgcagtttgcaatgcactgatatcattctatgcaaaatccaacaggattgaagacgcactcatggtgtttgatgaaatgcctcaacgtgacatcatttcttggaattctataattggtggatgtgcttccaatggtctatatgataaagctgttgagttgtttgtaagaatgtggttagaaggacaggagctggactctactacactgctaagtgttatgccggcttgtgtacagtcgcactattcatttataggaggagtggttcatgggtattctgtgagaactggattgattagtgagacatctcttggtaatgctcttcttgatatgtattcaaattgctcagattggcgtagcactaataagatattcaggaatatggaacagaaaaatgtggtgtcatggacagcaatgatcacaagttataccagggctgggcattttgacaaagtggctgggttatttcaggaaatgggattagaaggtatcagaccagatgtcttcgcaatcaccagtgctcttgatgcatttgctggcaacgaatcactgaaacatgggaaatctgtccatggatatgccatcagaaatggaattgaggaagttcttccagttgctaatgcactgatggaaatgtatgtgaaatgtgggtatatggaagaggcaagatttattttcgatcatgtgacaaaaaaggatacaatctcatggaatacactaataggaggttactccaggagcaatcttgccaatgaagccttcaccttattcaatgaaatgctactccaactccgacctaatgcggtaaccatggcctgcatccttccagctgcagcaagcctttcatcgctggagcgaggcagggagatgcatgcctacgcagtacggagagggtacttggaagataattttgtagccaatgcactcgtcgacatgtatgttaaatgtggtgcattactgctagcacgccgtttgtttgacatgttaaccaacaagaaccttatctcatggaccatcatgatagctggatatggcatgcatggtcgcggtagagatgccattgccctctttgagcagatgaagggaagtggcattcagcctgatgccggttctttcagtgccattctgtatgcttgtagccattcaggcctaagagatgagggatggagattcttcaatgcaatgcggaatgagcacagaatagagcctaaactgaagcactacgcctgcatggtcgatctactatgccacactgggaatctgaaggaagcttatgagttcatagagacaatgccgatcgaaccggattcgagcatctgggtctcattgcttcgtggatgtcgaattcacaggaatgtcaagcttgcagagaaggtagcagagatggtctttgagctggaacctgagaacacagggtactatgttcttcttgccaacatctatgctgaagctgagagatgggaggctgtcaggaagctcaagaacaaggttggtggccgtgggctccgtgagaacactggctgcagctggattgaagtgagaggaaaggcccatatcttcttcgcggaaaaccgaaatcatccacaaggaatgaggattgcagagttcctggatgatgttgccaggaggatgcaggaagaaggccatgatcctaagaaaaaatatgctctgatgggcgctgacgatgctgttcatgatgaggcgctctgtgggcatagttcaaagctcgccgtggcattcggtgttctgaatctgtcacaagggcggccaatccgtgtgaccaagaattcaagagtttgcagccattgccatgaggctgccaagttcatctccaagatgtgtggtagagagataattttgagggattcaaatagatttcaccattttgaagaaggtaggtgttcttgcagaggttattggtgagcaaaaaaaaaaaaaaaaaaacatgtttcattactcaggcatagttttgttcatagtagcgtacatatgtgctacatatagcaccatgtaagcttgaatattgactatgatttactcgttacattacatgaggaagaattgaagatgatgcgctacatcattgtggtattgtctttgtaagaaagaacagctaaaataacacaaaacataaatggatttcgccattagtacaaggaagctggttgcaagcacaaaaacacgctgactcttagagaacatacgttcatttcaccgtattaacaatcttgaactctcacttcacacaactagctgcagagaactaacaatcttgatttctcacgtcacacaacttgctgcagtgggcctagcttcatcattgtcaaaagactagtcaggaccaagctgacactgatggtcgggcacacaattttgtgctaaatgtcctcaagaaattgtcccatcgactggtacagggctgctcttgggcattgataatgccgcacattgtcagtctaaggtagattgtaaactttgaccaccttggatgtgtcacacacaatcaggttatctgaatcagtcggagtagtacacaaccagttcacctgtcaagatgtagatcaaaggttagcaattttacccaatcctaagaattcagtcacatccgttaacagcaaaattactatctagtagtacatcaagtaatggagtattatgtgcagatagatagccaaagtctgcagacaacatttcacagaatttaaggttgagtggctacctttttattaacctttatatccaacaccaattcagcactgttgtttgtttcagaggagaaccctttggaccaatcccataatttaattgatgaatcattgccaccagaaacaagaaacttccccttctcgccaaatgctgaaaatgtactgttaaagtattaagcagttagtaaaagggtaagatatgtaagaaattacagagaaacaacatagtgggacttacacgcaagaaacagatgaagtatgaccacccactgtgtaatcaaggtggatcctgttcccttgactttgactaccacatccatctcctaaatcagttcttttcgagcttaaactcaaatctgccatccgaggaagcccttttgattttgcaggggcaagttcatattctagatcaaccacatcaacagcaccatctcctcttgcaacagcacaaactttgtacgaccctcccaagatgccctcttcagaaactgctattgagtgaacaaaaggaggattgaaacattgcccacctgaacttccattctgcatttcaggtgatcctgacgtccaagagcaaaaaaaaaaaaaagttaatcaatgcatgctggagaaaatttatgcgaaaagaagggaatatacagcattgtggttaatcagcaaaacccaactttcccatttaatcttaaagatgtgaacccattaaagtaaccatacaagattcactaggaattgttagtatatgaccctgtcaaaaggtaaacacatacatagaagttggtgcaatgcatggattgtaagtttttcattcaaggaaaaaggaggtaccataatctatagaaaacagtgttcgccctttggagaaatcccacacagcaagctttgaatcaaggcctccagtaatagctgttagatgaaactgaactaattgtgaggataaaaaaattacaaattaaaataaaagaatccaaggagaatagctagtatttgcatcttacaagttgacaaaagaaaagtataagtcaaacaatgaagcatgaagtagcactgacctgtccaaggtctccaaggaatgaattgtacactgctgcaaatcttataaagataactaagggataactgatttacatgttgcagggaaattaaaaaaaaaatactaggatcataaaaagatgaaacatcagagttaaacatcccagtagcactacataaggatacacttgtgtgggcttccctcaatcttttgtacaggcttttttggatggtgttgataatctgcaaaagcaaaagcagaatttctctaagagtgaaaacatgagcaagttctgacttggaataaccttctattgcaccaaagcaaggtagttcagaaatctatttccaattcaaaaactattattttatctaaatgatacacaagcacacaaaatcagaaaatctcaacaagaaaactttctaacaacaaaccaattaaatgaagcaagtagtgtgaaaatatcaccataaattctctagctatataacttgttaataattgaaaaactagaaaaactgcaacataaatatttacagtcaatgttcatttacttaaatttaatggtaaactgcattgcttacagatttgccaactctttcaacattttcaagtgaagtcctctaagtctaaacagcactaccaatattttgatcacttaatatgttttaagataatagaagcatgcttgtcttcaacatttatgtcaacacaatattttaccttgacatccccactgtcatctgcagcagcaagaaaacctttagagctcacagcaatctgcatcaaatgtggccttttagattctctttttaatccaatcgcatttgcataaaagctttaggtaaaataataagagaacatccataaagtgaaagcatcatttcaggatgaaatagtgatcttttcatagagaatgagatggcaatatactccagggtacctgattgatttcatctctattgtagttataagtgtccaatggctttgcttgaggtccctaataagaaaaaagaatcatggtaaccatattacaagagagaaaccaagttaagcacataataaaaatagggatgctgaacttaccattcgaacatcgaaagataaaatttcatttccagcagaggcatacacaagatcttcatttcctaccaaaagagaggacattttagtgtgtgacattggcacgccccacatatttttgggacaaaactctggagtggtttggacaacggagggcatgctgacctgctttgaaacacacagaagaaattggttgatttgtcgcctccatggtgaaaagcacatccttcgtacgcaaatcaaaccagcaaagacatccatcctaatgtggtcaaataagaagggtcaagaattatgaatcatattctcaaggtagtgcgacacacggttagaattgtaactttgcagaaaaagggaaatgccctaaaagaagaaaacacctactggctgtaagatgatatcagcaaacggatgcacattcaccaagttcatagcaattcataacgttcttgcatgtacctagtgccaattttgtagtttttaccgatcgtatatgaaatcctagatgagatctctacaacatcttcatgctgggaaagttatggtgggacaattggtactgaattagtgaactcaagtgccatcaggaagcagcaaggacaaggtgaaatagggaactggatactaatctatggttatgcaggttgctactttcacaaagttaccagtgcattattgtacacagcagtggaatgattatctcagtttgccgtcagagatgcaagacctctatagatcggccacatgactattgcctactagtgccttatgaaccagctcaaccgcccccgctaacgcacaagcagccatctaaagcctccggcaatgaatttggctgccaatagtcatggctgcagatttctgcatcgcaggggaggaagcatgcgatgcgagcctacaagattgtgccactagctcagcagacagcgcccacgaggtgttcgaccgttgtcctcagcgaagggcacccctctcctcctcctcctgctgctgctgcagcaaggtgtctcccaccagagaggccacgcgttgctccggcagaggaagtcgcaaggccctggatggcgtcgcgcgccttcccctcggaagaaagacccacgcacgagcagaatcgcttacctcgccggaggaggcgacgacgcccgggcgggaggaggaggcgacgcagcaggtgacggcgcccttcttgtgcccccgcagccgcctcggcttccgaccctccgccgccgccgccgatgaatccgtctcggacatggcgtcgcagcgctgaaccccagcgaggccgacacggagccgcagaccgtgcgatcaaaatccgacggtctccgctgctatctcgagccggaactcaactccgacccggacaaacatagtccgactcgtaggccaacgcgtacagggaaaggcggagaccgcgcctataaataaatcaatcaaccaagacccaaagccaaaccgtcccctaattttttcctaaaaaaaaactagcgtaatcctccatccaaatcctcgattttgagatcgatggagcgcaaagacggcgagacgccggtggagaattccgccgtcggcgacgcgaaggaggaggagaaacagcctcggcaggagaagaagccgttcgggatagacgcttacttggagaagtggacggctgcggaacaggaagcggcgaaagccttcttgcgggcgttgatcgcggacgcgcaccagtacatggagatgacggaggaggaggtggtggaggagtaccgacgggcggggaagctgcacaggtatgatccggatacggagtggcagaagcgatatgcccgtgtcgctagggctcaccccccgcctccctgcgtcatggccctcatacctaagttggaacaatacctcaagctcctcgatgaggatgatgaacaagattacctcaagcttcttaatgaggatgatgaataagataaaaaataattgggcttgatgaggatgatgaataagagtagaagtaattgggcagaatgaacaatattagaagtaattgtgcttttttaaggcttattcagttttctcaaatacatttatggtttgttctctttggtttttattaagacaaagacatgttttatttaatcaagttcaaaatcctctatggccacgcgacttctcctcggcctccaccagcctactctggcacacggcgggcgacgcaggcacacttcagccacatgtacactcgcatcggttgcctcagacactacatgcacactcttgtggaggttatcgtctccatactttccatcgcatctcgaccgtcgtcgaccactcatgaacagttctggtctggtcctggggtaggacgggcagtgcgaccgccctggtgccctgagccatgtatatgttgggtagcttgtacaacgaagttgcttgctaattatcacaggcaacagattatgtatctaaagtagtgaaaatactaaagtttttcctcaccacattgcgccacgtcatcaagtaaatactgaccatctgatgaaaggaagatttattccaagccattggatctggatgagtcagagtaaaggaggctcagggtgcgtttggatccaaggctagcaggggcctagcctggcctggcaaggacagtcgtttggaatcagaaaaaaaatcctagcccatgggggcgagctagcccataggagcgagaaaaggctagctcacaagggagagccgaatcggctcgcctccgatggcaagctcctcgcgtgaaaaaagttgttgataaggatgaagcgatttttttcaaaagttgttaccttcttcaacaaccagccccccaatttcgtcctcctcctccactcttcgccaaagaatcaggcttgcagatctcgtcgctctcttcccccactcttggctgaactatagggctcacagatccagtcaatttgcaatcatcctcctccccttgctgaactttcaagcatcctcgattcatctgcagtaatcccgtgcccatatataaatgcagtagagcctccggcctccacgcagtaaatcggagagcaaggccaactcgatttgaggagagcatgttcttgcagaagattgctactggacacaagattgctcgtggtgagaactgagaagctcccaaatttgatttcttccgccgatggtgcctcgtctatctagatttgcaggtacgaggacttttttcttatattaaatctctccatcttcctgccatggatggatgtatacgagctgtctatgttgcttcatgtactatttccacatccagtaatcttgctttgggcctttggtgctggattctgattttgcattaatggagattgtcgatggtatgggcagtagtagctaggaactttctggccgtcggcaccaagcatgatggaagacaacttgtatttaaagaagtctatcatgaggaatgtgcaaagcaaattaatggcaagtatcacacaaacttcacaagtcgacaagtttatcacaagttgaaggctcagtggaaggtgattatggaggcaaagaatttgagcggggccaactttgatgatgttgagaaaaaaaatcctatatgatgagactgaagttgttcgaatgactaatgtgagtgttctaactattctttccttgcaaataactatcgtgtttacatataatatggatgtctatgtttctgacatttttcttgtcatgtgtaggccaaagataaaagggctaaattcattaacgtccccatacgttggtatgatgaaatggagtttatttttcaagacaagcatgcaacaggggaatttaatgttctgcaaacaccatatgaccatccaatgactgaagatgatgattttattggtgataaaaatggcagtcctggtgatgttgacccttcatcaaattatgactcagattgtcttccagatcaagagaataatactggaagtagctcatcttctaggcgtgcaaaaggtagaaaatctgataaaggtaaaagagttagaactgatgataatgtggtttatgagataacaggggctatggataatatgtctgaaaccatgtgtttcacacatatgacacatccaaatgaatccctattcaagataattgatgagatgacggaataccctgtcatggttcgacttgagctgcaaacttatctcgcgacccatgagaatatagctgccatgttgaagggtaggccattagattctattaaggaatatgtggcccaatggataatacaaaactatccagctgctatgtaatttctttgctgagatgtttgaataattactatgcattcaagctaaatagtttaagaatgaaacgtgcactttagatattatttaaataattgatatgctttggttcgaacttgtaataaagtagttcacaaagatgtttgattgtttccaggaattcttttagcatatagctttgccctttttactacttctatccgtattattcttgtggccaagttaactgtggaagaatctgtagtgttcttgtgacaaagccatcagttaaaaaaatttgatctgtgtgcaatattattttgctcaatatgaaaagaagcggcacaaaatactctaaagagcaagatgattcgttgaagcaaccaaacggctagccactaattcttgccatagaaagcacaccaatcaaacaaagggtatatggcgagcctggcaagctggcaacgagttggcttgcccttacccagctaggctagctgggcaatggaaccaaacagaccctcaggctcagtaaaataccactgtcgctcccatctctcagtcaagcaaaggagaggcttcaggaagcttcccccatctccccgtcactcccgtccttgccgctaggcgctagctcccaccggccattcctcccaatctcttctcccaccggccaccgtcaccgctgaatacagtgtcctagcaaaccattgccgacgcaaggagaagtggactcttctagaagcttctgacagaaggatctagagtttttgtcaaattcgatacgtagtacagttcttcaataggagaactatgcaactagcagaagagaattgagaaaattgacgaaaaaaaaacgcaacgcttccttgatcttcaccacaccaactcaccatctccctattgagaccaagtcagtgcaggcagcacaagatagaagccctcgatgcgttgccatgctgctggccgccgaaaactcatctttagaaaagatcgacgaaagggggctaggttgaggagatcactcctcactcctcagtgaagccagcctcatccttcagacattctcctccttttcagcgcaaatccacggtggcaaaggtcgagctacaggctacctatagcagagacgagggggacaagatgcggtcctactcgtggagtcgtggttggtctgtgtatcccagaacccagagtcagatgcaaaagggaaacaatgaagaaatgagtagggacgataacgatgaggactggacgattaatttttattttgactgtaggaaaacgtgtagggctggattggtttgaggtctaaattgatcttactaatttttataattttaataatatttagtgtttatttagtttgaaactaaattttagcatgtcttaaaaaaaaggccatttcaatagttaacttaggttattttgatttcgattcaaatacaactttagcttaccaaaatttggcatgacaaaaattgataaaacctcaaacagcccgtactgcatccatcatcagcatgtcttgtacatatgtgacctgttaaatgcagagaaaaaggctataggcaggatgtgtgttttaatatgcatatgtaaatagtgtagcaagtattcttttaaataatttagttaagtacttatatgcatatgtactaattactccctttattctaaaatgcacttagatatagtgttacctttttacacaatcttttaacattatactttttttagggaaattttaacattatactttaactactactaatttctttcgtttattatcgataactacgaaatcaacgttacataaaaagatttaaatagaaacctgacgacactcccttatcatagtcccttatcatatagtgatataaaaatcaaataaaaatcgacatacatagcactaatcatatactcctatacttttagtccattcattagtcaaatttttaagttttgattttcctcaaaataagaatgccatatatattttagaatagatagagaaacaagttagtatttatttatcatataataatgcactctcttttgtcataaatatatatcttttgtttttttaccgaacctttaaaattttgcccatcaacgagaactcaataacggggcactgttggcctcacccatatatacatatttttacatatctttcgaacgggtcttaaaagagccacgcaacgcgtggcttacgtggctagtagaagctgaaagcatgttaattaactccagccagagatgcatcggaagtccgttacagtccatacttttgcaccactgtccactgcttacgtaaaatcaacaccgtcgaagctgtctcgttaattcctcccgaagcgttgggggaggccgggagggtttggggattgggggtaggggatggatgttttacataaaaacctctacacttatcatgtttacagcgctactctttgaagcggaattttctctttttcacattgtatttcactgaaagacaaggtgttttcaggataaaacatgacgggttgttagtcggtttaaggatctctgtgatattttctataaacacgagtagttttttgcaaaaatagccaaccacgcttattctctctgaggagaaaaaaaattccataaagaaaacgagaaaattcgtatggttagaagagttattgattttagattatgacttcttatgagatgttaatgcgtaattagccaactaggctaagttcgttcccgctagttgggaactaatgtgcagtgcacgtaaaacggactaactcattagcgcataattaattaagtattagctttttaaaaaacacaggattaatatgatttttaaaagcaacttttgtgtaaaatttttttgcaaaaaacacaccgtttaaccgtttgggaagcttgcgcacggaaaacgcgggggagtgagttaggaagttggaggaacgaaaacagccttagagcaggtacaatagcagattgtaaaccagttgtaaacacatatcgaggagataaatgaagagagagaagagcagcgggctacagatttgtagccagctgcaacacaaactgcaagacgcaatgtatatatgacaagtgggactaggtattatactagtgtagtatatgtttataggtaactattgtttaaacttgccattaaatcgattatagattatttggagctagtagttggctataccattaaacttgctcttagtatcactacaacataatctttatgtcttatttactccatttgtagcattgcacaatttgcgctaatattcaacagaaggcgtgttttttttatttttaggagccatatcatctattatatactttgatgaattatttttatgctactacagtttactgttcaatcagcaattttattgtctaaaatagctcatgtttaatgatgtgttaatgttaatctttcatttctatttggaaacaaaacttttttctattatatatgtgctaacagtgtagtgcctctttttttttttaacttgcctggcccctgttgacgaaaaaatcgaacacaccggcttgggagatctgcttagctccagtgcaggtccaaatatgatgacatacaggcgtgccagtcagtttgatcctgcaactgacaagatatgtaaacaatagatcaaatagccgatcggctaacaagccgatggagtagttccagccgatagccgataatagacgatgccgatacctgccgatagcgatagggtttaatcaatcggctatatgtccaatgcagataatgatataaaggcaatcggctgatgatgatgtaacaaaataacaatataatccagtataaaccaatcggctaataatgatatgatagataagcatcgatctgaaggttaaatcatacatcggctggaatgaaatccacaagattagattaaacagtaaaacctttgttgtcatcggctaatccaacttatatgtatatgcaatccttatgagcagatgcaacgtccagataactcaccggctgaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatatagcaacgcgatttagccgataccggcagaaaccctaaaacgagaagcagccgatagagctaaattgatatgctaaaactagattaacagagacatatgataaatatgtaggcaaatatattatctaaaccagagcaatccaagaggtcgaatgtactgatgcagccttgaatgacgccgacgtaaacgatacaattgcctgggccgacagaacattggacttaccccttcgccggagatcgaacaccgatgcagccccgcgtcaggtgccaagtcccgccggacgataacataaagtagaaaaggtaaaaggtggcgatgcgccgaattgtattgatcatgagattaattacatagaccccgggtgtacatatttatacccatgggttgatacaagtccttgttggacaagaaagaaactttcctatagataaaagaaaaagataaagtccttataggacactaaacacactttcctaaagataaaaggaaactaacaaactattcctaataaatagataacttgccatgccgcatcctctttgaactcggtctcttccggataagcttcctttagtagatcaatttccttaaccgaatatagcaagaatccgacaactgacgacttgacaactctcatcggctaatctcaggacttcgaagctgatgctgactataagccggtgactactccgggcttaccaaatttcactgttaacagcccctaagattataaaacgattgatcttgtcagtgaaaatcgatcttttgctagcataataaagctgtgtttagttcccttcaaacttccaatttttccttcacatcaaatgtttggacacatgtatgtgccattaaatgtaaattgcgagacgaatctgttgatcctaattacgccatgatttgacaatgtggtgctacagtaaacatttgctaatgatggattaattaggcttaatagattcgtctcgcagtttataggcggaatcttaatttgttttgttattagtctacatttaatacttcaaatgtgtgcccttatacgtcaaaaatttagtgccaaaacaactaaacacggcctaatacataaagccgcatacacatgcactagtatgatttgctgctgattttacttgtacatgtcatataaagcttgagtttcattgtggtttataatactcaagtaatcgaggaaaaacaaaacaaaaggtacaagaatcgaccaacaggacaggtaaactcaacgtactaagcagaacaaaacctgagctcgtttttattaaaaacaagaagaaacataacattatgatagaaataaactaaaaacatgcaaatttaaaaatcttgttcatcctcctcgtctagatacttaaagtattctttcatccggggcttacgggcaatgagggaatcaggcgaggggtgagccactgagccctggcgattgtccgggtcatacttgtgcagcttatgctacctttgcaagtggtgactattaagctttacaaacactgatctactgaaaatttctacttcagcaggagacaccacttgcaaatgaaacggtaatcccagttcagagtcaccgcatgaagcttgtagtactcgtagatcactctcagatgattccattaagaatgagattaatgacataatatatacgcgacccatttggctactcttcatcattatctaaaaaaaaatttggctactcttcatacagcattttttagacaaacgactgttacttttcacactgtttcgcaccgctagcattcgctccatccaatcgatgatatctcctcgtgctcaggctcgaagcctcaaatcatcgtgcctcgatgaggcctcgttgcatgtagaaaaagaaagaagggcgcgacataggaagtctcaagtgacaagcgggacgcgaagcctcgccttcccctggaagaaagacccaagcacgggcagagatcgaatcgcttacctcgccggaggaggcgacgtagcaggcgacggcttccgaccctccgccgccgccgccgccgatgaatccgtgtcggacatggcgtgcagcgccgaaccccagcgttgagccgcgcggagggtctccgctgctatctcgcgtaaccggaactcaactccgacccggaaaaacgaacagttggagtccgagacgtaggcgaacgcgtacgaactataaatctaccaagaagaagaagacccaagccacacgtaccgtatctgcggatttccagcggaaagcaaccagattaaactcgatcgggatggagaaggaagaagtggagcctgcgcgggagaagaagtggaggccgtcttcggccgcggagcgagcagcggggcaggccttcctccaggcggcggtggcggacgccttgcggtacacgaagatgacgtggcaggatatggtggaggagtaccggcgggcagggaagctgcacaagtatgatccgggcaaggagtggcagattcgttacgcgcgtgtcgccagggctcaccccccgcccgcttccctcctggctttgtgtgcctgagatacaacaatacctcaaattcctcgacgaccttgaagaggaggacgatcatg

SEQ ID NO: 58934 - DNA, 29290 bp, Oryza sativa
acctcctccccccatccctccccctcctcctcctcctcccgtcgccataccaacccaaacccccaccttctcacctcgccgcccgcctcgcccttgctctcgccgccgcggagaggaggagagaagcgtgaagcgagaagagatcacgcggaggcggaggcggaggagggggaggaggttgtgggtgggtagtggaggccgcagtggcgtgagctttgacaaagcaccgggggttgcctcgccaccgtattacccctcgatctccgcttatttacgcgcatgccaccaccgcggcgccgcgtctgctctaaccccgccaggggtagtctcgtcatttcgcaccaccaccccacaccactagccactagggtgtgcgtggggggcaccccccacgaagcgtgtctctctccctccgccggggtgggccccacccccctcggctcggtccacgtcaacgacgctgcacgtgggcacccatgcgcggtgggccccacgagcgggacacgtgaggagcctattgcttttgcgatcaacccacgcctctctgtttttttttcgctcggacgtcgagtactgtgctactgctccgtccagtattttaattttggcgcgtgcgattatttttattttttttcctccttccccacctcggcgtgcgagggtggggtggggccaggatgtcagtgacctccgtgctcgtgctcggcgggttggggtggcgtcgacacgtggtggatcgtggggcccacgtggaggtgacggggaaacgggggtgagggacagcggaacgcggttacggggcggcgtgcggcgtgcacgtgagcgtgggggcccggggcccacccccacccgaccccccgccgcacggagggccggcgattggtccgcgccacgcgcgatgtgggcttttttgccagttgccaccacgtgatccccggcggcccatggcccccacgagccgtgtagtgtaggaggagagacctcaacgaccctgataccctcatactggtggcttctggtctgggcatgtacgatgcaacgggtggtttggatagcatagtgctctctccgtatccaaatacaaatatttttttttaagatagttatagctattaagaaagtagttaaaaatgattataaaaatattgtgatatgttaaccagagaaagtagatgcacaattaaaaggaaaattgttgtgattgattaagagaataacgtaggtaaaaatagcttagtgctcgaacataatatacggggttaattaaagcatgcgtttacatatgcatgggtgacagcttagtggtggccctagttggggtgtcacctactggagagcgacttttcctggcatgagataattaagtgtgtaagcgtcgacggtttacgtggaattattttcgattaagatatagattttctctcgattttcattaacacgctatttaaactgctaaacgctactctttttgtcccataaaatacgaatctaaaatcggatgtgtcacatccggtattaagttgatttttatgggatagagggagtatgttgcaaaaaaattctagatataaatataaaagttgctttagaatataaatgaatttatttttcaagtttatagtaatataaaattaattaatcatgtgctaatatcttcattgaatcattgttttgcgcgccttaactttgtgatcatatcttcatcttcattaggccttattcggtttaaaggggattgaagaggtctcaccgggattaaccgaacaagaccttatagaagaacaccaacataatatagcgtggcagaaaatataagtttttatttatcctagcagcactccagataagttcaagggcaaaagccatctctatttatcgaaatctatgcaaattagcgtgcgattagcgaggccacgtggcgctgcgtggttcgtgtatacgctcttcccgcgaagggctaaaatgtaaaatatgatctagcgaaggagtaaaatgcaaaaaagttagcctctcgtcctctcctgaagggtcgatcgacctcatgcctcttccccttctaatcgatctcatctcgacgcctcccgctcccggtaacggcgccggcgagccaacgacagggatcccagcctacgacgtgacgtgaagcgtgcactggaggacgacgtggagcgcgaccgcgccgaggccgcagacgaggagggcgagcaggacgatggcattggtgttgaacgacacggcgactggaccgccgccgccatggccgttctcggcggtcagcagagcgcgcttatcggtcgtcgccatggccggtagtggtgagcaagctacagtgtaatgtttcttcaatttattttcctgaacgtgtggttgctgatttgtagtgcgaactgtgcattcatggtgttcgatgaaatgaccaagaaagaatatatcttgttctttcttagagttgcatttgatagcacagttaggactattttgttggatagtgtattaattgctctgttgctactatactacttctgcagaaatccaggagaaacacaactagaaattgcagaatttgatgctaagttatgaaactcttatatggattactaatcagttaagttatgtattactgattccatcgtagcagcaatcgaattatacatgagttagagctattagtatatatacagttagcataatttggaacagaaatattaatgcgctagaagaacataatcaggaatggttcttgacaaaactcaagtttgattttttttttctgaataccctttctaataacatttataatcatgaaaataattctgcattgatacatagttttttctttggtctcaatcctgctcagtagtttatttcgagagtacttctcctcctgacaaaagaaaatgatctataaaagtggcgcaatttactaacatttgcatcataattggttagtgtgctcattgcaacttgcaagtgttctattcaagggattgtcctgagtattacttcagaaattttgaagttgcgatcgattgcaactgttcatgatgaccacattcttaagttaatacatcatgagcttgttatatttctatccacattctctatatatggaaaaaatatagtgttatctgaacatgtatttttgcgattatctgacaaatatataaagataaaatatttcctaaagagattttttttctctgtatccctctcccccatcctttttgttttgttgggtggatgttgaatgcacccataataagaactaacaatagttttcctttagatctggaactgctgtttcaatctaaaaaaaatagtcatagttttactgccatgtctctgatagcttttgctgctgtgccactaacccaccagaacaatctggcttaaccttgtctcttgctattgatctccttctatagtcagtataggtccaactaatttgtgttcacctccttatatttctagggatatgcaagataccaaagatataaattgttgccacctacaaggtgctcgaaatcatgacctccggatttaaaatatgtgaaagactatggttctaaaaattttttgtgtaactacattgttgtgtttcttctttgtgccgtacctagaagctagaccggaaacgactgtattctttaaaaaaaaaagattgtatacaactgtggtagtatcagacttttttatcttagtgaattcatgtaaatatatatttatctatggttctgtccagtttttgatgattgttcttaaagtgtaatagttacttttttttagcataagtgccatggaagctaatttagcttaacttgttgcatcggttaataacaccattgaatatttcatttaccaaccttttatagacatgaattttggaaactacttagcaagtacacaagggctataatgagcgcgccacttggcgcgctaattttctagtattactgaattcaactccaccaggaaaaacagttcatttcacatgactctggaaaagtttcacggaacaaaattaattcaattcttttagaaaccagtacattttctctttttttcaagtttcaaacaggcagaatgagcttttagacccgaattaattttcccgtgattcgatagaagaggcaacgagaaaacatacttgcgtctttccctcaaaaagaggggaaaaaaaacgtcctacttgcgtacacaaaggatttctccagctgaatactctgccgccttgtcaacatgcacttctaattaatccaaccagccagcttaatagagggctccacttgatgatacaatttttttagaagcttgatggtagattgattacgatcaaaactgaaggattgtggacttttctacacttcttccaggagaataaaaaattacataacctgattctctgctgcatcagtgagatgcatgcatcacgctcctgtgattcaacctttcaaaacgttcaaatagcatgctttctgacatgatcaatcttgcttaactgaagtactactacttgacttattatgtgagagaagttaacaagaagacctatgctattagattactagtggcaggcactaccatgcaagcggcaaaccgggggagagaagaaaagcaatcgctgaccggacaaatgtgaaagaggctccgagtttcagccgaagtttaaaatcaagcaagcagccatcagcacgagacgacgacttgaatactttgatcatcaacacgaggccagaagaatccatcaaaactgaactgtccaagagattagggaaaagaaaccaaaaggaaaaaaaaacagagtagagagtagagcatcacttccgtagaagattcagttctcatcaggcggcaatatggaagggttcacattatcacatagatgaagtgacctaccgacctcgcctcaggagaccagctatcctggattattctacaagagaggtgccatgcagagaagcagtccagttagtctgaagccaaactgttcctctccctgcacaacacaccaaagatcagtgtttccagtcagtctgaaaacgaactcttgatcctgtcgactacatcactacgtgacaatggttgctaaagacccagtgttccatggttggacaagaatacagcacaagaatctccatcatatgaaggagaagaaaagctcgtggctacaaggtaaaggtagaaagtgacggggcattggtctgaaaagggcctccctttttctactgcatcatattttaccaagttagcatgcgctgataggataaggggatccatgccaattggagcttcaggggcacatgaaccatagtgcttcgaatataatatggccaacaaaacctgaaggcagatgcattgccggctaagggcatacattggctgatctttttctaatcacgaaaggaacaggttattaaagaaagagtaagagttagattgagtgataggggtacggtaccttgtccaaactaaatggtttacagctagctaaacaacatcacatggggagtctgactgatgcaagattcctgggtgaaccactgcatcttagcttcagcgcatctgcttctgcggtgcaatcaggttgagttgcttaagtgcaaaaaacaagtaatcagatggtatgtgatacatgtgttggaatgtggaagcgttggtgatgtttaaagaaaaaaggatatcatggtacggcgttatgtaaacttttacgagttcacagcaaaataacaaatcacaggaaacaggaaacaagatatccttatgttttccttgatataaggtcattgaaacaatggcttcataaatatttataaggtcattgaaacagacaatggcttctgaaagcaaaggagcttagaaaaatctatggagtatctctcgtcaagctgacacaagatacttaagagacaaggaacctcataaatatgcagaactgacttaaaggaatcaaataatgtattcaaacagtatgagcttggcagtttacagctatcgtcaattgctactcagtcaggttcacatacccctgcctcaacagaagttacacacaatataaatatgcgaggtcagcgctctaaccttcaggtagtatttgcaaacaaaatatgagcttcatccatttgatccaaataaatttggtcacctctctggcaaaagcaccagaaaaaaaaacatgttataattatgttttagaccttgtcacatagtatcaagtaaataaaatgtacgaaacatgaatgcttgtctacctggtatacttcaagtaccttctacagttacaaatgatctgcttagtaattattggcttaggtttatggtgtccttgacaagcttgcaaatgctagctttcaattcaggagtaaccttgagttgctgaggacatgtatccaggacgaataaagtaagaattctcatagtatctgacaggatcactttatcatgcctagatacttcctggttaacaaactggcatgaatttctcatcttacaagagccgcatatctgaaggaggacaacgagcaaaacgttaacctcaagcatgttttgacagaagtaattctcgcataggattaaattgacaattacatgatacctactttagcttcctggattttaaagaaagctcgtagtctttttgatgcaaaaactgttcttcgctcaacagatggacaaccaaacaacgcaaccttcttcaagtcacttccagataaccatctacagtgcacacacaaggttcagcttcaacagcggagaaattgggtgataaagatagttcttcaatgttattttcaacttatttttttgccttacatactactaccaaagaatattaaaatcaaacataaaagaccaaaggaactgttcaacaaaatatcaagcatggccagctcatgtagcatatgcagggacagggagcatgatcagtgttgttcacaaggatgtattatgcctggaatcactattaatcttgaaacacagcatttcagagcacggaaagttaaatggaagagtttcagataagtaaacggttaattcatgattttttttagtatagttttgtgttcaacctataaaatctgctcaggactgatagctcccccactgtaggtggcaattaaccagtttccaaagtgtaagaggaaaaaaaaaggaatgcagttcattgttagaatccactgcaaaacatacagcagcatcagcacaatgcatacggcataccacaatccagaaagtcaagatttgaaacaaggaagcagaaccaattacatggtaaaactcattgccacaaactaagctcttcatttccaaattgaagaagacctagacattggtaattccccagggtagctgttcacttgttctcttctataaggccacattaccacatcttctcccaggttaacgaaatcagaaacgcaatgaattcacccaccatatccagagtttagaccaaacttgctaccaacatactccctccgttttatattgtaagactttttggacttatctagatgtatccgttgatcactatatatgttttgtatatgtgtccagatttattagcatctatatgaatttaggtaatgctagaaagtcttacattgtgaaatatggaggaagtacattatttgaaactaatgtacgtgtaagaaatgttagtcctatttttatttattgagataattgacggtcgaaatcgatacttaacgaccgtcatacttccactgtcgacatattgttcagagatgcaacagaaaaaaaatacaggcattccgaattaaactcacaaaatctagtgtttcatggtaatttagtggcatccatctgatgtagctaaatcatacaacttatatagagcgcaaagggaacaaagcaatcggagaggcggcactcacttggcgacgacctggtgatcatgaccgaaccgctcggccgcgcccttgacgacgtcgggggacaagacgtgcggcgccaccgacaagtcaggccccgggaggtacccgccgtcgtagaacctccggagcagcgccgccgcctcctccccccacggctgcctcgacctcggcctcggcctcgccctcggcttcctccgctcctgcggtggcccatccccgggctccggccgcggggcgcgaggcttcggagagcttcgaggcgcgaagagggaagagagcgtcccaggccgcgcggcgtcgccgccggcggcggaggagagccggcgagcggcggagagtgccatgggttgagagggttcgggtgacggagacggggaagaaatctggtgtgatctgaaccgtccgatcaaaatccgtatggcctagtttggatgggcctagatcgaagcccatgtacacgaatgggccggtatactgaactccagggcccattcacgtagatgggccggtattttgttactagcctaatgccgtgaagcccatggaacgtgcagtcttcggccctgttcgtttcctctggaaaggatgtattaatttttggatattcgtaccacgtttttcaaaccgctaaacggagtgtttcgtgcgaaaactttttatatgaaatttgttctaaaatatcagattaatccattttttaaatttgtaatagttaaaatttaattaattacatgttattactacatcgttttacgtgaaacatttaaacttcgtcttcattcttaggagattcaaacaccacagaattctcacgaatttgtacacttaggtttctctcatttggttgtgtgtgtttttctttttcaatcactcgaaattcgaaaagactgcactgcacgtgcacccgcaaatgaactctcccaaccctggctcaattgacgaaagcgagtgtactggctcaattgactggtcgacctacgagtcaatggccagttgatacttgatagacatgggtagaccgccctaatcaaaaggtaatctgtggattagtcggttttcaccgattaatcagttaaagtcggtctagtcggctttagtatgtgatttaagtgttgtttggagttcaaaattcttaggaaaatcgattagtatttaacttctaataatttagaaaagctgaaaaacacatcattttacggatttataaccacatcttctaaaaatctagatgaaaaaatagattgtttgtgttatgaaaatagatgcacaacggaaacacaaatttttatatgaaaaattcttgcgggaaaaaactatgggcgccgaccggcaataatcactatagaggagatgattacaaactaagggaatcacaatggaaacgtcaccccttcccgtacggcttacaagagtatatataggggataaaagaaagacacctaatagaaactcctactagaaaacaaatccgaatatattgtggtcccaaaattcagatcacatatttaacagtttgagagagctcttaatgctaggagaagttgcagctaccaaaaactccctcaaacaaccctcgatcaattagatgtgtcattttattttgatccagaaggagtagcgtatctattccgtggaaaatatttttacggctactatattggatcctctaactagttggcctaggtgcctacttactaatcagtgcatcaccgactaagattactccctctattttaaaataaactgattcacgtaggtataaatatgatcgaaaggacatgaacacgaataaaaatgcttggaaagatttgtccgaggcgaagaggtggcgccacatcagactcgaccggggatcagggcaggttcaggaaccggagaagaaataaacagcacattgccctgcaccggctgctacagtgctacttagcattagatgcgccgatcagctgataacaactaaatcaattcaactattcaagcctttaggccctgtttagtttcaaaaacttttcgtaaaaacatcacatcgaatctttgaatacatgtattaagcattaaatatagataaagaaaaaataattgcacagtttgcatgtaaatcgcgagacgaatcttttgaatctaattagtccatgattaaccataagtattacagtaacccacatgtgctaatgatggcttaattaggctcaaaggattcgtctcgtggtttacatgcgagttgtgaaaatagttttttcattcgtgtccgaaaacttcttccaacatctggtcaaacgtctgacgtggcaccaaaaattttcatttcacaaaataaacaggccttaattccttgtgcagaatttctccgggtcgatcgctacagctctcaacaacatgccaaactgcaactttttccgcagattttgacttgaatgagccccagtcgtgcgtcgttttattgctattggatgaaacgcatttatatattagtgatctgatgatatgctcatcctacttttataggcaaaagtgaagttgaatatttggacgtcgacgcataatcttgacgcgaatatgttagttaaaagacagtacgagagctgtgtttattttcggatctataaagtggagataaaatggtgcgaagttgcaactctgttcttcagttcagctgttcccttttgctgtcggtcttatttagtttaagtttagttcttaaaatatctaatttatttctataaccaagtttaatctgttcaataatctaaatcaaataaagttctttctagagaagcattggcaggaaggaacagcaacaagatggactgatacacaccctcctggattccttccaagttccaagagtccaattctccatgcacagttgagcaacacaagccactgcatttttatgtataaattgcatgtatatgttttcagatggctgatgcagaaggagtatgtctccgaggcgccactgcaacagcatgaggttagttggttggttcatctgtggcatttctccttggagtctcttgagagaatataagatacttactccgtatcaaaatatagctatctaatacaagatgtgatattacctaggactatgaatctggacagaacacttcagattcgtattactactccctccgtccaaaaaaaactcaacctaggagggtaggttgagtttttttagacggatgaagtaggtaatgtcacatcttatactaggtaattacattttagaacggagaagtaagtactaagggaggcttggcttggaaggaagagccactctttgcccctgacacagcagatcagacaaaacacgtacatcatttcctgagtgattatctctaattagctcatcataagatagtttaggtactcatcgtttggcttattttctaataagtcaaaacgacttattaggaaataaaaataaatttgtaggtgaaacttttataaatgtgttcttggtgacttaaaagctaatattgaaaaagaaactacgttgaaaatatctcaaaatcaatatcaaaattaagcttaaaaatttaaaatttggctttttctttggctgattagagccttagttggtaatactatatatggttgatgcaatatgaatgagctaagaaatcatcagcagcatatagtgagcatatgtgtcacaaatatataccaacttgtgacatgtagtttagctagtgacccactggaatactggattgtttactgaaacatcatacggatacactgatccctgaacagtaggatatagtatcagatgtgttaggttagcaagtagcgagcgccgttttcctgaagcatttgttgagaaaatgactttcacccctgagagtgttaccacctttaaatctttaatacagtactagctagtagtacgatagatcagcatagagcatagtgggccaataatgcagaagctattttgattgcttgaatacgactaatccataaagccaggacctgagaagtagttagctagcattctaacttccagcaacatccttaacacaagaattcatgtcggtaacatgcatgcatgcatgttgtgatgttggttttcccctgccagttgggacctacaccatcccgttccatagtcaattaaacttttataattttaactatcaacatctttaaaaatatttaatttaaaggcactataacaacatatatagagttgtcttgcaaattactacaatagaaataaatttatatataaaaaaatatagtcaataacgttattttgaagatcgtgttattatctacttcctccgtttcataatgtaagttattctagtattttccacatttatattgatggtaatgaatctagacatatatatctatttagatccattaacattaatatgaatgtggaaatactagaatgacttacattgtgaaacagaaaagtaaaacgtaaaaattcaagaaagtatttaaacctattccttgcgtacgaccaattgcaatcaacccggtatgcatgcgtttcattcattaattcatcaaccctgactggatgatcaggtaatcagctacagtagttaattaagctagcattagagttactccctccaataaaaaaatcttgttgccacattctaatataacgaatatatcacatcttaatataaggttgttttttttaaaaaacggagaaagcaggtaatatcatagacggatttaccatatagccaatggggtttaggatcccaatcaatttttactcgttacttttctcgcaatctttgtacatgcattgaggtgtcactaccaatactcgaaccattcgctcccaatcctctcgatctaatttacaatcaacaacaaatcaggatgggaagcgagaaattgatgcgtcgtcctacactcaccgaaaaattcttgcgcttccatgcagccagccatcaccttcgagaggaggagcagcgtgtctaacgagtggccgccggaggagttgccactcatggatgctagcgaccttggtacttccttccaatactctctgtccgacaacagcagtgtatctcgctgtccactaggtgacgtcgtacgttgtggccgatatctaccgccacattctagtcggctagttcttacttggtgtgcctaaatcctaaaaccccccattagctatcaagttgtgattcgacgtaatcccctccttactcaccaccacgtcacttgatatagctatgagtacaatatgtatgcaccacgtcactcgatatagctacgagtacaatatacatgcactagatgacccgggtcaatttttatcatgtgttcgccctgggtattagcttgccaaacagaaataaatataccctgaaagcaactaggcacagccacctgcaacttgcagaactagaagcttcctctgactctcgatctctgtcgaggaagtttccaaatacgccggcaattaaactcgccgtccgtccggccggcaggcaggcggcggcgacggcgaccgaactccaaatttcaattccggcacggtttcaatatttccatcggatttgaatcgcattccccctcgttttccttttcctacacagtagcatcttagtacattttgtactctagcccctctcgtttgactcgattcccctgttctacggggacgcaccattgtcgcacacgtagggggtagtactaagcactagtttttgacgaggacggtggttaacaagtcagggtccgtctaatagagccgaggccgtacttgctattcctttgcatgatttttgggttaacaagtcagggtctaatagtctttaggctatgttcttcccctcttttttcaactcacttctctcgttttccttgtacacgttttccaatttgttaaacaatatgtttttctaaaagtttatatacgaaaattgcataaaaatcatattgatcccttttttttaaaagaagctaatacttaattaatcacatattaatagattgctctgttttccgtgcgcagcacatgggttcctaacccaggttgccaaacatagcctaatcaattagcatagctctgtttctaattaagataaaccttttacctcggtattttgttgtcacgatatttgaactactacacggtatatttcatataaaaaatttatgtagaagttacttttcaaaatatcagttaaatctatttttaattttataataactagaagttaattagtcgtacattaacgattttctcgttttatgtgttcgtaaaaaaatctttatattcagtgaactcaaacgggaccataatgacgtggcaaaacaatcgaaatgccggctagattcgcgggcactggggcaacgactagcatctcctcctcttcatcctcctcttcctctgcctataaatatgctctgctatctccttctcctgcacgagccaaacacaagaattcagctgtacaacctgatcaatcttacacaagaattcagccatagctagccctgatcgatccaattctgagttcttgaccgacaaccatggcgtccatgaccgccgtcgccgccgtcctgctcctggtcttcttgctgctgacatcgtcggctccgttcttgcaagccaggatgatgccgggagacggcggggagattgttcaggaggccgtgacgatgatgatgggatcctctgccggcgccgccgccgccgccgtcgcaggaagaagaagcacggcgtcgtcctcgccgccggaggaggagatgctgctcccgaggagaccacctctgccgctgtcgccgccggcggcgaccaccggagctcgcagcagcaggatgctcgggtcggtgcccagccccggcgttggccactagcgggacgacgccggctgatctatagttagttaatacagtagattcagagtgtcccttttttttatacatatttgactttctttaaaatatttatgtaaatattattttttagttgttttataaaatatagtttaagtatgatgtatttgtaggaaaaagttaaataggaggaatgatcaaacatgtgtttaaagacgttatttatttaaaaaagagagggagtatatatatatatcttgtgaaactctaaaggttagaaattcgcaagattttatctcaatttttcaattgaacatggtttagcaattacgatatatgtaagagggattagttatgtgtttagatgataatgatgtgtgtgtgtaaatagcaattcaattattccgttggatttctacatcttttttcttctgatgagttgaattacgaatcaattagccgtcgtctttttctattactacatccgtcccaaaataagcgtagccatgagtatccgcgctcaattttaatcatccgtcatatttgaaatttttttataattagcatttttgttgttataggatgataaaacatgaatagtactttactcgtgacttatgtttttaatctttttaaaaaaaaattaaataagacgaacacttaaagttggacgtggaaaaccatgactgcacttattttaggacggagggattattaatgatcgccacctagagtaccagcagaacgaggtgatctgattggctggctgagttgaaaccgtttccctctccatgtgcttggcgccaaaattgtcgcctactctgcttggacttccctgggttgctttggcttgcagcacaacgtacacgtacaaatagatacaatgaacacacatcgttaattatgttgcgtgcattgctctccaatctaattatgtgtttgtactaggtgagctgcaatctcaagctgatttaggtatttatgttagtgttaaatggactcctacatctttcttttttttatataaaaaataacattgtaaaaactgggttacattatccttatgaagaaaaatcattttaatcggttttgttagtcatgtgaaatgcctatacagagatatgtactctattactaggttaatatattttaagactaaaaaagtagtatatgataatagaatagtgccaaataggtcaagacgatcttgggttgttatcgctctaaagcaacatggttgagatagtcttcagtgtagcaacagtacatctaggttagagatattttgtaatacttgttaaataccatactttactacggataaaataaaatatattttccataaaacatgttacctatccatttttcaaatttaatttatatgcaactatccatttagatctaattgtttcttaatattataaagttcatagggtaaattacaaacttacagcaggaagtaagtggctgacagattttgtcactactagtaccacctttttaagtattaaatgagtatacattaggcaaacttaaggcctatttgacacggctctatctccagctccatctctattggagttagagcctaactaaataatttcagctccacctaaaatagaaacgcagctgggtggagcgttctcacaaaatgaactagagagatagagctgagtttaggctgtttcacaactttactccaaatctaactcttgaagctaaatttaggagtcggagctataccaaacggagactcttatttcctctattcatgcagaaagtgaggccttgtttagttccaaaaacgtcacattgaatctttggatatatgcatggagcattaaacgtagataaaaagaaaaactaattgcacagtttgtatggaaatcgcgagacgaatcttttgagcctaattaatccatgattagtcataagtgctacagtacccacatgtgctaatgacggattaattaggcttaataaattcgtctcgcagtttccaggcgaattatgaaattagttttttcattcgtgttcataaccccttccgacatccggtcaaacgtccgatgtaacacaaaaaaaaaaaatttcgcgaactaaactaggcctgaatttgctcctaggcctaggaaattacctagtgaggggttcaagtcgtgcttactcacaggcctaggaaattaccaatgagcggtaccactcagtacaaaacaatattagcccttgggtggatggttcaaatttagtactacatccactcaaggataataaaatctcattccaaacaggaccaaattatccctcaaaaaaggtgtaaaattaaaattatctattttcgaatgattgttacaactgttttacttaatttgaccacaaattacttttagatgattatattataatgaataaaagttttatagttaatttttttcatgctacatatttcagtagtataatatattttcaagtatttatttaaaaaagagagagaaaaatggtactccctccgtcccaaaaaaagaccaatcctagcaatgtatctggacatgcttgctaggattggtcttttttttgggacggagggagtaaatgtttaatcatgaatatagtgtcattaattgtcaatatttcaataataagtggagtagtacgtcgaattagacaaaccatagtagcagcatttctgtgaaacccaagtacattaattaggcatactggcataagaacatttattcagctggcctgacactgttgaagataatgacgtacgggatgtgataagtgataactgataacactactgccgggcatgaaacctaaaaaaagaagaatcttaccgtagacttctacataagccaaaattagcatcagtcaagtcgaaaccgaaccaataattggcaccaacataaacctcatcgccatcccctcgaggagttcgggtgagaagtacacccttcgtttttgccgttgattttttaaaatatactagcaatgacgtccgtgcattgcaacggattaaggtaattttaatcatgcatactgttggacaaaaataataataatgaaataaaattgcagtgacctttggtcaaaaagataaaaaaaaatataattaattatcctttaattccattagataaaaataatttaatatgaagtaggaaaagttttaaaaagcttaaatagagcaaactaattctgtaaattaaaacaatttttttgacattgaaaaatgtccgtgcattgaaaaaaatataataaatatagaaatattatatgataaaggtttagttttatatgatatagcccaatagtatggatgtcatgggaacagaatcggggcaacttaagggacataaagtgaacttattccgtgtgggcagcttgggaatggcgttcggcttgacgcaggagaagccgtagctatacgatatgatggacagttctgattgattccgacctatataaaagttcaacagcccaaaccctaaccctaaaatcatttcccctcccccccactctctctcaacggtggcagcggcgcctctccccctcccctccccccaccagcgcgccgctctatctccccctcttcccttccggcaggagatggatgcgggaggcaggggtggcgccctcccttctagtgggaggccaccggcagtgccgctctatctccccctcttcccttccggcgggagatggaggcggcaggcaggggcagacagatccaactttatctttttctcttctcccttatctatttttctctctcccgcagccacacaccacttctcttgttatctctttctcctatctcccacaaccgatctctcctacatccacacgcgagcagcgcagtgcgagtgcgagcggcagcaatggcggtggtggccccaactggcgagcagagacatcagcctcgtcgagcagcaggagaggcgatggcctcaccacagcgagtagtgacctcggcctcgtcgggcggcgggagaggtgatggcgtcggtacaggtggcgatgaccccgatgtgcagcggccttggccttggcaggtagcgggagcggtggcgtccttagcctcggcctcgggcaagcaacggcaacatatgtgacctcaacatgttgtggatttgagaagttagtttttcttttttggacagggacattaataattcacatctttccggtttgattcaatttttagataggatgattttgttgacctaggcatcgatctagcatgttctgctgtattgatttaggcatcaatatatgatttggatagagcatgctcgaattgagcttcttccgattttgtgaaacagatcgaagcgtaggaaacgctggcggtgcagttctgtcgacgtttggctgggttttagatttgtgtcatttttttctcactcgaacaccctgtggctaaaaaaaccggcacctatagcagtttataagtgacggtttatgaaaaaaattgcttatattatataatagatgatagatgatgccgttgacttttagacatatgtttgatcatttttcttatacaaaaattttatgcaaatacataagatataaatcgtgattaaaatacttttagtgataaaacaactcaaaacaacataaattaaatgatagttacatattttttttaataagacgaatgattaaacatgtgcccaaaagtaaatgacatgatctaattaaaaaagatgtgaagcagtgaaggcggcggtccacttctccgcgcggcggcagcgcacgaacagcggtgacggcgccccgcgggtggatccggtagcggcggctccctccgcccctctcttctccctccggcagcggtggtcgcgtcggcggcggccacggatggaaggcgtggcagcggccgcagatggatggcgtggcgacgaccgacggcggcggtggcagtggccgagggccgcggtggcaatggccgagggcggatccggcggaagtccctccgccgcctctcttctcccaccaagagcagtggtggcgtcggcggtggccgcagatggatggcgtggtgacgaccgacggcggcggtggcaacggctgagggcccacggtggtgatggccgaaggcggatccggtggaaggcaagagaagttttgtgatgtagttttgaagttttgtgatgtagatttgctgttcttctttaacaattattttgtgattttgtgatgattgtgatttggttgtgccaattttgggaagattttgtgataattgtggtcgatattttggggagctaagagtgatttggttgtgccggttttgggaagtctgagagcaattgggattcgggggtgggggcgaagacacgatcgtccgtgctgtgacgaacgggaaaatacgattctttatattagttaagatttaaccatttatcttataaaaaaaatatataattattatttattttattataacttgatttatcatcaaatttctttaaatatgatttaaaaaaaatttatatgcaaaaaattttgaataagataaatggttatatgttgatagaaagtcaacaacgtcatatattaaaaaataggtaatatatacgtagaatcagaattaattaacatcacaggctcacggctccaactttaaatggccaatcaagaatggataaacatggtaattaagtagcaaagtaaactagctctaatacagcagataattaaagttgtcgttcccagtaatgcacggcacgttggaaaaattccatgcaactactggctttcctgccgggtctcccaggagttgtccatgtcaaaattttgacacaattcacgaccgattcgacgccagcagccacccaatttgggggggttatacgcgttacgtgagtgcgttctgtgcgtaaacccttttggcattttgcacttttgatcgatccccacagcacgtacaggatattaatgcaataatgctgatcagctcaagttcttttgtgatgacgctgccactgccatcgctggagtggagcgtgtgcaggcaaaatgtttcaatagaaagtctgtctcgtgaagttataataattgtatgcggtcgtttggttccgagacacctacccgtctagaaacaaaaagacaccatgcctgcgaaaatggtttttctaatagagcaatgtcttagaatgatgccatatcttagatattgataaaacccattggttaatatagatctagcatttacagtttctccttttttttaaaaaaaaagttgaaatggcgtgtgtccataaatatgatcattagatatatagtagtattgacgaaccattgagtttcatgatgagatgtatcctttgcgttttgctaaagaatatgcttgcactattttaatagagagtctatctaatacaattatactatcgtgtagttggttttatgcccacaatatgagatactgagatgtgacgctcatatatctcgctaacagagttataatgaatgtcatatctttgatatcgacaaaacctatcagttaatgtaaacttgttttatcctgaaaaaaaataaacttatgttttacaataaaaggtgaaatgacatgtgtgcataaatgttggcattaggtagtcataatggtgggccataatctaagtatctcttatagatctcatgctaactgatataatcacatatgtttcatgtaatttccccatgatttacatcaaaaatcaagtctttcttgaaggaattgacatagtttcaagtaggtttcattaagatttaatgatccggttacctaaaattaatctgggctcaactttgctatgatgaacacagcaaggcaaaataaaccagcagcatcttcccgtgatgttcaatagaaacaaacttgcttgacatggcctacccactgcagaccatatatgtactagacactagtgcatagaggtccacaagatattttcattatctccatcatatctagttaggtcttttcaacaccagcaacaaagatgctgccttcagaaagatgaggaaagagatgaaagcacttttttgatatggtctcaatcaaactactttctttcaactctcatggtaaaatagacaaaattgaaatatttagctggtacagataatagagtataatgccaacaaggtcttactctagacgccccttcttgaagtcaactctatgggccctagatagttatgcttggacttttggataggataatatcagtgtggattgtggaaacaagcatgcacattgagagtttgagatgccctgcttaagtgtgtgtgtgtgtgtgtgtgggtttttttttttttgggggggggacatgtgttgacttactttaggttgtgaagtggtatggatcatataatgcatagtggtgcatgcaaatccataatgtagaaatggtatgggtcattttacgtgtgtccatcgatcgactctagttatgctcaaccaacactactacaaattaatttggtctttgcatacgcccacctttatttttacaaacgtactaaaaatatatatatataataagccaggggatgtccaataaaggcctgtctatggaaatagtttgttctcacagacatgcatgttaagaagaacaattgcgaaagtgaagacctggctccatccttttccttctcccttcattttcgctgcaccccgcatttcttctccatcacttctctttttcttccacatctcctccttcctctctctcccccatcacttctccttccccaacccttccttcccctctcctttctcctcgaatccaccagcggccgacaacgagagtgaccatcgcgtgccttggctcctcctcctccatcgtcggtagccttgtgacaaccagattcagcagaggcagtgatgagagcatccactgctcgcctcggctcctctacctttggtggcctcacaacggtagaggcggagatggaagcggacaccatgcgcctcagctcctccatcgctagcagccttgtgtaggccagctctagtggcgcatctagcgtaggggaggtaggggatcaaggctagggtttctaggtttcctttttttttttgccaaatatcttttgtaggccagcctacgaaaaaacgattttgcacgcggttgaggtgccgacttgtgataatcaacatttttatgtggcaccaggtaggcactccatctacaagcaaataccgaatttgatagtttgggggaaagcctttatgcaattgatcgtaaaaacattatatatatatatatatatatatatatatatatatatatatatatttgagcgaaaatttttaactaaagttgatcaacggctatctacataacggttagtttgtacaagtgtacgtgatacaagtataccagatcgagttaattatctttatgcttcaaaaaaaatgtcttttttaaatgaagcgcctgtgttaattatcacaaggctttttttctagacttgatatttatgtccattaattttagagatacacgaacatacgcttatacacattcagtggatctccggcaaagtgccaatgctgcagggttcggtggatctcctctactctacttgtagtacttgcctaggtcaatgcaactgatcgaagtgccacattaaagcatagtactactatataaaaaagagattgaacatatgaaaacacacacaaaagtttgagaaaaagacccttgattttgattccggtcaggccatcgtccaacaactataacaaaacaaaacgcgtttgtaattcgttccttcgttgaattcccgcgatgcaacgcaagctggcggcatgtctcgcggcgggccgacagcacgcgcgccaccacccacttgcgctcccgtgggcctactcttggcccatctatccaacaacggcgacgctcccgcccaactgggccgaatccctggggcccacaccgccaccccgcccgcgtgcgccgcccctgggcccactcctcggtgaccggggcccaccgatcacacggaccacggcaacgacgcgccaagttgccgtcgcacgcgcgcgcggtggcggcggcggtgtagctcaacgacggcggcggcgacggcgacggcgagcacggagtagttaaagcatttaaacattgcttacacagaatcgatggatgtatcatgtattattatcattcggattataatttaatcatacggttatgtacaagctcgatcgattgatgatgatcgcgcgaacgctagctagctagctaagctagctgtggccgccgtcgctggggccggacggcggcagcggcggccttcccgtcttggcaacggcgacaaactggccacccgtcgacgacaccggcaccgccgccgccgccgccgatggggacgacgacgacgacgcagctgccaccgccgcggccgccgccgccgtcctagaagcagagtaatgctgctcgctccgcctcacgcccgccgtcgccgccgtggaggcgacggtgagcgccatgaagacgagcactagcaccgatgctgccgcaatcgccagcgtcgcaagaacacgcgccgtcgtcgtcatggttgagacgccgagaagaagatcgactcgatcggcggcttaatttctctcgatccaggcaagtattaatatatattgttcatatgtgttcatgcacggatcgatttgatttgattacgaaaaggggcgacgcgtgattgcatgccccggtgtacgtatgtaacacatgcatgatgggattcaggattaggttttcaaatcgcagaggcgaagtcccggataatcttgagaattgcaaattgcttgcgttggcgtcaagttacaactttgcctttattggatcgaagcccatgtttgtgttggaaaatcattccacaatgagacagactggatagatagggaatcgaattcaaggtatctttttgaatataggagttttatggcatttatgttgcgtttgtttctcacttttcccatcatttattttctcggtttaaatgcacacgctcctcaaactataaaacaatgtgtttttaaaaataattctataaaaaagttgtttaaaaaagagtaaatttcataaaactatatatactttgcacaatctttcacaaaactacagatttaagaatttatttcacaaattataaattcactggcttcatttatcacaaattaaactacaggtactttgcataatatatcacaaaactacagatttaagaacttgttttcaaaactacatatttaatatctccatttatcctagaactataagacactaaatctgtagttttgtgataaataaagacactaaacaagttctaattagtgttttaacatccgatgtattttagtccctagatccaaacaggccttaggctgtgttcgctcctcctggatgggaacactccccctccatcacggaaaacggagcagtccattagcgcgtgattaattaagtattagctatttgttttttcaaaagtggatcaatatgatttttttaaacaactttcgtatagaaattttttacaaaaaaacacactgtttagtagtttgaaaagcatgcgcgcgaaaaacgagatagaggggttgggaacatgggatgcaaacacagccttagtttagttgctgcatgtggcgaaagaaacaggagtagggcagaaaagccatactcctgatctgaaatatttcctaaaattgcactttaaaactttaaaaatagaagataaagataaaaccatgtaaattactaacttcgacctaaaataaaccaaaaattgcagagagtaattaaacctaaaataaatttattttaagatgaatgtggtactatatttgggaagccagagagtatacgtgacatttcagtatacaatgtacataataatatacactgtacataagtattatagatccagacagtgaaagaaaagattgtactggtactccacagcatatttgtctgcgttagtagcccacttgacagtgtcatctgttatcaaatgtcattcttggaaggggcccatggaccatggccgaaagacgacatgtacggcactggaatatttgacctttagctccggtttgccacgtgacatgtttgacatttcctgtctcgtggcatgacactggaattaatatgcacgcacgaacctgtgattatttgtgatttgcctgcctccttgtgtgctcctcctgcctgcaaccaacatgtgctcgaaataatggaattggatgatttggttggatggcaggggcttaagggaaattatcttaggacagtcaaacatttttgggacgtactgaattttgatttttcgttccaagaactgtcgatgaactacctgaagtaacctaacaaaagtacgattttggttgcaaattatttgagaaaacgcacagtttacaaatgtatttcctatagtacaaaagatggaatgttggaggaaaaacatacttcaaccgtcctaaaatgtagctacctagtacaggatggaacattatctagtactacgaatctggacaggtcctgtactatgtagctacattttgggacggaggaagtagtaattttagagaatttcaatcctataggaaaattttctatgaagccatttgaaacaaaggattaaatcatatccaatcctttgaaatttctatggaatggacgatcctatagagattttagagaaaatttagcgagaacttcaacctcttggtaacttttctctgagtcactctctcatccaaattctgcgtttttcctacggttcaatctaacggtcattcctatgttttttctgcgttttgcaatcctctattttacacttatattcctatcaaaattctacgtttttcctatttttatgttttctcaatcttacgattcaaagggacccttaatgtgtgattcttcatagttttaccagcaaaaaaaaaagggtagtttcacaaatttacctagcgatgatttgtttttttctaccaatagacaatgtaaattttagctgaatttgcagggataattctcaaccaagttagtactacttgctgtactaaagcctacagcctattgcatgccgcccaaagttgtgaaacaagactccaaagaatgacacagttcaggcccctttcattcgcaggattgagaaaacgtaggaatagaaaaaatgtaggattttaatagaaatataagtgtaaaacagaggattgcaaaacgcaggaaaaatacaggaatggccgtttgattgaaccgcaggaaaaacgtaggaattgaatgagagagatagactcaagggaaatttatcaagaggttgaagctcttgctaaatttcctccaaaatctctataggattgtccattccataggaattttaaaggattagataggatccaatcttttgttttaaagggcttcataggaaattttcctataagattaaaatcctctaaaattcatatgtttttcctccaattcaaacgggccctcaagaatgtacgatgaccccattggctagcccctatatattcaggcgatagcccatgggccaaaatgcagagatgcgacccgtttgattaaggcctaaagatgacggtcaaaacaacagttgggacattctcataaaggagtaaagttcagctaaaaaattagggaataaagtcccccactccacttggattataaggcctaagtgtgtgattattttcacgttcaacatctcgatcctttttctgttgctgcttagtgcaaattagctgtgtatcatgctcccaaaccaaagctagcaccagttatcattgtcttaacaaataagaaagaaaagcaaaaggagaaaaaaaattagttgaaaatacgacctcactttcttacacacaaaaaaggaaaagaggttgtacttgtacacgaggtgctataatgatgcaacagaaaaaaaaagtaatggatcaacacgaacagctcagctatgctgatgatcctcatttatatttgacactgtcagcaaaactgagctaatccagtagacagcaacactgaaagagtggagaaccgttttgtgcgtgagtatttgacattagccaaagaaagaaaagcttttgatcctcaccttgtcttgttctcataacaaaccaaaccaggcggcttggcttaaagattaaagaagccagcaagattaactagtccatgctgatgccgtcgcccataagcactgcgcataactttagctcttgatcacaaaccaccaaaaggaggcaaccaactgcaaaacagcaaatcacaagttccaacatgccaaagccatcgcaacaaacatccaaaaagtatttattattattgttttgttcctccccagaaacaagaacaccattccagaactaagaccacattgatcagatcaacccccatgatttaatatacaagttaaataagcgcataattggagcaagaatatgctaaccagttagtagtagcagtagttaccacccaacatacatggatgctcatgaactggatctttggttccatcttgtgtagagtacaacccctgcaaaacaagcaagtgacaggagacaatctgatccgagacaagaacactgcaagaacatttctgattgctccaatggatccaaacttaaaatgccatttatattatgatcaccaccactacatcccttaatagatacataaccacccactgatcatcatcaccaacaccgccgccgccgccgcagccggctgccggcgggagacctcgacggccgccccaaaatggacattcctccccctttatcatccgccggacacctgaaacaagacggctttgtcacaacccatcatggccgccgtcccggccgcgacaggtagacccggcattggatcattgtccggccaactctaaaccccggcaccacggtgaacccgacgacgcgttcctcggcggcggcggcggcggcctcgtcggagcgcccgtcgctgacactctccatgtacacttcggagaagcgcgcaccggtgcggacttggaagatggaggcgccgtcctcctcggcgccgccgtcgaacgcgtagaagaggcaatgcagcagccagacgcggcgcgccatctcggcgaagtcggcgaaccacgagctctccgggaagcccggcccggcgctcacgatgccgcgctgctccagcctcccgaagaaggccgtctccatcctcgcgtgcaccagtgacaggtacttggcgcgcaggaacttgccgaacccgccccaccgcgcgttcctcgcgtcgaggaaggcgctcgccggcgccgccttgagctccgtgaactcctcgaagaagcggcggcggtcgtagaactcccgctcgtccaagaagctgaggttgaagtccctccggtggaaattggcgaacatcttcatggcgacgtaggactcgaagacgaacttggtgtccccggcgcggcgcagctggacgcccgggtgcacggcggccgccgcggcggcgagatcccaaccggcggactgcatcgagttgagcattgacttggagaaggagcggatcgactta

SEQ ID NO: 58935 - DNA, 19063 bp, Oryza sativa
  unsure (1)..(19063): unsure at all n locations
tctcttctctctctgtctactatattttggacagagggagtatcttattgtgcactatgcgcttagatatatttgtactactatcacctaggggtgttcatcgacaggaaagattagctatcatgatgaaaaatgaatgctatgctgtctcttaatgaagtagaacaaagaccggggctgatagaatggcatgataaaaccgttttctttctcagtttttttttttgaggagggggggggggcagtaaggattcaagggactaagaaagttcttaagttcaactaacttagtgcccgaaatttcagtggataacttacatctttccaaaccttgctttaaactaccttacgaacagcagttgagaacttgaaatctgggcagcagatgagatttagtaattctgctttttggtgcctacatgttgtaccgtttattttacaactaattgacattgtagtcatgttaggccactgaaatgatcatcagttaattgtttggggtgttctcgacttcttgttataaatgaggccagaggcataatttgcttcagaaaggagtggctagtatcatgttaccagaaactttaaggtccttgcctattagtcttaaattcttttcagagccaatccaccttcccaggttgttcctgcatcgcacatcgcacacattactagaatttctggatgttaagatggtttcacgcttttatttacttcttttatccaggtagttaaatatgaaacattaaaagcatgtcagaaaacttcattctattcgcgtgaaattttgatatggtatatttgtcactgttctaaaacaatacctacaaggccacacacaaggaatgggtgcgcaaccttgtaatgcttaagccgcattagagttccataaagaaatgttcttttgtaattaacagagttccataatttcattaattttcttagttgcacttttttttaagtatatcgatttgccttagttcctaatgatacttttgccatttttcattctcagtttttgttcaaacatttcttttctgttctaaaccgtttctcaacattataggtttccacgttgacgattctgaggttacattgaatgtttgccttggcaagcaattctctggtggtgagttatactttcgtggcatccgttgtgagaatcatgtgaattcagagacacagcatgaggtagatgaacttttatgttttagttgcatttaatatctatttttaaatttcaaacccacctcttttcttctcttctgtgagtgcatttatgtggtgttgaaacttattttgttcagattttttttttgcatgaaacttgtcatttacttgcaacatattctggttaatttgttcacggaagttacacaatacataattgaagatatatatttttttacccttttcaatttcattactcatgttgcaggaaatgttcgattactctcatgttcctggacgagctgtgctccatcgtggtcgtcataggcatggtgcccgaccgacatcatctgggctcagaatcaatcttcttttgtggtgcagaaggtatacaagtcttacagatcttcccatacaattttgattgtcaaagatttcagtgaccttttgtcttgcttgtttaaagcacatactgggcatgtattatagctaccgtttatgcggacatttgaggtttagttcagtgaaatattatgaccatatatatgtatgcatttttttccttaacttatcatgttttattggtgcttgtttcacggaaagttgtgttggtattgcgtagttcatgtcaagggtaagaaacctgaaactacaaaatacacctgatcaaaggcctctcatgagtgctgtggaatcaaggtagttagtggaatctttactgatttaagattttgctgttacagcttgcaaaagttacggagtcctattgttttgaagggattagctatttccaacatggttgtagtctcaacgaagacattcctcatagtcaaatgttgacaatagttcctggaaatcaatttgtagattgattactgataagacagctcaagcgagtctagcctgagatataaaaccacactagccaataaaaaaggtagccaaacaaaactagggagttttcatccaggcgaacaagtagaaagagcttacttggtagtggggagctctttctgcattatctgttttagcagctcttatttctattgagtgctcaactagctcttaaacattaaaaaggatacttatccagaaaggtcagttgccccttacttttactgacagaacataacaaccactgatgattttattttattttagtatttttcaccaaataatactaaagataatgttcttcacctagcataacttcctcatgaaacttttaacttaatactccatctggttgcaaaaacatgtttcggacatctctcaattcaaactttgaaaattttaaacatcaatatcattttaattatttaaaaaggatgcaggcaaaccatatgtatatattttgttgggctttacagatgtcttagttgtagaagttgtattatgaagatcatgttggtgtccaacatgacattttttttatggtagaggtaattattagatttgtagtgtacgtaactctataatagatagtgtaatgttgatttctttagattgtatcacctgtgcactatcatataatgatgatgctaaaaaggttcagattcgcacgcaaatctgttttgtggttaatgatgaagtgatggaaatttggtaaaccataatagacatacgagcatacgactatatgagctgttgtattgtatcattagatcaaaattccaacttatggtatgctttggtgaagtatcaatattttatttctgttcctttttgttttattagaaccgtacttgttctttagcagtgatttgaataaaattgcacacggatgttttttattaggactaagattagataagacatatggggtagtttgaatggagaaaggtggagcaatgttatgttgtttgaataagatgcagccaggcgcaatagtaaaatttcaggaacaaaacaagatgcaaacataggaaaggtttaagaggtcaacataagttgttccatgaaaaacttctctttaacaatgtatcatctccctagctatgtatctgtacgtatgctactttctgtgcaatttagggagggattttagaaagattttgcttccattgacaaatccaaaaactgaacatatatatggaactccataaggttgagttcaaatttgatttttctgtaaacaagatagacatacattttcttctgatgtatgagattccactgtctgtccatcatactgaaagagcctagtgcttaccactcggatagcttaaggttagtaaatcaacgaaacattaatggaactagaagtttgagacaacaaagcattagtgcaaaattacaaatattttgagataatggtcatgattacagatttaagatgctctattgcatatcttaatttgtaacaagtttggtgctaaatatgtagatctgtgatacttcgtgttgaatctgtagttatgtcaaaatatatgtggttttgctaaatttatctttatatttatgtcattcaaatgcaatcccaaaggttattctttctcttgacatccgcaaagagaacttgttactggttactggctactggctactggctactgaaaagattatctttcttgtggctactggctactagcaagctaacttgcagctaaaattaatagttcctgtgcacagctctgtgttcagggagatgaagaaatatcagaaggacttttcgggctggtgtggtgaatgtaaacgtgagaagaagaagaggcagattcatgctgttaaagcagctaagctggtaaattatcatttctccaaaacctgtacagtacatgtcgctgttaactccatgttcaattcttagatgtcttttgttttgttttctggttttttgtttgatcagcgcgtttcttaggggtgctggaggggcacgatttaaattatatttgctttatgtatttacacaatcttgtattatattatactttactgtcatttgggaagcagctagtgtgatcttcagtttttctggtcacaatcattagtggtcacaggtgtatgtaaattgaacttgtgatcaaatcaagctgaaacttagtggaggatcgcatgttagtgtgaaaggagtgctagcagaatagcaactccccccttcaatatcgtctaagcctgatattgtacagataagtgcatctgcatagaatgttctaatctgtcatcaaatttgggtgatgcaaccttttatgcacctgttgccttgttgcttcatttagagcaagtctaactataagcttatatgtgaataagagagaacaagaaaaatgaagtgttaggtctcgagatatgctacaagctaaatgcattagttacataagtgagagaaagaggaaaattagagacaactttattagagacaactttatagctatctagattcattaatatcaatatgaatgtggaaaatgctaaaatgacttacattgtgaaactcaatatgaatgtaggaaatgttagaatgacttacattgtgaaacggagaaagtatatgttagctttaatactacttagttagctctaatattaaacaaacttgctcttagtgatgttctcacagaaacgagagattcgcttaattgtattttttccgaggaggcatttgtggtaaattgtgtttgcctctttacgctcccttctgtaccaatgcttttctagaaattttctattcttgcttttgtattttaacataatagaaaaaatgtattcattcctattttctaacattttcatatttgttctgactatttgcttgctcgagaattgtatacagatactcttgaatcaaacgacatgcctaattgagctccagattgtttaaatagagtaattagaggttatcgtttgcacaagatagtgtctgttgggtgaaacgcacgagcaactatggatttttgcaacaaatacggagatagagaaaaaagagatgtccattcacgtgggcctcactacttttagtttttttttactagtgcgccccactgttcccaaaccgttgccaaaattgctggtgggggtcgtgtgctcgatacctgattttaaagtctaagggtgtattttatatagagtgaaaagttgagggggttaaatgaacttatcactactagaaatgtcttcttttatgccagtttaacttgggaacatatcctatgcgcataagcttcccgtgcacactaagggcctgtttggcacaactctagctttagctccacccctcctggagctggagtttagccaaacagtttcagctccaccaaaactgatagtagagctgggtggagctctctcacaaaatgaactagagttatggagctggatataggtagctccacaactccactccagacccaacttctgaagctaaatttaggagttgaaactataacaaacagaccctaactagcaaatgccataaaaaattctacacaaaattgaacatttactcctattagtattacacatatctaaaagtcttatatttaaattcattatattttagccgtaacaaaaaagtaaaaaatctgacagttttaagggtaaaagtctgtcagaattttgtcttttttattatggctaaaatataatgaatttgaagataaaatttcacatgtaattgtaatactattcgaaatatgtatacaattttttgtagaatttttcgtgacatttgctagttggtgtgtacggagtgtgcatgggaagtttgtgtgtaaaggatatgttcctgtataatttaaacaaacacttggtgagctaatttgggtgattaccggatttgattgacaaaacataactaactggagagggcttaacatcaactgtcatggttagtaacgtcaaaaggacacaaacagctagtttctttcaaacatgcctattttgaacaaagaatttgtggaagaattctatagggattttgaacaagaacaggttgccacggattcgatatgttttgtgaaacacgataagcgcacgggtcaagcctgaaatagatttaactcgtgatggtttgaatgagtgaaataaaagcaggttttagtaaaataagtttaattcaatttttccaaaaaacaaaaccagttctagcttattactctctctgtcctaaattataaagcctgtattttttaatacacggtattcaatgacatattttgattattaatttatttcatattatattattaataactgtaaaaataatatcacataaaaatattttaaaatacgaatctactaatataacatacgtaatattgatattattgtaattaagcgttaaaagttgtacggaaggagtatcgtgttattttagatctcactttttggctgggtggtttaagtgcgcgcatagcataatgaaaccagcttttgtagaaactctggtgtctttgtgataaaaacgcgatttccagtttagagcaaatttgctttcctatccagaagattggtacaataatcaaataataatttatctaaaacaagattaagtgaactataattaacagcacgtgagatctaaacaaccccgtcgagaatcataaaactataaaagcatttacaattttttgcagcctcataatgtttttcgactatatcattcataagacagcatgggtttaaattaatttgatcttttattaattcattcataagatagcaaagcaagtttgaattaccatatggttaccatgtactggcaacatgaaattatacttactacctacgtccgttttaagcatagccatgagtttatgtgtctaactttgatcattcgttttatttaattttttttatgattagtatttttattgttattagaagagaaaatatgaatagtattttatgcgtgacttatgttttttaatgttttcaaaaaaaaataaatatgacgaacaatcaaagttgaacatagaaactcatggttgtgtttaaaatgggacgaatggagtatttagttactgcccttcatatggttgtgtttaaaatgggacgaatggagtatttagttactgcccttcatgtgcaactgaatttaccagtaaaggttattttactagtactgtttagaacatgatgacaattagttcatttgaagacttatttaccttaatttgaggatcatttgttggaactacgcgtggctctgtttattactctatttcgcattataaaacgcgttgggctctcatctcgtttagatttattaacatccaatataaattagatagatatatgaaatatgaatctattcaaaacctaaaatgtcttatactgtgaaacacaacaacgaaacaaaggaagtagattttcttcatgttttatctttaggcgtgtaatgctaacattttaccttttctttttaatttaaacaatgcagataaatggggcgtacccagtgaactctctctttcctagtcagtgagcttatgtgttctccccttctttcattcatgtcatgattctgtgtaaatggatttcagcttgtagcagaattttacaggtatttcactcaaacaagtttacacgcaacgctagtacttggaatttgtttttctttaatggtagctaggatagtaatccgtttgtaatactccctctgtaccatatttctagctatgaatatggattcatagctaaaagttgttgtattttaggacagaatagtaatattcagaaattgcaaaaaccgcacaaggtatgaatgtttcttatattgtttaatctttagtaggtatgcaggctctctgtggagtgaatatgttggatatatttgaattcccttccatgttctaattgcactttggtttttctttgtttggcaggtgttcaatctcactactgctcactaaactgcatggaaaatgattaagccaccaactaaattacattctctatagtctaacaatgggaagaactattagcttttgttcgtgggtttaccatggatatatatatttggatgagttttggctgcacaaatggcaacattctacctgattgttattgtttattgtgaaataaaagataaataagcaataaagatagtgatttattgtttttcaatgggccttgaaaactgtgagggtctcacagtggggcagccatttcagccttgaccattctgtctactttgggcctttttggcaaatgggttagacaaatgattttcctagccatccattatccatcctcatttcattgtaaacctttacccattttcctatcccgatcttactcttcttatcccatatctaaacaaacccttcaagtcaagggttccttaagcatgacacatagggcatgaacgctttccccttagcttgtcggcccatgtgctttctccccccacacgcatagcaattttattaaaagatttcttaattttcattaaatcttatagaaagagatataatttcttctttttttagggattttagggaaaatgaggctcttgtcattttttattctattactgaacataatgggaagacagggttggttattcttcgtctacgaatatccaaattttaactcctaatactccatagatagttcgaattgaatagcagcaataatcaattttagcacgaattgtttggaggggaagtctaccttttttgatgcattcggcacgcgcaatttcttttcccgcgagacggcctgcaatttttacttttactccctttatatccatttttttagttaattcaatgccttttttcattgcctttcggaatgaaactctatttttttaattggaaagctatatattctacaagaatgataggttgtctataagattctttcactttttcgatcccaatattaagtctctggtttacagaattaacttcaaattttagaacaatttattggcacacaacagatttcttgaatagtaatggtattttttttaaatcaacatatttgtaatggcatagatccaattaacccttgattctaacagggtctacccctagtcggtaggggtggtcattcggtctaaatgaaaatttcggtctcggtcttcggtctttcagtcttttcggtctttgaaaagtaaagaccgaatttcagcacaaaaaatgttaggaccgacaaattcggtcaaggtcttttcggtctcggtctcggtcttgatcgaaattcaacaacattttcatatatgcaaagaaataatagaaattttcaacaaaaaaatcacaaaaaaattcgtaagcacttatgagtaaaaactcttattaggttgcatgcatagaagaagtagggatgtgaaaataagagtttaatcctattaaacatagtggattgtagattgcatttagacttttttttttggataattcggtctttttgattcggttaaccgaggagactaaccgaattgatcgaacaaaattcggtctatcactaccgaggaccgaattgatgaccgaatttctcggtctcggtctcggtcttttcggttcggtctttttctgcccacctctactagtcggttggttttgtgtaacatcccgggttatatctatagtcttagttgtcctaatgacttggtcacactagctgatagcggtgttgatcgaaccatgatgctaactaggacttattaatgtattgaattgtagtttctgttttggatttcttggcttatttatgttggtatttcttatgttcacagataaatccgcaaattcacggataccactatagtacttccccttagagtattccaatggtatcgaacaaaattcaatccaaggacaacaactgatgatagattgggtagagataattcctctatcttttaattagctacttaaattaaaggtaaaactctatcgaatgcttcgggcaccggtcctcccctggtctgccaggctgagtccggtcttgagctctatgatgtacccaaacattgagggatacaagggatggacaaggctgtcaccacttgcattctacctcacttttcgtggagcacacaacaaacaaagaaaatttctaacctagacaccacacctatgttattaattactactctaaccttgcgcaataacttcccttctttatctaaagtcctagtactagaacatagtttcacactaagcgatgaaccaacatcgatgagaatatatctcacttaaataaactaactaaagaacataaagaaactcgaatacttaccttatagaaggaagcatccgctgaaatacaattgagagaagaaggccaacagtaccggctttctccagaactccatttgaagaatgccgactttctccggaattcaatttgaagaatgccgacagtccggcactcctccataaaattctcggaggtactccaacagccaacatactaaagtaatgtctaaaagtgagttgcactctattttgttgtgcaagttgaagtgtgtatgaactccttttatagtgtgccaatgacaatcggaactattggaagggcggttattgtgaacaacggaattttgcatcaagatcgaagaataataaaacctagatttatcaaatatataatttccagatgtaggtcaatttacttaaatatttaattgaaacttattattactcgcaaagtagataaactaatattggctatgatagtttaaatcgtaatcattagcaatctaaatttattaatcacaatctagatagatcggacctaactaagacattgtagggaaagtaatgaaggcagcagcttgacctattctgacaaaatctatgtattagccgatacagtagattaaattatgataagcaaataacttatcagctaaaactccgataaaactatattgaatacctatcagtttgagtaaatatagttaatatgttataacctagaagattggactcaaccaagatggttctagattaataacaagtttagtatatttaaacgggtcgatcgatacttttgatagtgtttgatataaaaaccctgactatgattgcaaaaacgatcaaacaaagagtcgaaccttaactagtatgccggacttaactgagaaagtactaattccgctgttacaagcaaagttgacaaaaacttactttcttgccagagattgaaaccgatgcagcctaaactcgaaacaagaactcgtcgaaagtaaaactagggttggtgatgcatcgaaatttgtatattgaactgttgttttacaaagaccctgggtgtacatatttataccaataggctatagaaagtccgactccactacaatcggatcgactcaggactgtacctctaagcaaggaaaatactattacaactccgactcaaacacgactctgatcggttaacctaaaagataaatcttctaagtctgattctaacacgactccatcagcccagaaatctatctataaaaatagaaacttaaaaaccttccttatcacggaagtaatttacaaaaacccagataaacttgccaaccaaatcaactaaaatcatggcgtgaattccatctttgactcggccttaactaacaataattgccaaattttgccgtttacatctgcgaattgttagtataaagagtgaattgcactttatggcaggttttattacccaagttgcaaattggagcagcaatcagcagatcttttcacctttgactaggttttattaccaaacttggcatttttaatcagtggcccatacgtcagcatcaaatagtgttcttcctctcctctcctccctaatcacggccagctacttgtggttgatgaggaagccgagatgagagcggactcaacggatgaaggagatgagaaggatatacgcacaaaaaaaatgttcaagaatgcaggcctccactagtatgccgctgtccatgtattgctgctcgagctcgatttccgttggtgccgtatgcgctctgcttgacctacacattctgccatgccctgcgtatcgtggagcattggagcaagcatagttgatgctttggtgaactggaccggtgaatgcccccaatttgtggaggctatagcgagcgcctactgctcatcgccaaggagcatctcctctgagccatgccctctacctgacgtgaagctcgaggatctcccattttcccagttcccaaaatcaacgtaagaagcgagcacctagctagcagatcattgattggtagtagttgaatcctgcattcctgctcatgctgatatgatgcactgaggatttgaggagccgcatgctgctgccttcatgagctcaccaagtttcctatatggtagagaagaaagtgatgagagagctggagagggaagtggtacaaagtgactcattttacaaacttatctagtccaaagtgaaaatattttcttctccctagtccaagatgcaaccttggtaaacataagtggcccattgtgcaattaactctagtataaattatgacttaggctatgaaaagtgtaagaacaaagcaagaaaagaagataaaactcataaattgttattgttttatttcatcaactatgtttagtattttgtcaataatttgcacaaggcccccgaattcgatgggacaaccctgtagtaaatattgaggtttcaactattgaaacataaaaaagggttgtaagatcaaaagttaaaaatataaaaaatagtcaaatcccaattaaaacattcttgtaacactcatttaacattaaattttaattattgaaacataaaattaacagtaccattccccacctcttgccatagattccatgcttggaaaggatgtgggagagtgtttgcaggctacctcagttttgccactcctgagcacccaccagagtccaattccctccaacctataaaaatttcttggaagcagctatttttttttaataataaaagcttttatacaaggagaaattgcaaatataccactactttcaccctctaactcaaaatagccattaaaaacacgaactgtaaatttgccactggttttggtttaggttgatgcagtttgccactatcgtttgatttagtgcaaataagcagatgaagataattcataaaaaagaaaaaaacatgataagaccgttttgcccttagccagtgttaatcctcactgcccatctctttcgatcagtgctcttcactccaccgtgaagaatcagctcctctctctctaatcccaaatcccctcgtcactttcccctcatcaagagcaaatcaaccaaaaaatgggtcacactggaataggagatgacaatggaggagctcagccgtggggcagtagcggcggtggctggggatggcagcggtaggggtagcaacagcatcatgcggctggggcagtggcggcggtggctggggaacagcggcggcaagggggtggcagcagcatcaggctgcaggggcggcggcggcaagggagtagcagctgccgacggcgaccagcagcagcagcaacacgcgccaggagctgcaaggaaacagcaggagcaccatggaacggtagatactccaccgatctactagaacattcatcaattttcttcttatgttgtaggaatcaatggtccggcttcttgacaattatggttagagttgaatctcatttggccacatcatttttggaggacaaaccaatatgtaagctttttatggcaaatatgatgtcaatcttgcaatttcggggtaggggtatccttgtcctaatttttctgaaaaccaaccttctaacggtgttagtctaatctgtcaatccagtggcaaatatgataggttctaaccgtttttgatggcaaatatgcaattacatcttctataatggtaaattcacaataccggttcaaaccagtggcaaatatgcaattggccctttatacaacccagtcaactacaacaagatcatacaacagttttgagaacactcctagcctttgcacaactaggatgcacataaccaaaacatacaccaaccaatttcgaagaaaacaagtacaagaagcattaaggaccatcaattctagaactagatcgtcacccatgtccctaggtaaaacacacccttatcacatgctccaagcgtagacacgccacaataaccatatcctgtgatgacctgcataggcgaaggaataacttttttgtagaaaccatatgacgtgtttaattgcctccttaatgtgacgaaaacaaaaaatttgattgccttgccaattacgtttagatatattgttcttagttaacacaactccacaacaaagataccgaaggaaaatctttaccttcagaggcacttttagtttccagatgcgtctatttatacctgggatgtcattatggagtagtgcaagggaatgatacttcacaatgaactgtctataagaagtcaagttctatcgaaactcatcttgctcatgaattagatgaatatcggtaatacggtaataagttagtccatgctactaatttgatctaattagatcccttcttcaagaaaaaaaatggaatatccattcgatatgacatctgcaacagtcgcctatttatgcctagcattatttgtagggacactgatactattttcatttatagatatgttccaaccatttatcgtcctgtaaccaaatataagggccatccttaattacaaaggattcgaactgaaaggacatgccttgccaccttcactagggtaaccaaaaaatgtgagtcccctgcttttcattgaactcgcaagcgggttgtgaacataaatacctatgtccatagttaattatgcgcattactcaaaacaacngctatatttttaaatttgggccctaaccgttttgaaccacccccctgaatagctactgttttagtaggttatgtttttaatatccagatcatgaatccctaaaccctctagtcaataggcccgcacaatatgtcccatttgacaagaagatatttctttttatgaccgtcacttcgccaataagacatagatcgaaaatagtcaggctttttttaatccagacaagagaacgtactggttatgaagtcccataaagccttttatccataggcatgggcttgctctacacaatctgatacaacctaaaaggaaatgcattgtaggaagggtgaatagctaatttaatccctcaagtttcaccgaaggctcaatttggtccttcaggtttcattttgtccacatagttcctctaaatatttgttttggcctaaaatcatccttgggcccacttaatatgccatatggctatttttagtcaacaattatgttagaaaatgtcccttttgcccttaattgtatacagctatagactagaaaaaaaaaaccaaaatgaacaaacaacattacatatgtacttcccattatttcaacatgtgcacatgaaaattaagcctaatggctattgtatacacttggaagtacataatttattttatctataaaaagaattcattgcatacaatttttttcatatatatgtgaatggggggcataagtgtcatttatcaggaaagttgttggttatgtgtgttcaaggataacactacaataatctatttaatctatgatgaaaaaaattcgcattnatcactgaaaaatctcacataaatttgctgtgacgattctacttatcgtcatctattgagcgtcacagattaaatctgccgacgttttctccgaaatcgtcacggatcagcacaatctatgacatttttaactgtcataaaacgcttttgggctcatgtagttcagcccatgcccaacttttgtgacaaaattaaacgtcacagatggttgccacgtggcggccaacatggcaggtgacgtggtcattaacacgtgtgatgacgtgtcactgatgacgtggtagataacgtcagcaaatatttttaaacgacctattatttttttaatggcccattattttttttacaggccattaaatttttacattggtccattaattatttcatagtggcccattatttttttagaactggcccattttgttaaccaactattagatcaaagcccactaaacaggcccattaaatttgagcccaccaaattcaatccaatttctcataccatgtcacattcaaacctaataacagataccatagtggtttatcctaggtgagcttattacaattttgtaaaacattagattccccatggagggtagatatcaaccatccccatcctctaatgtgtgaattcaccacgggggatcggtgatcgggtccccattgccatctctaggtccacatggttttacagaaaaaggcagcaaaaagtttgcttcacatgatttttacagtaaactagccaagttctcgatctgggttgaacataaaataatataaatccctacttagatggtgtttgaatcttctgaagatgaagatgaagattaagtgtttcacgcaaaacgagatggtaataacgtgtgattatttgagttatacttattacaaacttgaaaaatggattaatataatattttagaacaactttcatatagaaagttttcgcacgaaacacaccctttagtaatttgaaaagcgtgtcatgaatatccaaaactatatgctctctttacagaggattcaaatggggccttagtgtctcgatctcatagaactacaaaaattagtgaattttttttatttttaaattttttattaaaatatttacaaaactaattttgtgtttgaaaattttacaaaactagtcgcccgctgcccttggggccctcccaaagggccatttttgtgacgtggcgcacgacagttagctcattcctaacggctagctatagggggcctgccattttgcaggcggcccccttgccgtccttagggagggcggttttacactgttcgggggccgcctgcaacagggcgacgagggcggcccccttgccgcccttagggagggcggttttacactgttcggggggccgcctgctaaaggccggcgaggacggcctggaattttgcaggcggcccccttgctgcccttagggagggcgatttttcactgtgctaggggacaagggcagccccaggtgtttagctctgtttatttagaaaatttagtaaatcatcacttaaaaaactgtgaaacaagaaaaacattattacaattgaatggtacgttgttttcgcagtttggagcccaacaaggggtatttttacatcaaaataattaattgttactttataaactacgtaaatcatcgtttcgaaataggaggaatagtttcaaattattcattacataaatctaactattttgcacttaaaattttacaaaataggtgttttacatagacctaattttgtagcacttaaaattaggtaaagtatagttttgaaacgaacaaagtacgtacatttttataaaatttcaataatttaatttttcatatagattggagggcaatgagggggtttgttacctataaattgtaagttacgtataattcttacgtatgttgaatcatgtacacaattgaaggtgaaagttataaaaatataagcagatatttataaattataaggatacaacgtatcgtggcgtcaaagaaactttggaaatcggaacgatagagcccattaatttgtaattcgtgacgcatataacaacacaccataataatgaaacattataatgacaagatagcatggataaaagatacaaatttgtcggtcctgacaaatcgagcctgagcttatctaccgaccccttctgcgctgttcaacatgtattgcattttgatgctccttctcccgttggtattctacctatgtttcagactcagttatcttttggccatcatatgttggattgacattgtcgatccataaagtgaatgtgcacctccttggattgccctaagaaataaacatagttagtcagatatgatagtaataataagcagatgctagttaaatttggaatttgttatacgtacaacgaaatcgtcgtctacattggggcagacaaagtatctcctaccaattgtttgttctgcaaacgaggtagccacctggcagcgatctctacaaccacactttggacactctgaccatttaggtaaacataatggattgttcctccagtctaagcttgcaatttgtacctgacattcgtcaatgagaccgcaccaatgtttcactgcctaaactctctcatcaatgagatcgcccaatgcttcactgcctccttcatatcctccttatgagcatatgtagcaccctcaattaccttgttatccttgtattcgcagggtacatgatgctcctctgagataacaagtcccgagaagtcctcgtttgtccaatcagtgggcattacatcaccttcctcgtcggatgatgcatcaccctccgcttgctcgttatccgaatcttccctctccatttcatcaacgattgtattgtttctctccccctcatccgccacgcccatggcctgctccacccctgtgtcattccctcatcttcccctgatggttcaacaaaatccccctcatggcttggaccctcgacatcttcagtttccattgcaatatttctatcattttcatgcaccgacacaaaaataaccagggccatgacctttcaaaagccatctccagataccgtttccaagcaacagtgctatgcatcgggatgagttcctaaaaataaccttccgttgcacgactcactacaaccgatactgacattgtgtagacttctgagtctattctaaatcctcgcatcaaccaattataaattgactgaaatgatctctcggcaagcctatcgatgcccttcgatgtcattacaaaatctgacagatcaacaccatcaggaccaaatctaaggttgcctt

SEQ ID NO: 58936 - DNA, 1900 bp, Oryza sativa
cagttttatttacgcctaattcgattttttttatccatatatagattattttgacttgaaattgtgaaattactctctacatcatcaaaaaaatcaagttattttgttaactatttgattggtgttgacaggtaggggcaccttttttaatgatttaataccggcaacatcataccctattttataaaatctttgtttatgcataccagctaaattaaggagttgatttttttttctcaaatgagcagaagagctgcgcatcatcatattaaggaaaagagatagcaagtaaaaggtcaacattttacaaagatatgtattcaaataccgtatatcataacttcataagagaacagattaatagaatcaatacaaggccatttatcatgatagacacccaggaaaaaaactcggagaaaacatagtggaaggaagcttccttatatctgacatatgttcaaatgacgcattatagcgcacaaaaatagcaccccgagcaaaaaatagcatcccggcatgctcgatcacatgcttaattcttagctttgtcctagtttctatcctcgttcctctcctgagcgcgagtgtagcacacaatttcggaccgtcttggacgccatctttactgcccccaggcataacggtttgtcttctcaaggataaataggacgaatacactgatattcggttttgggtccaaaagagctccaccgcaatgcaaccaatcccttgtctctccgtcgaggatcagtaatgcttcacgacgattgcatcggtgtaattgtttcgtcaacacagatctttgctcagtttttcttgatgtttctgagcctcttctatgttatcgtcttaaatttttcatgtatcttgtttgtgcgtatgctcattggattgtaactgagatgacgacatgctgctccccaggccaatcagtacatacctgcatacatgatacaatagttattatgaagtctatagtgaaaaaggaacgcacgatgtagaaattttattcaaaagcatcagatcaacatgaaacctttcggatttgggtccgtggcagcagtaccagagatctttttttttctatgacatcctgtgagctgcaatagtcatacatgtgcaaatttattggaatggtctgttgttcctataattctttcttataataaaaaatttcaggtaataaaaggtacttacaggttcattcccatttaattttacaggagggactctcaagccccatagctgctcaaattcttgatttctgcgatgacggcctaggtgatgatcttttcgctgcagtggccactacctccgagcaatttgcagcctctttcgaggatggttcatcgtcgtccacagccacacctcccttttgcagcaacagcaatgacatcacagctgttgcagacacagctttctccccattactctccttcgactccaccctttaagctttcttgagcaagagcaaaaccctgaccaggacaccaagctacttccctccattgatgaaacctttactgcaccagcatactatccagctgccaccgaggccaacatagaacaattcagccaaataatggttccagagcatacagatgcaccaatgcccccaatgcaaacaaacaggactgccaatgccttgctgcctctagcttcagggtatgacgacgagtgtttcacagcagcactagctggagggtacatgggtctggatggaactctgtatgaccaaacaggagtaatgattccaaattgcaatgtggagacaccacaagtaggatttttcaaccataatagtactagtaacaatggtatggtgatggatttgaataattttggagagtaccacaggatgatggaaggtgaaggacttgaccagaacatatagcgacac

SEQ ID NO: 58937 - DNA, 1054 bp, Oryza sativa
attattctcgtcgctccctccgcattgcacgcaccctctaggacctctatgagatgcatgtacacaccttccgttgcattgcaagcatatatgcatctatgccaagccatcacgtatcgcatgtgtagggattagagcataattaattacaccggccgaacccatgcacgcatgctacctaccactgttgatgacataatttgctaatggtgccatccaggatatcactatagagagataatagagatacatgcccatgagcatcttcggatcatcattgacaccaccaatcaatcaaaccgttttgttaactgctggcagcgatagctagcattgatagagtgtgccatcgatcgaccttggccgcgcgtatataagcactcgccgcattcccatgagataactccacacacaaaactgttgcactccactgcgctataaatagctacgtgctgcattcgcgcgcgtgtgcatgcatggcagcaattggtaacatgaatttgttcgacttgttcttcgtcttgcagcttctcctgtcaggagtatgcgtgctcgtcatctgctaccgatatcagcggcttaaatccatgaaaaaatgtagcctatgggttgtccagtggccgatcgtcggcgtgctcccggccatcgtcgccaacatgcaccgcctcctcgacggcgtgaccttcctgctggccacgtcgcagctcaacttccagtgccgcttctggctcgccggcttccggttcttcgtcacctgcgacccggacaacgtgcgccacatcttcacgtccaacttcgacaactaccccaagggcgacgtgttcgccgacatgttcgacgtcctcggcggcggcatcttcaacaccgacggcgagcggtggcggcggcagcggaacaaggcccagatgctcatgaccacgccgcggttccgcgccttcgtggcgcgctccagcctcgacaaggtggagaagggcctcctgcctttcctcgcgcacgtcgccgacgcccggaagacgtgccaccttcaagacgtgttcacgcggtggtcgctcga

SEQ ID NO: 58938 - DNA, 533 bp, Oryza sativa
tgaaatttagtaagcccctaagagaattatcacgtcgccaatagccggattcctgctatattcggttaaggaaattaatatgttaaaaggaatcttatctacaagtgatcgagttcaaggaggatgcggcatggcagtttatctattaattaggcagtatttgttagtttcgttttatctttaggaaagtgtgtttagtgtcctataaggactttatgttctcatttttatcttttaggaaagtttatttcttatcctacgaggactagtatctccacatgggtataaatatgtatatccgtggtcattgtaaaatatatccacgatcaatacaattcggcgcatcgccaccttttaccttttctacctttttatttatcatccggcgggacttagcacctgacgcggggctgcatcggcgttcgatctccggcgaaggggtaagtccaatgttccgttggtccaagcaattgtctcattacgtcggcatcgttcagggctacatcaatacattcgacctcttggattgctcc

SEQ ID NO: 58939 - DNA, 3194 bp, Oryza sativa
  unsure (1)..(3194): unsure at all n locations
aaaccaaacttatgtgcatcacaaggtgtgattttcaacataattgatacaaaataagagtgaaagttgccataatcacaggtcgatttcaaccaaaaggcagtaccattgatgtcagggggatatcttatctattaaacaagaagccaagtacaacatgcaaactgaaacaccaaagttttcataaaaaatgttttcaggtggtatgaaaatggttgctttgttacaccttttgagaaatttaatttaagattgtcctttttgctggtcatttttctgtaacaattttaaatgtatttgatgccaatgataacctcttatgcgatagaccttcaactaaattttaatgtccctaattagattacacgcataaaaagcatagtcataaaaagtgcagtatgtgcctgaggcgcgtacttttccagctaaatccaggatacggcaacagcgggctcagttaaatatcgtttcttgctaccaagtttgataacctcatccacaaaatccttgacaatgggagaaccttcttcatgtgcccactgtcccgagacccgtccagacctaacaattgatccataaccaaataatcgtcccaaaagattgtccttagcttcctacaaaagaaaaatgaaaaaaaatgagtaaacaaattaacatcacaataggcagaaaaaatcagcagtaactaatcatcataattaccggtcccctcattgaagctgaatactctaacaaattaggtatcaacttcatgattgcttcgacgctgattgcatgaattgattcgagcacaactgcaagacccaatgcgaatccttgccttgcaaactgcaaaccaagttcccaagcataagatacgatctaactgtagcggatgaccaatgcaatacacaaagctaaacttcgtcatggaattggaaaagcatctctaacctctctagaagaagagataccgcgaatgagccgccgaatggcgtaacgcaccgacggcgcgcagttctccaggccatcgtccttctcggcctccatcctcgacgacccatctccaccctccgcttcgctctccccctccttccgcccacccttctcgtgcgccacctgcacctgcctgagctccgccacgagcgcctccgccgcggcctccctctgcgacgcctcaggcgaagccaggtccctgaacacgttcatgtgaagcccaggccccgacaccaccggaatcacaggcggaggagccacgggcgccgccgcagccgcagccgcagcctccggcgccacctccgccggctgcttcggcttagcggcagcggcgtccgattcagcggactggcggtgcctctccttgtcaatctccttccgctgcttcttccgctccatggccagcttcttcttcttcgctggcgcctccgcagccggggccgtcttggctgcggcctcctcctcctcggcggcggcggcggcttcgggctcggagagcgcggtcggcggcctcttcttcccggccattgctgcgccccccgcgaatctcaagctcagctcgaggcggcgatggctgcggagtagaagggtttatgccgaggcggcgatggctgcgaagcttggagccaaccaagcctagggtttctcctctccctctctttctcttcttttttttttcttttgtatacgtatagtcgaggaaccagaggcccaagaagcgacccacctatgcggcccaattcagcccatgtgccaggccggcccagttaggcccacatgccgggctagtatagtgatctcgatgacacgtggggtcgggaggttgacacgtgggggtgaggctgacgtctggggcccaccgaataaagcagaggaggggggaagagaaganaagggnaggtgcagcaatggcggacaagccgagccgcgggctggtgctctacgccgcggggcacgcggcgctgctccctccggcgagcgtcgcgtcggcgtannccggagtagaaggggaaggaatccacctcgacgccttcgcgtctctcgcgtcatgtggcttcctctccctccgctcgccccctctcgagagtgggtactactgatccagcgattctctcttctgcgtcgtctctctctgtgattctactcgctgctctgaccgaatggagattttccttgttttggtcgttgtaggtggggaggagaagcgtgacagcacgattcttgagctcgcgcagctgctcgacgtgtacgatgatctcttccctgctaaggtgagatcttgcttccaccggttcgcacttaggagggttgattgtgcgagaatttagagtaggtagtgctgattgtaatttttgcgtgatagactgagaaaactggtcaagagactgcccaggtggatccactgcaactagcagttcccaagctatctgaaggttggatgtgtgtgatttttgctttgttttctgtaacattgttcatgaattaggtctaactagctttcatgtggtatttgtaatgtcaggtttatggggatcagagctgccatggtcaccaattgccccctgttagttcttttgcagcaaatcttggttttcatgtatccgggactgaagatttagttgcacaatctggatcttccgctgcttctaaggaggctggaattatttcccaggcgttaagtctgcttggattttcagaggggaatgttcaggagacatctgaatttgatctggtgtttctgcatgttgccatggagaatacaaacagcaagttgggaaaattgggaatgaagactgatctaaatcggcttgataaattagttggtgcaatcatgaaagcggcgcccataagttcagctatcgcctcccgtattcttgtatctgtgatgttgagctatgggtctgctgctgaaaataaggatgagttttccatctcaaaatcttcgactgaaatagattctgacttgaacttgcttcgcccacgccagagctatactatgaaagcaggaaatacattggatgatgttaggtaggtgttgttctttgctgcaaatgaaatccaaaaagttatttccaagtagagcatgttttgtctgtagtaatcatatttatgttacacataataagaattccattagattttgtctgctatatatgtaaggtgaatagtttcacggtcttccaaatgtaattactgttgatctttcgctgcatataatg

SEQ ID NO: 58940 - DNA, 4920 bp, Oryza sativa
cgtgcatgcgcggcccacaccagaaagtacgtctgacacctccggcgatcgaccaccgggttccgctcgccggcaaagtcgccgttccacgttcccgccgccggcgccgccaccgccggccgtaagttgaatctgcctccgaaattcatcggctcgatctgttttaactgttttagagattatctccattattattgttatttttttccgtttttgtttctgagcatttcttcctcagttcagagctaaccgtgtcacagttactagacaagctgaacgaactcaattttgaatttctagttactcgaggataatctgattaccgagtgataatccacggtatatacatcattatctctccttccgaatcgcatgttagagtagaggatagtgctaattaactagaggatgagataagccgttggacacattcctgcatgcaatgcaaacgcaaagcaagtgtgatccatccatgcgtgaggatcggagtacgtgtttatctgatggaatccgcagattcctccggaatcagcagcgatttctccctccctcccgatgaatcgccgccatactctcctcccctctatataaaccccacccgcgggactacgtcatcatcctgccactctacaaagagcttaattagctagctagtctcttcgatctgcttctctctttggtttccatggcttcttctcgggttgtcgtcgcggtggcgctgctcgtggcggcggtgctcgccgcgttcggtgcgctggcgccggcgtgcgagggcgcgagggtgatgcgcgagggcgccgccgtcgtcggcaagatgtcgagctaccagccgccggtgaggcataagcctcccgtcccgccgtcggggccgtcgcacaggcacaacaagagggcgacagtcccgaggaagaggaagcacttcccgccgtcgggcccgtcgtaccacgatccgcacagctgagctccggcgatcgtcgtgcgcggccatggaaaagacggccggccagtcagcatctctctctgcagtagcttcattaattaattgatttaattagttaggaattataataataatagcaggagagattatctagcttaattggtatttccttcttttgattagtttggtaggttaatttgaggtgtaatgcaggtattgttaattagcatttcgtatagaaatgcgcatgatacatgcatgccatttagtttattttttagatgtttctctacgaattattcattttcttaaataaaagtactttgcttattaattagttattaattgggttaaatctctactatcttaaaaatggagtcgttcttcttccattctctcatcctacatagcacatactaattacacatggaggtgagaaaaacattataggtgctgattttaactgtttcggcacctatagtgttgatctctatatatattttagtagtagtagtgacgttacacggaatactggtaatattataaaaatctcatttacgatttaattatttgccctcgtaatattgaaacactaattcatacgctaattcatgtatctttggagacgatttctgccgaccgttgctactcttaattaaaatgggttttctaattgcatctgaacaaaattcactcagcctcaagattaatttctttagtgaaatgttcacttaaataagggtttattttattttcatcactagcaaaaataatagatgaaacaaattatataacaatccgtgacaaatcttttaaaatgttagaggattaatttttatggaaactgaactaattcttatgaaaatcatataacccaaatatttctttcccaactagcaaaatacccaagctctgctacagataaaatatattatattataatatgtaatagacaaaataaaaatatcaaatatattattatcacttatatgcatgtttgaatatatggtattcacgtgttttaactaaatatttaaactattccataatattagaaaatatcaatggtaaatttgtaaaaagttataaacagtgctggcgtgacagacttttaaatgagcatagatgtgacacgatccaaacatttttttaaaaaaaataaaataaatacacccacaccgccacacgaggtcttgtgcacgtactagcctgcaagctgctatataaatataccacaaggaagcaaagagaactgaggcgcgtctcgcactcttgctcccttctccctcctcgactgatcactgatcgatcgatcgatcgccatggctcctccttgccgccgtccgtacgccgtcgttgtgccagcggtgcgggtcgccgtgcttgtcgtcgtcgtcgtcgtcgtcttgctcgtgctgctctgcggaccatgcgacggcggcgcgaggcacatgctgcaggaggagagtggtggcgcgtgggcgcggcggtcgccggagcccggcgccgccggcgtcctgcaccgccggacgtccgacttcctcccgccgtccggcccgtcggagcggcacaacgctcgcctcgacgccgacgtcgccgagcgcggccagagctcgccgccggcgtcgccctgacgatcgaccatgtgtgcaagctgctcatgaatattaatctactctctcctcttctcttctgattcagtgaaagtttggaaatatatgtgtgaattatttcagatgttttctatcccgagtgtgataattcagctggattctactctgtcatctgtccattgaaagatgtatatatatttgcagagattcagagaccaagaatgtctggctttctgaaacttcaaagatgtttattcttggcagagataagactgtatttggttgatattttgttcatctagcatgcttgcatagttgcatgaaactatggaacatttgttagtttaattctgtcctattaagttgttggcattattgtagacttgctgcacatggtggagtggttgttcagttatgtgatacatattcaagtaagctagatatcagcaggtgactaggtcttccctgtgcatcatctagtcatgctgctctaatgattctatcctgaactagatagatagatttgatatgcttaaatgatgctcaatgatgatgtaactgttgcataatgcatatatacttgcagttgtattagttaaaaaaatgctaaaatgttgtggattaggctctgcatgtagatcgtgttggtgtgtcactggccagagcttgcaacagatttacctgctcccactcaccacttttgcacttcacaccagtatgctgcatgtaacctgtatgcatgcagctagccagttccccccaactgaatgctagaaatgatatgaaattgcacatgcaattctgggataatatggcatgcattgacataatttaccaattaccattgagatctgttgattttgttctgaaacggtaatatggtactaaggtaaaaaagtgccagattgttcatatggcagatagagtcatcacacactgccaggctatgaggaaaatgcatgtacaacaagccgagttgccaaatttggcctcgaattgacaaagacaactcatttctccaagcttgatgcttttggaagatgatcaataggtgatataagctaagagcctagagtatcagctcatagatataggcaaggatccatgatactgatggtataaacagttattggaatttggaattgcatcaagatcatggccggctgaacgctggttactgatgccctaggagagcatcctggtcacattatctgacaactcatagacaacctcttccatgtcctcagagataccattctccttcagagtgaaaaaaaaaaaggcaaagtgaaacagagtaaaacttagtcagacccacaaaaacaaagatacgagggaaaaaatgcactgataatttactcataagatttaccaagtgtcaggctaaaatttaagcactgtcatcatactggcagtaggcaaataccttcgggcctttattccctctaatgatgcacgttgaagcactgatactagcactctttaaatagatcttaggattggagtttagattgattatgccatttggataagcagatgcacgattcttgcccttttcttgtgatcttgggggacttatcatagttcgggcaatagaagatatcgctctcctctcttcattgtcagagtcttgattattgctatctactgatgagcatactctttccctgtcacatgattttttttgtaaagaagcaagcagaacaagaaccacataagattctctgttcagataaaaaaaaggattttaggcaattttaagtttcaggagctagtgaattccagctatataccttggcaaagacgcatgctgtctccgcaagggggtacttctttctcctctgctgtagttctcctcaagatgagcaaactgccgtttgaaacgatcaaccccactgtaaggagttagtattagcaaaagagacatggataagggtgttggttatatcacctgccagcactatcagcatgaaaatatatacaaattatgttttttcactatcgtaaaacaatcatattccccggagagtagaaaataaagcaaaccagctaggtatgaagaaataaagcaccaccgaatgaacaatactttttttaaagcacgccagcaaactagatttaaaaactaatttgctcaccttggatagaggaagctaatttgttctccacctctgatgtactcctgaagcatttggggatggtactctaatatctgtttactttcagaaaataaaaaagtaattttgagtgagatggatttatcagccagcccataacataaaatggagcggtagctttgtacctctcgataaatcatttctcttacatcatcctttgtcagtttccttcgctcaaattcaaactcaa

SEQ ID NO: 58941 - DNA, 750 bp, Oryza sativa
  unsure (1)..(750): unsure at all n locations
ctgtgcttaatttatatttcttatttcccaatttccttgtaaatcagatgatatatttgcttggagatatcattggtttttccttgtaaatctttttactaattcatatcattggtttttcctgactgcaaatcacagttcaggtcctctcatgttgtgatttaatgttcagaaggctattatggtttatgggtacttgctctaatataaattttgtcaaaatatatgtcgaagttaccataatattgcagattactctttcatctaatccctgaattttagattggtgcacagtgattagttaggttattttctgactaatgctgataaaatcgacgtgtacactcttgtatgaaatgaacagtttctactattctatacggacaaccatatatctttgagaatattgattttatccgcacgcggccgcccttcactncggcttgcttggcatctcccccccgcttgctggacgccggctcgctcgttttcttccaaacgccgctgctcgcgaccacaggagaaggaaccccgtgcacaacgctcttcccggacgccgcgtaggcctttcttctcagaccttaccggagaaagcggcgttggagcctgagatcaagcggtccttctagattcagtccttctcctttctcgtctccaagcagcatgtcctcccttgacctcggattctcactcggcaccctttgtgttagtgagcttctcgatctcgcctactcaacttcagcttgtttt

SEQ ID NO: 58942 - DNA, 20191 bp, Oryza sativa
  unsure (1)..(20191): unsure at all n locations
ccacgctgtacgctttatgctttcggctctgatgacgcgcgggatggctagcggtccccttctcacacaggaaacagatatgagcagggtggagcatccattgcttttgttggtacgtttctcaagttaaccctcctagacgaaatcaacatgcaggactgtcaatttgtcattgcaaaaggagggggaaaaaataatcgcaggattggtttgaaaaaggaaaatcaggatatgggagacaaacttgaaccttcgctttatgggcctagtcggccctcggcccattcgagcccaaacataaccctaacataagtcttggtccttgtccctcgcagcagaataaaaaatcgccgccgccgccgccgccgccgccgctgcccgtccccgcaacccaacgcctgattcgcttctccatctgcttgcattcaaccgggttgtggaggaggagtaggagaaatccggtggatatcgatcggatccagatgaacactcgactggattccggcggacagaagtaaatccggagtcggttttttcgtaaatcgcaggtactctacgcaatttttgatcctaattgttatactagtagtaatacagtgggagatgtgagtaataattgctggattatttctggtttttgtacaaggagaaatcgaggtacagatattcatgctgcctcgatgtgttggaatcaacaagatgaacaattaacatccgaagcacaaagaatttcggataaatccaactaatcgatcgatcgtatatgcaactagtgcatatacatatctagtagattcctgttcataatttggaggaggaagatcagttatgagttaccggcgatttgtgaatctggtgcttgataaggtccaaggcaactacacagtgcggcgcatggacatgtcacgcttcttcctcccccgtaaattggcaacgccgctggacgccggagcacacgacggcgcggcggcggtggagtacggcaatctgccatgcccggtgatgagcttccgtgcatcggtctgcccgatggagacgatggagttcatgctccttggtggaaggcataacaagatagtcggcaccgacctgacggggcgcaccctcctgtacgaccccgacgagcacgtcgtccgctccctgcccacccttcccatgcccaagttctcccccgtgtccctcaccatcggcgacgacgacctttacatcctcgacgacatccagggcccgttcaccggcggccatgatcactgcttccacgccctaacctatagtagggagagcttcaccgacgccgacggcgactggtgttgcaacactctcccgccgcctccttacatggtgaagcaacgcggcgacttccaattcgactcctacgcggtggtggatggggtggacatctggatatccaagcaaggcgtcggcacctacaggttccacacggagcgcggagagtggagcgcggtggcgagcggcggcgagtggtgcgcgatgccgttcaccggcctcgccgtgtacgtgccggagcacggcctgttctatggcctcgcgtccggcaccgacaacgtcctatctgcgtctgatctcattagcggcgggagaaagccggagcagcacagcctccttcctctggagtacacgccgcccaaggcgttgacgcaggtgtcttcccacctcgtgcacctgggctctgccaacttctgcatcgccaggttcttcgagaccggcttcttcgacgccgacgaacaacacaacccggagctgttcgctgtgttcaccgccgtcgaggtggagcgctgcgacgacactggagtgctccgcctcgtgaagcacaagtcggagatgtacaagcttatcagcgaaatatattattgggtgctttaatcagctattactccctccgtttcagattatatttattaaaatcaaatgcttaatttatattgggtccgtgaggggacagtaaagttctttgcttaatttatatttcttatttcccaatttccttgtaaatcagatgatatattttgcttggagatatcattggtttttccttgtaaatctttttactaattcatatcattggtttttcctgactgcaaatcacagttcaggtcctctcatgttgtgatttaatgttcagaaggctattatggtttatgggtacttgctctaatataaattttgtcaaaatatatgtcgaagttaccataatattgcagattactctttcatctaatccctgaattttagattggtgcacagtgattagttaggttattttctgactaatgctgataaaatcgacgtgtacactcttgtatgaaatgaacagtttctactattctatagggacaaccatatatctttgagaatattgattttatccgcgttggtcgggcnntnaccaacccttgcccggagcccatgatccttatagagactgctgttggccttgaatttatcccccaacatttgtatgcatggaaatgtggtgaaattttttccagtgattcatcaatataatctggtgagttgatcatgagctggatataatccaaaagcttctgttgatttctacctatgtcctttctgttgatcgctatagggtagattgaatgagctggatatatctttctgttgatttctacctatgtcatattgcagcatagggccataggggccatgcacatttatttgtaattcagatgaacctcatcctgtgcaaataagattgttaaatgctttctgttaatgatggacgctcaactatcaattctaaatttgggtgcaatgtgaatcaggccacataggttcagttggatctgttgagtttcataaggaagaggtgcctatgctcgctgattcatcaaacagctccatcaaagctgtagggcttgggatagactaatggtatgacggaaattaaaaatgattactatggtcaaggcattttttttttgcttatattcttcgatgcatagatatttggttgtattgttgacaaaaatatttgatataacattttattgattcacgcagattaaaaattgatttcacaagcaaacggaagcgttgtctctgctagtttactggctgaagagagtaccaactaacacaagaacagatctaagcatggcacaaaacttcttcactttccagaagaagttcagagaaagacagtctcaccgtatcatgtcagagaaaacttcagcagattcccaagtgcatgtccctgaacttccgcttgattcttcctggacctaggctttcctgggattgaaaaatggcatgcacatctcatgatcaataatatacataatttaaatcagaatcatgtacatctcatggtcaacaatatacacaatctaaatcagaatagtttgcgctctcatcgatccaaggttgccactttaattgctttataatattttaacaatgttgttttcttctccatagcaaattaataaatcaaaacgatggaacatgaggctcaattcttgtaataaatctcatactattcttgttgaacttcattagaatgatagattacatatttacagtgattaagcatatatagcattatagaaaaaaagcaataggacaagagtgcaagaccatgactaattcagacattaattcagtgactattaactattgattcaccgggtgcttagttgttcttctagctgctgttgctcgccgcctaatctgctagctgctcggctgtcagcgtcggtggtctcgttgcccagtcgccagtcgcatggtgccttgcgccctcgcctgctctaccgccatatgctgctcgccggctcgccaccgcggcgcccggctgctgttgcatgcctgcgcccgcctccacttattcgctatcgcgggctcgccgaagcacctcgttgctggcttgtgcttcacccaaccacccagccgcgagtccccaaccctaatctatggagagagacgtgtgcgtgaggtcacggctgcaccaggatcgcatgacgatgacgccctggatggatgagtggggacgacgtctttcagcgaggcgccgcagtggcgatggggaggagagcgcggaggaggcgcggtgtatgccaggagcggtggagggagcggcggagagagggatcgagccatcgagggcgagagatcgcggtggttgtgaggaacgaggagaggtcggcgactcggggggtggggaggggatgtgcgtgtctgccaatagcacgcattctgaagcgttagatatctggatccaatgggtacgattgcgtgtgtctgtcagggttggagtcaccgctaccactacagaattttaaagtaatagagatacacgctatcatttactaagaaggtgtttcttttccatcctattgtcacttgaggtgccgttgaggagggaaggtgttggaattgccaagaaggctgaactccaccaattggtctaccactcctttggcaagatcagcctcaacctgggactgtggtagtttgacatgttaatcaactaccatcctatgggctatttgacttggtgttgtaacacattctgttaacaatggttttcactaattagccccaaaagacaatagattgattttgtaaaactgaatcattattagctttcttttgtcagtgctatatatggtcatagattaatgtgatccattactttggtcaccacttgggacaaccatgctcaaaccaaatgcaagatcttcctttggatggcgcacaagcgacgtatcttcaccaatgacaggcgggtgcgacgcggacttgcaacttccgcgtgctaccccttctgccccatcgacgaagatgtggaacatctcttccttagctgctccggagtggcagccatttggcactcctatggactcgatgaacaacaagtcgcctccctagcacatctcgaagacctatggggtctccctccccctgacaatgctctcaccccacggatctggcgcaccatcttactagccacggtttggaacatctggaaacgccacaacaacaagatcttcaactccattgatgaagcccactcggtagttcttcatcgttgcgccaacgatatcgaattgtggtcaaaccgatgtatcgacgttgtaggcaaacaacaacttcactcttgggcgctaaatctttctgtaattaaccactaatttttagtttcttccctccgtccctctgtacctccccctttgtaaagtttttttttaccatatgaataaagttcaggctggtgttcaaacccgccgtagtttcccttaaaaaaaagatgacgtatgatatctaaagacaatacatacgtaatgcatatataaaattagatttttgtttttttatcggctcataagctagctcctattatttcagctattttgtcgtttcgcatatcaacgaaatttcactgcatgattttttcatctttttgtgtaccataagctacctcctgtatttttcagctattacaatgtttttggagattaacaattatcatgtttatcatcacggtttaattctcccatgtatgtgtagtagcacaaatagttaaacactatctagattttagttaagcggatatgccaatgtgtagcagaatagtttaaagcactatccacctatcgaataaggtgggcaaattgctttcttttccaatgtactcatgtaactcatcatgcatgtcgaatattcagtttgatcatttcagattccatagagaatgtatggatttttttaaaaaaattttagacatttttatttttttaattttattaatagacattttcgaaaaatattttcaaatgtcacatcctgatttttgtttcaggatttataaattatttaataaattcttaatagaatttatattaaatgttcattaatttacaagtgaagttaaatgtgggaaataaaatttcctaaatataaagcatggatggatttaattttttattaaattctccatggttaattatactctctggaatattctcggattttttggagctcaattcctaatttttaatcatacaaagagcatttcagtgattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaaagtaataaaaatcctcctcctcagcttgggccgaatccagcccattccctcctttcccctctcccttcctctcagcccagataaagtctgtttgacctccctatcgctacagtactccatcttcctcctccagacagagccgagccagccgtgctcgtgcacagtgccgccgcctcctcccaccaatccgacctccccattgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgccgtcgccggaaacgctgtccccgcgctctccttctctctccaaacgccggcgcgctccagccgtccctagacgccgcctcatctgcctccttcctgcgccgccacctccatcggctccgcaaggtcgagctccaccccggccggcgttccccttgcgccgaaacttcgccggaagccgtcctcgccatgaaccattgggttgctgtcatgttccgatctccagccgtagctagcagccgccttagccgccgcttttggtcgccgctgccgccggtgggttcgcaagaaggagagggagcccagcagccatctccccgaagccgaaatccaccagagctccatcgtcgccgtcgcgttttgatctcgggcgaagccctgctgctcctcccgtcatcgccaagcttcgccgctgcctccattggattcgcagctgcgaagtgaagcccggccaccccttcgttgtcgccgcacatcgccggaaagtcgtcgcctccgtggacagtacctcgccgcccttcggagctcgtcgccggccatcttctgtcgctgcccgtcatcgtgtaagtgttggtaagaatcgccgtcaccttctctacctcccggtgccctccgtttgcattattgtaccgtggttcgccggcaaccgccgctcctatgtcgttcaccggtgtagtttatccctagagtcttaattccatctaatctaatcttgtttggccctagcgtcatcatcgtctccgtgtgttgtcgtcggaccgtagccgtcgcctcttcctctccgttcgctaccgtttctcggtgaggcctcctctccgattcctagggtagatgtttatgtaagccacgtgtgtgtcgtcgtcgctgtgtcgtagctgctgcacgccgtgcggctgcggtttgccgtcgctctaccgagcctcttagccaccgctgcttagtcgctaccgcgtcgcgccttgccacgttgccccgcagctgcttgccgtgccgctgctgcgcgtgtgccggctgagccgcttagctgcagctgcttgccgctttgccgcgctgttgccctagaggcctagacttagcgcagccgcagtccgtcaccgtgctgctatcatgcatcactaccgctgccgctgtttgccgctttgccacagccgcagccgtgccggttgcgtttttgctcgcagccctgctgctctagccgtgcatggtcgctaccggctgtgccgtcaccctaaccctagctgcgtgtttccgcctagccgccgcctagccgagtcaagttgtcttagtgccgccgtgtcgcagctgtgtgccgcttaaacctagccgctgcttttagtcgagttgtgtagccgtaggtgcaaccctaggttcctaccggcctatcgtttgtcgtaccagggctttaccgtgaatcgtgtctagccgaccggtttagccacagccgttgttgagtcgttcgctcgttcgttcgaacgaggtgttccccgtgcttcgttcattcgtccgtgttgagtcgtcctttagtttagagccgttcagagccgtcggttctgttcgccggttttggttgatcatttaggtgatctcatgtcacgtggagttgactcgttgagtcggtatctcgtgaggctcgcttgccagatcaatccaagccatccgatcttagtcgactcggtcaaggttaatctcagctgtccaaaatcaatataaatcctctcctcttttcagtggcatattatttctttttaatatatgtcatctaccaaatatgatctaatcttttccggaggttgctttaatcttttatctccgttataaatcatttgtaaatgatttaattaatttggaatagtctccgtttaataggtttaattggaattaaatcttgtaaaattcataataaattcatatgaaatcagaatgaggccgttcaagtctcataattcatctaaaattatgatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacaaatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatataattgcttagccatgcttagaaacattagcacactattgggataacttatgactcactgttatttaatgatggcttaatggtagctcacgatggttaatcgtgttatgataattaattggtaattaaaatatgattaatggtgggttgtgagcacatggttttgaaggtcgtgctcatggcaattaaggaccggttcgcgagctacagttgtgaaacattaaccgtgccaaccacaagccagcgtgagcaacggctttaccttttgtataacatgattcattacggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaatgattaatgatgttataactggtaataatttgcttagctcctggtttggaatggataattcctggtttggagattagatctgtacagtcgggtatggttgttcaggatggtcgggcctgtgcagcatgggtgtgctgttcggtgttgattaaaatttctgattaactactctactgttttatttctcttaaatgttttgctaaacgctgcttttgcaaatgagcctatattatgccatcctttggtatccttgtgcacttgcatatttgctgtgtggcttgttgagtatgtcatatactcattcttgcaataatcaatcaacctcagttgaagaaaaaggatccagaaggagaagacgtttggcttataccccagttgagctgcctgtgggagtggagctgaagccatcgctagaccgtttttccgctgctgttttcttttcttttgtaagtgtgtaacgttattattatgatgaatctgtatattaaattgtcagtttgtgtacctcggctgattcctggacgaggattttatgcacaaataagtttggaaattacttgtgaatttccgggcgtgacatcaaatatgaaccttttagccacactagggtttcccttaccgccggtaactgcgtggttaccacggtgcttaccgcgggggtacggtaagggttaccggcggtaaggtttgggtgaaatttgagcaaattcaaaaattccaaaaaaaaacgaaaaaagcaaaaaaaaaatcatggatacagttcttggtttttaatgctagatggtgatttttttaaaaaaacaaagagtaagataaaatcaaatttgagggcaaaaccgataattgtttaggaaatggaaaaacaaaaaaaatgtattgggcttcattttttattttacatccacaagttaggtttgcaagtatcatatatattattctaattatccctactttctacacgcatttaagtgttttttttattttttagtatttttcattttttttcatgttttctgcaatatcgcggttaccgcgtcaaaccgcgaccaaaccgcgaaaccgccaattttttaattcaattttttcgagatgaaattcacacggtttttagcggttaccgttggggggtaacctccccaaaaacggtaaggtaaacctgggcgtggccaaatcactttgtcatgtcacacacagtcggcgtggcagtggcaagaggctggcgtggcaaaacaacgctaccacactagctacttggctggcgtggccaaaaatttcagttttcggaaatatttttcggaaatgtctattaataaaattttaaaataaaaaaatccgaatatttgctatgttgtcgctaatgaccccatttggacatggttaataactatgttatttacgcatgtggcaatttaattaacaaaataataactatgtctatctatcttaaattgtgtttctaaatgtcactgtagtgttaacacagacagattactagtattcaatgaaattgacacaccctgtatcggttctatctatctaccctatagttcaacaaatactttcactcattctttcattcatcactctagggttcagattattcgtatgagatccaacgctcctgatcttctcctcctcccacctctgtattcgccgctcttccaaccccatcagcgcccagatcgctccccctcccgttgccccctctccccctcctctttctcgtacccacccgaaaatcacgccgcgagatccccagcgccaaacccatcgtccaccatggcgactcctcgaaccctctagcgtcgccactcagtgccacagtttgaaggtgtttttttttgtgtgattatgatggctcatgctctgttgcaacggttgctatgagtattggacgaactgattagatctcgaggagaggatcatggccttggttgcctcatcgttatgcaggtggatcaagtgtattatttgattattcaaggccgcatgctcgccgtcgaccccaacacccctggtgacgatcctcgtcagatcaaggccaaaagctgccccccatcctctgttccacccctgcaggtacaacgaatttcctctcttccttttcatgttctctttagcgtgtcatgatagtgtatgtagagtttattcttatactccctccgttttaatatatatgacgtttccgacagcatcgagaaaattaaggatagagcgattttactattttgcccttcatcccttttcatcgcagtgttcgcgcacgccggctccctccactccggctcccttgccatctcccccgcgctgcctcgacgccggctcgctcgtcgtctcccaaacgccgctgctcgcgaccacaggagaaggaacccgctgcacaacgctcttcccggacgccgcgtcgccctttcttctcagaccttcccggtgaaagcggcgttggagcctgagatcaagcggtccttctcgattcagtcctcctcctttctcgtctccaagcagcatgtcctccctggacctcggctcctcactcgtcaccctctctgtaagtgagctcctcgatctcgccttctccaacttccagcttgttttttttttctcatttcctccaattttaattgcctcattgcctggttttgcccaatttacaatttaatcagaaggagaggagaagccctggttctggttgatctccagccgaacggcaagaacgacgatgtcatctgcagatgcagtacgttctgcttggtttcagccgagcggcaagaacaacagtggcggcagcagcaagcccgacgtccggctccctgtgcgccatgctgcctgactcttgctcgccccacaggccacagctcggggtgggttgccgccaaattggggtgcggcggcggcgcacgggaggcatgaacggcagcggcgcgtgggaggaggagacagtggcgagcgagtccggtcgcgatgaggacgaggcagcgccgtggcgatgttgagatgaagggcaacgatagaaattaacaaacgtgactaggacgaatgaactggtagcgtcaaacaaaaaaaacgattctgatttgcactgtagcgtcaaataaaaagaaacagagggagtacaatacaaagatcaaaacagacttggtggtggtgattgtattgaccatcaagcaggtaatttttcttgtgatgttcatgtttactattatgtccaaactccatagacaacttacacatttagaattacatcttgtatagacaaataagtgtatgtattaaaaatgtctgaagaaaatggactgtatgatcatagtgcctttcaaccgttgttttgtgcaatgtccatgatatctcctcgagattaatcgatttctacttttgtaccatatgcaatgtttaatttttaactgctcaggctcatgctatttcatattttggtgcttctgaagcgatctatatttcttgattctttgctatcgtcctgacagtgcaccataattgtcagaaatctcctaacctgaagctaatatatttcttgttttaacttcactgattcttcatatgtttcctttactgaatagagttttgttgaaagctactccctccgttccaaaataagtacagccatgggtatccgtatctacgtttgaccgttcgtcttatttgaaaattttatgaaaagattaaaaaaatagtcacgcataaagtaatattcatgttttatcatctaataacaataaaaatactaatcattaaaaattttcaaataagacggacggttaaacgttggacacgaatacatatagctgcacttattttgggacggatgtagtatgttctatggggtcaattggtcaaatcaatgcattttgctgggaaggtcgaaatcagcccatgtctacctgccacaatgagaaggcagccggtcagccgcctacacaacagactcttatattgccaccatcataagtttatttgttagtatgtactacgtaagaactaacacgtttatccgttaaaaaaaataaccaacaagtttgctttagtgatgttcagtgcagtgcaaaaatgccgcaagtcattgtgtaagttgtataatgcagtgaccaaattaagaagttttctagccttctgcattcctgcagttttctagccttctgcttgattccttcaacaaaaaataaacggatacacacattactaatctattgcaatctgtatttatttttcaataattctgttccgtacaagatacagcaagtttgagaagttcgagaggtacatgggatttcctccgcctttgaaaaacgtctaataggttcgagaggcgcttgacatttcctccctcttcaacaatgtcacacagcttgattggatgctctttctcattatggacagctgcttggtggagttttttacctaagaaaacatatgtttaccctgtagcaggcttgtgtataggagaaaaaggtggaattcttaaaggtaatcgtggggagttttagttcttttttgaagatttctctaactggtactccctccgttttataatgtaagactttctagtattgtccacatacatatagatatatatatgtctagattcattaacatataaatgaatgtgagcaatgttagaaagtcttatattatgaaacggaggaagtacatactaaccgtttggagttttggtctctcgttactcactgtaaaaaacataatggtaaaaaacaatttactcctaatggttctctctttatcccattgaacatttttatcgttgtctcattgattgctatcaaaatggaaaaacactggatgagatgtaggagagccgcattgatggcacattttgaaccagtggctcaggatccctgattctcttgatcgtattactctataaggtgaggaggatgaagcaggtgagttactctataagacaattatttttctttacaaaaccattatttttgtgtggatgtatattgtctcatatattggtattgaagtgatttgatatacttattgacggtattgaattaatatttttaggtaatataattattatacttcgtcataatatgtgaacctacatcaaattaaggttcaatcggacggattctaggaaatttatttttactagcatgtaattcgttaaaaaaagtattatgataccgtagcgttagcacgggcaaattactagtggaaaaaaaaatgcaccaagcggttggccagggatagcaatttgggttgccaacatgccatcttcttgcaatatttatccataagaagtcgcaacattgctctggtaggcttgtccaagccacatatatgtcatcacaagtaatgctatatctttttttttttttgcaaactactttttcctaatgtgttgagtcgttgatacaagagggagtgtgataaaagaaaacggataaaccaagacagtgcatctgcacgcacgcacttagaattagcacttagaatttttattatttctaattgtatttctatgtggactctaaactcatctttcaatattctttaatttttaatttcgaatttcagttacttttaaattgtattcctatatatgtattcctatattgacattaaactcttattcccatgtttttcttaattttgaattttagttatttgtaaattgtatttttatacggactctaaactctacttttaattttattatgtttattccaaattttagttagttttaaatttctatatggactctataatctacttctaataatccttattttttaattccgaatttctatttttttttcttaattgtatttctatatggactttatactctatttctaatattccttatttttaactccaaatttctttcatttcctaattgtatttctatatgaactatatactcctcttctaatattccttatttttaattccgaatttcagctatttcctaattgtatttctatatagactctagtctcctcttctaatattccttatattttaattccgaatttcagttatttcctaattgtatttctatatggactctagtctcctcttctaatattccttatattttaattccgaattttagttatttcctaattgtatttctatatggactcgtttattccaaattttagttagttttaaatttctatatggactctatactctacttctaataatccttattttttaattccgaatttctatttttttttcttaattgtatttctatatggactctatactctatttctaatattccttatttttaactccaaatttctttcatttcctaattgtatttctatatgaactatatactctacttctaatattccttatttttaattccgaatttcagttatttcctaattgtatttctatatggactctagtctcctcttctaatattccttatattttaattccgaatttcagttatttcctaattgtatttctatatggactctagtctcctcttctaatatcccttattttttaattccgaatttcactatttttaaattgtatttctatatggactttgctttttctttttcttctttttctccgattaatatgagaatttctaggccatgagagcgaacgtggaggctcttttttctattcctttaattatataatagatatttggaggaactaatctcgtttttgttaagacgtgacgatggttttgggtccataatagcgttcgcttcgagaagcaagtaagcaactaactctcgcgacccatattcctcataatcataaatcattttatgcctcgtctccaaccgactcgccaattcgaatcttcttctagaagccgagaggcggtttcaaacaaattcctcgagctcgagctctcgagcaccccaaccaaaaatggcgcccggccggttcgtcaccagcagcatggaggccttctccaagctggtgatgatgccgatcgcgcgccacagcccgcttcgccgccacgccatgagcgccgccagcgaaatcctcaccgtcaggcgaaggatttctgaccgctccgactccgagctggtgtgcgggcaccctccatgccgccaccgcagcaacgccccgagcgccgccgggctgcctccacctcgctgctgctgtgattccacggaggaattcgcggcggggagaggattcattcggcctcgcctcgggctcggcaacctcctcgtcgacgttcgcctcgggctcggcaacctcctcatcgacgtcgagagagaagggagcgatcgccgcgccgacacggggccgtctccacctcgccgctgcgatttcacggaattcgtagcggggagtcgcttcatgcgtcgtcgcatcgggttcggcgatcgccgcgccgacgcggggccgcctccacctcgccgctgcgattccacggcattcgtagcggggagtcgcttcatgcgtcgtcgcatcgggctcggcgatcgccacgtcgacgcggggccgactccacctcgctgctgcgattccacagaattcatcaccgggggacgcttcatccggcgtcgcgtcgggctcggcgacctcgtcgtcgagagcgccgccgtggggccgtgtccacttggctgccgcgattccacggaattggtggcggcgcggatacgctacattcggcgtcacctgggcaacctgttccttgaggcggttgggaggatgaagccgcctgacgagatcatcttcagtatttgcctggatcatcgcctcctctcctcgagtctccctcctcgccgcctccacggcatcctctcccagggctccgcgccgccgccggatctccgcggcgtcgctggtcagtaccaactcgcggcgctgaaacgcatgaagcgaatcttgtggagggcaacgccgatggcatcagaattcagagcctcagccaaatcacaccgtgtcgtagaaatccatggcgagccacccgaacaagagaggattggactgcgtgtgttgctgcggaggcaatcatcatcgccgccacgacgacaccaaccactgagagcaagcgctagccatctgcaggtcctgaggaggtggtgttcaaattcacatgtccccaatgtgccaccatcgtcgtcgtcgccgccgccgccgccgtcgccgcctcagccaactaatcctgctgatttttggtaagcttcattacccaatctattaattcaagaatggaactgaaatgcaattgaacgttgtatttgtagtcagatttgttatttttacttcaacttgtctaggatgaattcaattttgcatgttagtgcatcacacaattatctgtgctgtcattttcttttcagaatttttcattaccatttcaatcacatgcaaagaataagtgaattttccccatgttctaattccttttgaactctgtacttctgtttattaggaaaattaacactcctctgaatcctagtgctactaaaactgagaagagtacaattgatgaaacacttcttcagctgaaattcgatccaaaagagtttgctagatgcaataagttgatggagacatacaatgtgttaggtcaagaatggacattcactaagctgaaggaacagaccaaatatctctttgattcattgattgtgctggttgagtcgtttcacgaggcaggctattgtttctctcagatatccacaagcaccgttctggtaacatcatcttggaaatttgttctgctagaggggtgttttgctcttaataactggagtgttgaaggggttagaaaggactacagagatattgctgttttgttcaggaagctcctatccgagtccatgggtgaagagacagttcatccccctgattttgggatgctactcagcttgatggaaaaggatggctttcggtacaagtacttgattggtactcacgtatcattgttacctgatgataacattaacattgcttatatgaagattcatgagttcattcggaaaattttgctggctgaagagaaggataaagccaggcaactgaaactcggtataacacgttacagtacaattagcacaagaataagaagacgcattccttacaagaatatctggttgaccaaggctcgaagcaattcattcatgacagcattcttggagcaaaacgaaagaaatatggagttaggagggacatattttgaactgcttgacactattagacatttcgtatgtcacaggctggacttgctgaagctcggtttcagatataaggcaaacgaggtagaccgcatgtggtatgcagagtttcctacacttttagctgagttgcagttagctctgttcctggttggtcgacttgaagaactggaattggagaagaactttatgaacagaaaaccaatgcgacccaaagtgtcaagccatggtactttctaactttctattcatttcacttcctcctcacccccccccaacgccttcttttttttttgtacaatatgcttgcctgcagttgattaataagttcaatgaaatacccagtgaataaattcaatgaaatagtaggggacttgaattaatgcagcttggtgtgcattgggacattttgctgcacatgctaacaccctacaataactctggcagaatcttactcggagcagcactgacaaggatgaggtcacaaaggcgtgcctctggaaggatgattcatgagttgagatgcagagaaaaacaaaaactaacctggtaattttggatgcttgttcctggatatgttagtgaagttgatagctcaagccctttgagttccaggtcttagtacgttctactgtatgttccctgttcaggatgaaatgtatgttgcactttatttgccctgagttgcagtcctgttaacatgaggatgccaaatggcatgatgttgataataacttggatgctgagtgatcctccaagtacaagaaacttcttggttcggcactagttcaaagggtggtggtagttcatatctttgcaaatccttgttgctgttgtcaggattggttttgtttagctttctgaattttcaatcattgacaatctttagctattatttgcaagaaatgccatgttaccatgtccctctttgcaatttcatctgtgcagcagtctcttccacttctttataaattttgatatagttttcactaacaaatatagtttttgctgtattacttggctacgttcaataggatgggttgggcacggaaaacggatcagttcattaatgtgtgatcaattaagtattagctaatttttttttctaaaaatagattaatttgatttttttaaaacaactttcgtatagaaactttttacaaaaaatacaccgtttagtagtttgaaaagcgtacgcgcggaaaacaagagagaggttggaaaccttcatgttcgaacgcagccttaagtaggctgtagttccgaaattttactgttttgacctgtcaagcataattaattatatgcattgctatttgacacttcgttttgaggaggactgactaaacgttgctattatatcagtattatacatctcagtattaacaaggtgtttttattcttgtctgaaacaa

SEQ ID NO: 58943 - DNA, 20325 bp, Oryza sativa
  unsure (1)..(20325): unsure at all n locations
attcgttggctcgttgccccgtcgccagaaattcgtgactcgcccaaatgcccaatcccgcgaagacatctcagtatgtaatgtgcttttgccctcttttacgatgtactaaacgggtggaaatgccttttgggctttggctcagcgatggctcggcacggtggccaggcagcgcgaggaatggcccggcggcggcggaaatcgacagggcgacgatgacgaccactatccggactccgggctgccaagagaaggagtgtaacggctcaaagaccatctaaggatgctacacgagtgaggaattgcgccgaagctcacccgggatcaaggaatcgacgaccacggccagcggccggagttgaagaagaagggctcgatctcctcgatggcgacgcctcagctcgattccttcgatgggcttgctactgggatcttggcaattctcgtggcgcgaagcctcggcctgagatccaccggattgacgggaacggcgacgctatccacggcggcgctccaggcttgctccagaacagcaatagcaaggtccgtgttccggaacatcgactgcatgaaatcgactgaacttaaggggaatggaaccagcactgagaggagacaagggaacgaacaagagatcgagacaaccgcggctcaatcggcgatggcgacggtcgtcatccttgcggccggcggcaagaacttgagcggcggagaggcagaggctctccctctcgagctgctcggttttgggagggagtaggaatgaggcgatgcagnttggagaaggagaaagcgaagctcagcgtgtgacacgtcgaggccacgcgtcgagcgcgtccgagagagatcggcgccggttttccttttctccctcgtgttgagcggtgagaaaatggaaatggacagaggctgggttagctggggaggctgccaagtgggtccagagcggtgtacactaggtaggcaagaggggtataggtttgagtttgagtgaacaatgaatttagatgattttcaggattatttcttttcccatctttgttaattcatatattaatttgtggtgcagatgagttcacgtgaattttattggaggtagatgaatatacctagtttttattttctttggttacactcaaaaattataaatagattgctcatagaaattaggagatgacgagcttattggaagctagtttgaatttttatgagacctgaaatgagaagtaaaattctagaaaaattatatttagccatgataaataatctagtatttaaataatttatctctcatgtataattctatgcagttcaatacatattttggttaggtatggtaaaaactacagttaatctattttttgattagtttgattgatttatttgagatatcaaatgtagatattaaattataccaaagttacagtgaattaaatgtggtgatcatagcctacattaattttttcatgattttatcttgcacaaattattttagataattagtaagacttatctttatatatgtttcccatttctaaatgcatgtaaatgtttataaaatttatatctggactcctcttaacctgaaggggtaatattagacttctttttcatgtcttcaatattattactcatgaacgcttttaggttttgcttagtgaacttatcttttaatcatgctcatgagacctaatatgaaatgcaaacaaagatccaaatgcactagaaagactcaagttaaaccattcatatgtgagtatgcatgtctacacttgtgtttgcatttatgtcctaggttagagatgaaaaggttttaatttaccctcaaattttattcatgcaagagttagatcaacttcacctaggtttagaatggaaatttttggttcacaaaattgaagaactttttgatggaaattcctcgctcctagaattcgggtatgttacatgatcgtagagtcaccaaccaccccaacccagcaagcgttaagtcaagatgggttttgatagattaaatcggctagcggagccgatttagatagaacgatagataactacccgtctcgtaggcaaaacggaatttttcgctgcggcagtggacgatatacagcgcaaatcgacaaagatggacaaaccaaactagaactaattcaaagtacaaagcaatattgaaaaaaaacgattattttgattgattgtatgatcttttacaattgaaccagccttgtcccttatataggggttggtcttgtcctctacaggtcctcctccacgtccaacttggatagaaaccaaaggaaacccaaaacataccttcccgagtaaggaaaactcgagacccgataaaacagacttgggctcgaactctgtcggtcagatcggtcacaagccggtggtctgaccggagttcaggccgcggtctgaccagcctatacaaggcgaccggtctcctagaggaaaacacctatttgaaacttgggtgtaaacaagtgagtataaacattaatgaagaaccagttttatatttaagactgaggggtttgagacaggatgaccctccgtcaacttggtagggatgttttgtctaggattttgagctctgcaacagagaggggattttaagctctgcaacggagagggattttagagctctgcaacagagagcgggttttagaaggactggttctaaatattgtgaatgagggtttatcacacttacactaatttgctaaaaaataaagatgtgatgacactaaagttttttctctaatgttttgagtaaatgtcaagaatgaaaatccattatcagaaaagtgagttactgtgatgaggtgagtaaagagagagaaccaaattgcatatatgctaacttgtaaagtgtgggacttcccaataattttatttggggctaccataaagtggagagaagattggtaagaaagaactcatgattgtgggggtgaaaaatgtgaagatattaaactcttggaaaaccgactacttatcttatggggaagagaaatgctaataaattcatatttgtcaagcataggtctatgtatgcagtgggcttttataggctacctgagagcattcacaacaaaatggactctgtgaggggaagattttattggaaggaagtggataaagagaaaaaatatcacatggttaagtaggaggctttatgtagactaaaagtattggggacttaggtttttttgacacaagagttatgaatatatgtttattaagttaatggattattaaactggaaattgatagtaatgatttttgtttggaagttcataaacattaatggagaaccaggtccatattttaagaccgaggggtttgagacaaggtgaccctccgtcaacttgctacatgatgttttctctagaattttgaactgtgtaacaagagatggtggttgtagaggattttgagctttgcaagtaacaagagagatggtggtggtagaggattttgagctttgcaaccgagggggttttagagctatgcaacagagagcgggttttagaagtactggttccaaatcttgtgaatgaggagtttatcacacttacaatacatataattttgtttgctaaagataaagatgtgatgacactaaagttttttatcttctgttctgagtaaatgtcaggaatgaaaatcaattatcagaaaagtgagttatagagatgaggtgagtaaagagagagaaccaaattgcagatatgctaaattgtaaagtggtggacttctttataatttaataatttatttgggactaccgtcgagtggagaaaaattggtaagaaagaactcatgattgtgggggtgaaaactgagaagatactagattcttggaaaaccgactacttatcttatagggaagagaagtgctaataaattcatatttgtcaaacatatgcaatgggcttttataggctacctgagagcattcacaacaaaatggactctgtgagcggaagattttattggcaagggagggggtaaacaagaaaaaaatatcacatggttaagtgggaggctttgtgtagaccaaaagatattggagggttggtttgtttgacacaagaattataaatatatgtttattaagtaaatgaattactaaactggaaattgacaataatgatctttgtttggatgttattaaacattaatggaaaaacaggtccatatttcaagactgattggtttgagacagggtgaccatccgtcaacttgctaggggatgtttttttttttgggattttgagctctgcaacagagatggggttttagaggattttgagctctgcaacaaagggggttgagatggggttttaaaggattttgagctctgcaacagaggaggttttagagctatgtaacagagaacgggttttagaaggactagttccaaatcttgtgaatgaggttttatcacacttacaatctgcatgcatatgatacaattttgtttgctacagataaaaatgtgatgacactaaagttttttctcttctgttttgagtaaatgtcagtaatgaaaatcaattatcagaaaagtgagttatattgatggagtgagtagagagagagccaaattatagatatgctaaattgtaaattgtaaagtgggggacttcccaataatttatttaggattaccatttagtggagagaagattggtaagaaagaactcatgattgtgggggtgaaaaccgaggagagattagactcttgaaaagccaactacttatcttgtgggggaagagaagtgctaataaattcatgtttgtcaagcataactatgtgtgcaatgggcttttataggttacctgagagcactcacaacaagatggactctgtgagggagagattttatttgcaaggaggggataaactaaaaaaaatattaagtgggggctctatgaggaggagattttattggcaggcgaggtggtaaagaaaaaaatatcacatggttaagtgggaggctttgtgtagaccaacagatattggaggtttaggtttcttggacacaagagttatgaatatatgtttattaagtaaatggattactaactagaaagtgacaataatgatatttgtttggaagttcttggaaaaaaatacatgcagcaaaaggggttctttcagagttatgaggtagggggtcataattttaaaagagtttgcatgagatcaacttttgggtgaataagtttcaggaaaagaaagtcaacaatagtgaaagtacttatttttgggagatgtttggtgtgatcatgttcccttaaagaatctttttccttacctatataatgtaaaggaacaacaaagggctacagagaggtgaaagatgatgggggctggaaactctcttttagaagaaacttacaggggataatttgagagatccaaaagaactaatgataaaggtggagggggtttgtttgactgacaagagagatgagttgatttggcctctagaaaagaggaagaactttacagccaaatcactttatagagaaatattttttttttggggggtggggggtgatagatactacaatggtcaccttgtggaaaggaaaacccttgaagttaaacattttctcttccccatagccgcattcctccactgccgccgaaccatggcactctctcgttgccaccctcgtcctctcgactctcatcgccggcgtccatagttgcccatctccaccatccaagctagccaatgagttccccgtccttcactcgttcttcaaccgtttctcctacctgccaccattcatcggctcactgtcgtgcgtcgccggccatcgatctccccggtggttcaactcccgtcggtccaagatggcgtggctgccacgtcggccgaggtgaccaccactatgccacccacacgctggtctccctcggaccaggctgcggcccgcggccgcgcaccactttcgcccgcgccggtctcgcacctgggccaggccacgatgctaccaggcccaaagtgggcatcgatctcccttctctctcgtactatctaggcccaatcaaatgaagcccatttacctacctcaccaggcctcctactctcttggactgaacccaccaaccctcaaaccgaaaacagaaggtctaactttcctttagcccaaggaatattctgaatattcagttccaatttcaattcattatttcctattattccataaatcattttaaattccaaagatcatatctccatatctgtaactccgattgacccgttcaactttccaaatctttctaaaattgagataaacccaatggaactattatttattaataataatattttatttttagggttttcttgattttctctcttcgaagagttgaagatgaagagctgagataagtcaccctttgatcatattactcctagtttttaaaattttttgtttgcgaaattgcatgcaatgtgcacattaatttaacatgcctcggttcatgtaactaatcgacagatctacctagtagttgcatgaatccaataggtagttgatgacaccaatcccacgtcactccaccttgtggtatctcggtcctactcgtataacttgtttgtcaaagtgggaaaatgggttacaaaacctttttaaaacccgacaggtagtgttgtgtttgtgaaatgaaagtggttagtgaaaactcgtgatgcaaatggataccttctgtttttgcatataaggacgatttcctttgggaattgcattataataatatgtaggtcccccacgtctggctcgtcttggtctcgctcactttggaattttctacccttgagagatcgaggaaaaaaacagcagaaaggatgtctcaggctaaataaaggatgagtacgaccacaccggttgtactggttacccttggctaagtaattagctaaccaaagatgccttgtacgtcaatagttggggattgttgagatgatgtcacgtcctgataaattcatcccgaaataaaaataattctctaaaaggaataatagaattaattaaaattcgaaaagaaattggcaaacactaaaatacatacaagaaaaattcgaatgtggcctggagaatttttgttaaattctccttggtctaaaaggagtcctcaaattttactcgaattttcagagcatcggaaataattattaagcaacaacaaccattaacaaagtttattaaaaagaaaaactaaaaataatcctccttcctcctttgggcccagttcggcccaatgcccccacctctccctcgccctgcggccaaagtccctctctcctccctctcttttcctcacctctctctctcttgggccgcccctccctcctccctccctcctctccttcccggcccactccctgctctcctcctcctgggccgcctcggtttcgcccggcccaagccgagccgcgcctcccacccgtgccgcgcacgtgtgcgccgttgccacgcgttgaccgcgcctcccgcgtgggacccgcctgccaggcgcgtcgtcctcctcccgcgcggcctcctctctctctcccgtgcaaccctagcttcttcctccctcaaatccgctcgattcaaatgactaattccaaaattgattagggggattaaaccccattgattcctctctctttccccctaatttcccccttgaatagcgccattaatcgcccggaacggccgcgacaatcccggtcaccttccgtggccgccggccgccattcccgccgccgttccccgctcctcccgtggccagatccctcccctcacctataaaatggaatccccttcctccgttctctcgttttagcctcctcccgcgtctccccgtggccgcaccacctctccccgtcgccctcgtctctatcctgtgccgccggccacctccagccgcctctgccgcctcgcctgtgtgccggccagccgtgccgtcgccatcctcggcctcgcaggtgcatcctcttccccggcgtcgccttcgtttcacggggaaaccaccggaggcgcgttcctgccgtagtccaatggcgttgccgccactgtgccgcctccagctgccccggtcgtcgcgcctaagcgccggccgacgctgccgtctcctcccttggcatggtgacgtcgccctccaccccggcctgccctcggattcgtccagagaccgccgccgccgcaccagcctctccttcctcctcgtcaacgtctcctccggcagccccttccgccgtgcccgtgcaccggccgacatcgtcgtctcctcccttggcatcgcagcggcaaggtcgccctcggtctcgcctcccctcctcccgaaccccgccggtgtcaccgtcgtcgtcttcatcgttcgttctcgtcgatgtactcttccggtcggccgttcatcctcgccggctcgtcgtcccgcggcgccacctccgtcgtcggcattgtagcggcgtgttccacgccgtcctcacctctatgcaactgctgtcggctgccatcgtcgcctccttactggccctggtcgtcgtcgtcctctcgtcgttcccgatcgtcgtggcgttcgtccctccgtcaagccgtttgcgtttgccgcccgcgtttcgtcaagtgtgctgtagcctcctcgtcgtcttcgtcctcggctccgcgtcgtcaagccctgcgccggccgcgtctcgccttcgtccaagaatcgccgccgaagtcgtcccctcgctgttcgcctccgtcgtccccgagccatctccgccgcgcccgttcgtcgtcgtcattccacgccttgtcgcgtgatggtaagggtccctcctcgtcctttcggtatcgccctgtgcccattgtgcggttgtcgaccccggtacccgtgtaccggtgtcggtagtcgttcgtgtgtgcgtgtggtgtccgtgttaatgtgcccgctcggtagccgcatggtttctacgtgtgtagcccgcgtggtgtctagtggagtccgtttgcggccactcgcctcggttgacacacggggtccgctttcgtcgacccgtggaccgtctctatgtactcggtccaccgtggtcccttaggttgacatgtggggtccgcctgtcaacagcgcagccttcccgtcttttccagggtagcgcttacacatgctttatagttgcaaagcttaattataataatccgcaaatctccatataacagcattaaacttcgatgaccatgccttggtcatacgaactccgaattgacccgttcaagtctcttaatgtttgttataacctaacgaaccatgtgctttctttttatgtattgttattgcttttttatagggttgtagctttgcttgtgtatttcgcgtagcttctgtcgtttcggaggtttccgaagcatggttcgcggtcatcgccgaaggttcggaaggccgttctctctgagcaaggcaagtcgcatcacccttgagcatattgaatcctagtttataaaactattttgatttaaattattgcattatcgctttatttaaattcccacgttatcactgttttatttagcaatacctattaatccttgttatagccttatcattgatattgtttattatcaccttgcttaccctaggaaaacaaattcccagctagtgggtgctctattaatagttccactagtatgaatttaggtagatgcttcgctgattaattaggcaacactagatggtttataactttagactttggaagttctcatatcaattggacattatggaatggtttgcgtgtgatggaattaaacacacaccttccccctctattcaaaactcccaaaatggttttaggctaggctcgaggtgcgtggttttgctaggagcacctcggccaccataaggaccggtcttcgggcctctgttgcaaagcactaccgtactaaccacatatctaatgggtaaggcttaactcggtgctcaatctaatcctaaacagaaggaaacggatggagatggacgaaatcggggcccgatggacatctctagggcaaatgaaggttacacaagctgcggctcggtagtcgagatgttatggcatagggccggtgttctgctgctaggggctcaatcctgcctacctgtcccaggattccggacgtaggcgaggttgggtcggtacttttgttcacggctaggatgggtgaatggttatgtcacatgtttacgacgggttccaaggctttggaatgcggagtaaagatgtgtcttgtgggtaaagatgtacacctctgttcatagtataatctatttgaatagccgcgcccttgtttagggcaagcctagcaatgtacccaagttagtggtttaatttttaaaacttgcttaacaactaaaatgtggaatgattggcctgggttggcttgggacgagctgggacccaggtcgggttgccagttcggtctgaatcatcgtaggccttgggttaaggcaggttcgtgtgggttcacggccttgattaataacattgtgtagctctaggatcatgtttacaaaatagctttgggcaactaagtgacttttaaatgctgtttactgtaaaacctaacccctattattaccccttgtacccccttgcattaatcatgcatctcccggtgtggcttgctgagtactatggttgtactcattcttgctctatctttcccccgtctgtaagagaggctttggagaagaagttttaggtggagtcctggcttataccccagttgagcgcctgtgaagatggagtcgtaggcccgctagtccactgctgtttatttttgtttgttaggccttaagtgcctttgtaataatgtaaatattatcgatataataaagatgtgtcttttgtatcatgtttgtgtggtgtaccccggcttttcctgggacgaggattaatacactagcgtttgggaaaaggcaatttttccgggcgcaacaaatgaggagatgtgagatagtttattgcgttgggcacacattgaacattaacatgctaggcacgaatggttgaagacattccgaattcatgggtagacgagggctgaggcttgcctgatgctcggttcagagagaacccttctatgtggcatgaggtatcttcggttggctttggaaatgtcttgtcgtgaaccttgcttcaccgattgtatctaatcaatacgcgttgggcgattggagtaagctcacgtcgtgtgggtaaagtgtacccatttgcagaggttatgaaactgttcgaacaaccgtgcccatggtcaagggcggatgcgaagtgattcctcttgtgtagatttgtttgcatgtgatttgcaaaaataatttgtgggaatgaaaaccgttactaaattcagctaggtgggttgatgggtgaccgttacgtggtctaaaacaatattgtgtagatcaagatgtctaatggcatcatagattacgtttctcgagtggaagttgtgtgtatggctcttggagccaaagaaatgtgttatgagatgcgttgatgcccgatggtttgaaagtgaaaagaaactaatatttgggaaatgagttggaagttgcttgatggcagaagatcatgcaccggtttcatggtagggcaactggtagaatagttttaatcaactaaaaagttcctttgcccgcttgagttgttgcaagcaatttgcagataggattgaggcaaaagcttctttccgacacttagtgttttgaaaaatgtattctaaaagtttacaaaacaatcctagccctcctttgcatcctgcaaccccacatttccgtgacttgctaagtacgtatgtactcaatcgttgtttttcctctacaggaagagtgaagtgaagttgaagaatagagtttccttattagtcccaggccattgcatgtggattgggtctagctatgttaggtttcgttgttgcttttctgcttgccggttacactccaggagttaccccgaaggtgtgacctcttaaaggtacaatctatctatagtatgtttaattgctatgatgaatctctgttggttgcaggtacaagcaattgtatctttggactggtaccagcagcgaggttttgtgggattcggttcatgtggattttctgcgtcgtaccctctctggtgtcactattatgtgatgccaaggcagggtgtgacattcttccaagagttgttgctccaattgccattgatgcggccattgcaatcatcctccttcctcatcggcaactcggccgatgacacctccacgttgctgcttcgtacgatggcgctcatggtggtagcgtcgtcaacacgccattactgtgctctcctgcccgtgggcctcctcggacctccggggaggctggcgtcgagaagcgttgagcggttgacgacggcggactcgatttggaatcccggatctcctccatgacacgcttgtgggaagagaggaaagagagattgagaggggtgaggaggaagatgaaatgaagagaaagtcgttgacacatgggtcccaccaattgactcggcgagtcatagtcaatctgccatgtcagcggaagtcgaagaaattggtttgcaacgaatttcaaatatagaggcgacttacaaagggccacggagggacaattaggacaaaacatcctgaatttttgaagtagctaaatatttagtttcttccgaatatccgttgcaatgcacggaagctttttcaggtactaatatatgtctaagacaaactaaaaataaggttgcttagacggatggaataaactataaagttatatatatacatgtatttagcgtgtgaagcataatattgttatagctcgttgtttcttcttacttaaattttacacattttcgttgatagttccgtttcccattttcggctcttttcggtccgtttttcacgattgttgtttttctttaaaatcaatcaaagaggattactacgagtcgcctactactactacactagtagtaacattgtttatgttttcttctcccatatccaagatggcaatggcaagtccaaagcggcagtgggacacgatgataattttgtgtaatcactccccctccgattaattaacccctcccagatctaatctcctcccgcacatcctaacccaggacataatattccactcccccccccccccccgggccgcgattaaacaaggtggctacagacgttgaccagagaagcgagatttgggaagctgcggctcgacattggtcgcgccatgcagatggagatggagatggagcggtagctgccatcgattcgggtcgcatattcgcatcgtcttcttctttgtttggttggtctgcgtggtggatcggtcttggtggttgaggtggaggccgacatggagcgcgttgttggcgacttcaacctcctcctccaacgcggcggcgccgccggtgaacgtccgtgtaggcgccacgccgatgcgcttgatttgagcttcttgatctgcaagaacgcgtcgagatggtccatgagatgaaggtgtttgtttgtatgcgtgcgtgcgcaggtgggagcgaggaagggggagggggatcgccggggacggaggaggcggcggccgtcgcggtgaagcagcggatcgcgcgggcgctgcggctgtacaaggaggcggcgggcgacggcggcggcgggtggatggtccaggtgtgggcgccggcgagggacggcgcccggcgcgtgctcgccacgcgggggcagccgttcgtcctggcgtcgcagtgccaccgcctgttccagtacaggaccgtctccctcacgcgcgtcttccccgtcggcggcgccgccgccgccgacgagcaggggcttcctgccagggcgttcgacgcgacggcgccggagtggacgcccaacgtgcagtgctacggcagcggcgagtacgcccgcattagctacgcgctcatctacgacatccagggcagcctcgccctccccatccttgaccccgacgacgcgagctcccccctcgccgtgctcgagctcgtcaccaccgccccgctgctccgcgtctccggcgaggtcgccaacctctgcaacgctcttcgggtaatctctctgtctcgatcaagaaatgattagcaggagtgattagattagtgaagtgattaacatttcttgtgttcatatgcaggcagtgtcactgagaggtgcagggatttgcaaccgtgcagccgaggtgagagttgagatcacatgaaatttcacgagaaattgcatgatccgttcatctactgatccagtgttactcgcttgccgtgaaccagatagtccatcgagatgcgacccgggcggccatggccgaggtatcggagctcctgatcacggtgtgcgaagctcacaagctgccattggcacagacatgggtgagatgctggagctgcggcggcggcggcgaggacacggagaaggccgcgctgacgaccgccggcgcgccgttccacctcgccgccggcgcggacgcgcggggcttccgcgacgcctgcgtcgagcaccacctgcagcgtggccaggggctcgtcggcaccgcggcgcgcgcgccgggcggcggccgcctctgcgccgacgtcgcgcggtgctccaaggacgactaccctctcgcgcactacgctggcatgtacggcctcgccggatgcctcgtgctacgcgctgagctcagcgcggcggccatggcggacgccgccgccgccaccgccggcgacgaagaggactgcgtcgtgctggagctcttcctcccgccggactgcaccggcgtcgcggagcagaaggcggcggtggacgccgtctccgccacgatcaagcaatgctccggcaacctgaaagccattgtgatcagcaacttggatgatttgttcttggatactatggcagatggtgatcaccaactaaggcatgaaatggatgatcttggagatgatcaaagatgctcggacgaggaggatctgcagctgctggagaacacaaacattggtgagcttaacattcacaatgcagatcaaatcagaaatgaggatcctacatcacaagttggcaagaacaagacgaaaagaggaaaagctgagaaatctgtcactttggaggagctgcagaaacacttctctggtagcttgaaggatgctgcaagaagcctcggtggtaagacaacatcacacttgccaacaacctgcatataatcatcatgataattgatgagttaaatgaatcagctggatattcagtggattatcttcatcaaaatcctgatgtttatgcgcaaattaacacgcaaccactgaaagttggatcaccaggtgacagttttatcctcttgttttgcagtatgcccaacaacaatgaaacgcatctgcaggcagcatggcatcccaaggtggccatttcgcaagatcagcaaggtgaaccgctccctcgacaagatgaagcgcgtcatggaatccgtgaactgctcgccgtcgccgccggtggccatgcctgctcacccagctcttcttctccctccgccgccgccgccaccgcggccatgcctgtcaagtaccgtaggagagacctcctcccatggatcatgccaggcgccgccatctcacgccaaaactgcattgcgaaaacctccgaggtgcggcaatggcgacggcgtggtcaccatcaaggccagccacagaggtgacatcatcaggttcagggtgccgtgctcagccggcgtcgcggcggtgaaggcggtggtggccaagcggctgagcctggacgccggcgccttcgacgtcaagtacctggacgacgaccacgagtgggtgcttctgtcctgcgacgccgacttccaggagtgcctcgacgtcgtcccggcattgccgtcgatgtcggtgacggcgaggtcaggctccggagcggcggctccggtggtcgtcaggctgatggtccaggaggtagctgataacatcgggagttcctgcgctagctcagattagttgtaaaaaatgtagctgaaagtgtgaaaccagtagcaggaacatcaaacagatttctcaagtttttactactgatacacatacaagaaagttcagacctgtcaaaaatcactgtaaaaaggaacatgccttagagagtgtcaatataccatgaacattgtttcatcttgaataataaccggaaagagaaaggcacaaattgcttcagatctttttgctaggatgacagctacattagcaaataagtacagaatttgatgcatgtttgatatcattatggaacttgcttttctatatgctcagtgaaaatatagacaatactgaagagcgaaaatgtgctgatgtgcagtggcactgacttacaaggctgcctcgattttcaagcggcgacgaatcagaaaatggtatactcttgcagcagcatgaaagatccaattcaattatacattctgtaggaatatttcataattggtactttggcagaatttccacagcccaaggatccttttctgagcctgatggtgtgcaacccagtgggagtgcctgtctatcaatgtagtccctggacttcagtatatcaatttagaatgtgaaagtaactgagctaaatgtacatccaaccaggaaaaaaaggccttgcatttcatggtaaagtgaaattttgcaaatcggatgcatgatagcaatcgagtacagttcaatcttgcgctaggttttatagctgcaagttacaactatggcaaactaggagccaacagatatctacattaatttacaacaagtatattgttctgcattgaaccttcgccatcaattgggtactccagtgacagcctccactctccatcaaccaagaatttgatctcatacctttattttgcatacaaacagataagtgagattgtttagttaataaataaatcatagcaaatcagatcgctctgcagaattcacaaaacacacctcccaggtctaagattcagagttgcagagaatcttgcttggtaacctgaatactccatggacattgcctctccctgggaccagccatcgaaggagcccataatttgtacattctgatgtgcagacaaaaaaccaatgaagaacaatagaggacataaatgatagctgtagatatatgacaatagttctgttccatataacgagttaagtcaaaaaccttgttttacctcagcaatgccaacccagaagacagaaatttcttggtgctttaaagagtctacatccttaatttgttccataaccttatcatgaacagctataggaaacaaacatttcgtcagaaaatttcattgttaattcaacttggagcattgtgatagagataaccttctaatctggtgagaagatgtgactggatatattttccatttatcttcctagacccagatggaacatcaaaattagcaatctcttcagctagggcaaccagagcctgtggacataaagaaacagtgaatacatacaaaatgtaaatacatttagagtaacagtatcaacaatactgatcactgataaaagtttgaacaaaaccaagaaacaaaatatattgatttaaagccagtcctaggggagacaaagtacagaggcatacaaaatcatacaatcctttagaggaagccagacatacttcattcatgtatttacagtctgatatctttatggaaaaggaaacatgaagttatgaatgaattctcaagatgctagatgagttaaaggcatgttgatagcatcccctgtccccaaagggcttatgattgaactatgaaacaagaaaagtctgttagagctaacctgcagttcaagttccataacggcaagttcactcttgaacttcacaacgtcattatccttcatttgcaactgcaagaaatagtacatttctatctagttagcaatgattcagtgcttaataagagaaatggaattgtgcatatttgacataaccacaactctgtatggacagctatttatacaaaaaaaatgtaatctcacaaaaatattcatctgatgcaaaagaagcttcaatttagcaaactagttcatgaatgattttttaaagaaaaatatcctaagatactttcagtagttcaaagtcctggattcgttaggaatatttaaatacatttgtactacaaaatgcattatagattttttataaaaaaaatgtaatttttctggcgatatagtgcgtagcataaagtgaatcaacaacagtaatctacaagtaaaaggggagttctatattctattcgatcctgactgaacaaaattgctagttcttgctgacttgcatcatgacagcaaatacagtgcctggacagagtaattgtttttcattttacaaaacgtctaggcgctatcttcagtagaaagcataaagttcaagtcgcagataatagaaagctattcagtatgaacaattctgtattatgttatttgctgataattgtgaacagtatatatgatgcaattcaatgaacactttggaaaaaggtacaataatagaacctgtctcttgaggaaccggttgtattggtttgcttcactaagctttttcaaaagcttagatcgttctgaatcagccaaaagagatttcaactgcatgccaaaataaaaagagaagcacaacattagtcatatataaaataatgctagtgtctgtaggttgctaatcgaaaagaaaaaaaaaagaccaagttgcaacgttgttctttgtactttggaagtatcaatctttcaagtgcgatctacgaaccgaaacatcaactgttagagctacaatcaagtttgccatttctctgttgagttcatttctgaaggaggtcactctctaatacttatgattataagggttaaggagaatatctccttaagctgtcttagctgctagggaataagaccacatagatatcatacagatacatatttctcttacgcagatgctacattaaaaaccccctgttgacctaatatttgacaaatacaaacaataactcctaaaaatggactgaaagatttatgcaggaaagtataataacgtgaggtatgccttgaaagtagagatcatttatagtgaactcattggaggaattgaaatgctggctctgctaatctttgagtgacatatggtacaggaatgcagagtgataagctgcacgggtttgccaagctattgcaaatgaactccttttaaaatctaatgaatttcggacggcgtgtccttccgccgtcctggcaaagaaaaaaaactgcatgggtgaaacaatacacaattggatgatatgatacctcgtcagatttaagtttccgagaattcagattttcagaagggtcaccataaacttcaccaccatcactagtttgctctgaaggggatgatgttgagtcagaggatgcaggaccatcttccaaattcagacttgcagcaaaagatctccaatttgaacgtctgccagctattgggctaacaggatatgccatagttgtgaacttgcgacatcgtcttgagtttgtggaagctggaaaatagcatagaacccttctttgaatcctttgtttttcagacagagcttcgctcggacatatgagattatactcccttcccggattccttcaccaaaaacatcacctaaccatgttaaagtaatgataaaaggggggtaaaagaagaactatgcattctggatgtggtttcaacagggcatggggaattctgaaagtcgtacggggattaactaacttaccaagctaaaatcagattacggacaatatcaatagatcatacatacatgcttgtcatgttggagtattctatatctgaataataatattgcacaatcaagagaataacttacctagtaaaacttgtggtcagacactccatagctattttcctgaacaaaaataggaaataagatagatcaaaattacattttcatagcttccaatcgagaacattagccaaaacataagtctctcatacagtagcagataacagtatacacgaaaagaaaaaaaaacaactatgcaaaggaatcagtacagatacacggcagcaagaacctaaccccttctcttaaccacaaaccacaccagaactaacaattccctgccactccaccaatccaatccggaagagaatcccaaacctaagtgagccgcacacacgagccgagccgtatcaatcagaatcagttaggtggggggaaatcaaaccgaagacaagtgaagcgagcagcaacctcgcagcgaatgtggggggggggggggggggacaaggccaact

SEQ ID NO: 58944 - DNA, 6669 bp, Oryza sativa
atccaagtcatgagagaaatgtttttgatatctgcacggtcttgaaatgcaattttgaccactacggcttgaagaaatagctagagataccggttagtgtgccgagacaaaatcatgggatgaaggtagtaactagtaagtaaaaaatatatatataagattatttatagtgaggcttcattaagtcataaccaagactatcatagcctccaaatctccattcaataactggaacgagatatctgttcaaacaatgcatcataacagaataagaggaatggttcatctccctacacagaatgcagcaagaccagaatgtacatggtaggagcacagccttgcagcaaaactgcacgcgattgctggctcctgaacacttagctaggagaggtacagctacaccaaaagggttgcaacagatcacgcgataaactgctgggtgaaatcatcaacatgatgcagactcaaagtactgagaatagctgttccaccaggaactaaaaacccaaaacacggtctttgttgctttggctcctaaacaaggctgagttctttacagcagcaataagttgtacaccaccaaattcagtcttgattgtcaagaagaatgacttcaataacatgtagctgaagggtaattgttctgccaaggtagatgaagagcgacgccgttgctgctgctacttcgctgacacttcagcaggatgcccataatcatcaccttcacactgaagtagaaaattcaacgagagagattgtcagagatgatttcaacaacaaaaatgttagttagcatgcagtttcaaggtaaggtgtgcaaacaacaataatagcttgaaatatcgtaggcagagaatagaagtagtaatttcacataccagatcagcaagcatatcgattgtgagttctgtatcaaattcatgggccttcagtgcttcaacaatgaagtcggcagacacatctgggaacatctttgagagagattctaccacagcaagatgattatcaacaccattttgctcatactgtgatggatcaaacgcactgtttgtagcttctccttttgatgaagattctgcagaaatgttgagctttcctaggctttcagcatagtcatccaaagaaagggaatctgggagctcatattcagcagacttgtcagcattctcatccttttcagtatcacctacttgcttctcagaggcctttcttttgctcaagctttcttcaaatgaaggcctggggggaggcacaaagggagtggcgtttggattcaaccgagaagaccgctccattattggcactccagcagacctgttacatgtgcaaggaactcttggtaaaatgtgtacaaatagtgaagattcatcagatcataaactgcattttcatgtctgccaaactttgctgagaaattaacttattccacacagcatgcctactatgaggattactcaaccgaagaggcagtgcaaaaaaaaagtattactactatctaataagaaataactagctgagatatctctctgtctgcttcttctgtcacatagtagtttggtttccgtataagttaacgcacaaaagttgcagatcaccatataaaagttttccacaatactatgtccaaagtgatcaggtcctagataaagtattccaacaaccaaaaactgatctcatacttcaatcaaaaataacttgccatccagaaaactaaaccttggaattgggaacataaaacattttagctatgtacagtttaaaaaagctgtaggcaacagttcagtactattagtacttagtaaagatgacaccacagtccatatacatttttttttcttaacagtgcaatcttacataaaaatggtcaacaattagggacatgaatagtaatgaaaaacagggtaggcatagaacgacagcaaattgtaactgcaaccataataaaatagtttttaacatcctattgcctcgagctccaaatctgtcacccaacttcaaccaatagcctaatcacacatagttgcaacttgcaaggaacaagtgcaaaaatgtatttcacatccgcactccagtgcaaaaaagtgcacaaatgtattccacacccgcactccagcacaaagctaccataaggttcctagatatataatgcaacttgaacaaaacgaggatttcacttccttcctggtgacacccctacatattacacaccttcatttcagatttctcaacagacaggctgagaaattatagcaatgtctggcctacaaggcagcccgaggcacactgcaactcgatcaaccaaggcactaagcaaaggatgcgttacgcacgaaaaaacaacaggaaacatctagaaccagcaatcacgaagcatggaggagaccccaatcccccctccacagcatcaccaaccaacaacaactctaaaatactaggattcgcgcgaaatccagagcatcgaactccacccgcaaccacccaacactgcaacgtagcaggatacacccaggatcaaacaacaacaacccacaccacaaccacaggaggcggctcgcgtgggggatcgctcgcaagtgggacgaaggggagagagagagagagaggcgcgcgtgcgggcataccttgtcgtctccggcgacggccgcggcgggggaggggaggaggaaggcgcgacgaaaccctaggtcgccgcggctcgcctcgcgctcgcgcttgcctcgtcgtcggggaggatgaggaggagaggggaaagggaggaaacggggaacggaaggaggaggggggggggggggcccggccgcgaggagggaaacggtcgtggagcccgatcgacggctggagatcggcgcggttccccggatggacggtcgggatcgtctcttggtcccacaacgtgttagttacactttcaagttttttgggggcttctgctattgatggacagctttttctgggaaataggccgctttttggccgaatttaaatagtaaaaacctattttgctcttattacaatgatgatgagaaaagaaattacaaaagctactccctccatttctttcttttttgcgatgaaccaacgccaaatatttttgaacgaatggaataataaacaggtcaaatatgagtcaaacagaggataaacacatgtttgtattcgtaaaattttacgacttgattacactatccggatacatcgacttcttttgaaaaaaaaaatagtccgtcctatccaaaataaagttgttttagactcacgtagaagcaaagtaagaaattgataacggaagattccaaacaagctttttcccactcttatatgcatcgtttaatttcatgttccgtgcacgaagctgcaatggatgaacacctaccagaccacactgacagggattaaaaacttcggctaccaaacttctcaatcaagatctaaagattcttgctttcgttgctaagaatgatgacatatcataatcgcttacgggcagcattaaacagtcgcaggatagcgaaaaatctgcactcagaagtgccataaataatggtaaacagaaggcacacaagggaacacataatacatgaaagagttgcgacacaaagggttttctactctatccaagcaaattacttgcgccttgctaattgctgagcagaagcaaaattactagagccacattgtaagcagagagccattggccagcctgaaggctacacatatgttataattggcagccaggggaagaacaactcaaaacacctaagcctcaacagtggtcacttgctgccattcgccatcgacggcttctttccatagggtcacattatcattaccatcagacactgccagaatattcccagtcaatgaccaggataacctccacacaggtgtctggaaatcatagagaaccctgccttcccactgctcgccttctttcggtgctgtccagattacaaccgttccatcctgggaggcacttgcaattgttgactttgggaggcctagatttggagcccaggcaacatctctcacccagtccctgtgcatctgaagagccggaaagcaatccatcctccaactcccgttgtacagtttccataccttgactgtattgtcacaaccaccagaggcaagtttctgaacatattcaaactgaccggaaggccctgtattgattagagcacccggcgccattgcaggagcccaagaaacagaggtgacacccactgggtgagcctgatcgatgcgtgttgtgtcccacccaccatcagaacgagcagtgaagactgaaatgttgccatcagatgagccacaagccaagcacagcccaagctcatgaggtgcccaagcaatggaattgacagaggacttgtgctcaatgaaagtgtgcgcctgcgcccattcatcaggcttgctcccttccttccatatgataaccctcccatcatagctgcaggatgccagcaaggaaccatacttaggatgagcccatgcaacttgccagacagggccctgatgtccactcagagtagcaagctgctggtgagagttgccacttacaccaatgatctttattgtgttatcagaagaggctgtagcgatgcgcttcccatagtaatccatggcaatgtcatgcacaacatcctggtggcctgtctctatcttatggggaggcattgttccaatttataatctcctcaaatcagaagtatcccagccaactccaatgtattcacctcaggtaacctatttgataggaatagagaagctaagatcagatggggtacagatcaagtagatgaaaaatataaacggcgtgtctttcacatgtgcagctacggtgccacgcaacagacgcatcaaacagagaagcacattataaggaactaatatgttgtgcagcaaataaagtagcaggagttgatatgctagccagagttagaaaaatactgaaaaaccaacatgattagtatttttttatgagcattgcaaggcagaccttaattccccaaaatgctatcagctgtttacacaagcaggatgattcatctccgaataacccaagcgcaacgcacatcacgagcagattcaaaaagtaataataatttatttgacgaaatatgaacaaatctcgattgctcgtttatcccaacagcaaaacatcccacagaaacgcgaggattaagaggcgtcactgcgtaaatctcctattgctagttttgctacgctaaccacgcaaactctccccccaaaccgaatcctgactaaccctagcgcgcggcgtacgagggcgggagggaagaagaggaggatccgcacagagaccttgcggagaggagggagggcacctcaccgtgggccgagacgcaggggcggaggagagggagcgcgtcgacggcgagcgcggggatccggaggggagggaggcggagatcggaaggcggcggcggcggcggcggcggagatcggggggaggaggggagcgaaacgaaaggacgcgtcgcggcgtcggcgtactcgcgtttcgtgtgtctctagtcgcacgccttattttttccttcttttttttttacgcatggctcgtagtactagctagatcctttgacgtggctcgagcgcagctgcgtcgtccgatcttcatcgcacgagcgtgactgcttcgttccgttgtgtgcattctgagaaacttccaaccacacgatcacaatctaacggttcagattacatcgctacagtagcgtgtgctacaatatgtcggaggctagacaaatctgtcaccgttgctaggctattactgttggcattggagctctctcccgtattgcagactctgcattctattttcatttatcatgtttagaaattattatgtgtaaatatctttagtgataaactaagtcacaagaaaataaataataattatatactccatttgtttttaatagataacgccgttcacttttaatcacattttttaccatttatatttttaaaaattttatgtaaatgtataaaatataaatcatacttaaagtactttgagtgataaaacaagtcacaacaacataaattatgtaattacataaattttttgaataagacgaatgatcaaatgtgtgactaaaagttaacagtgacatttatttaaaaaaagaaggcagtatatttttaaattaatgaatagttaaatatagagtaaattttataaaactacatatactttgcatgatctatcacaaaactgcatatttaagaacttgtttcacaaaactacagatttagtgtctttgtttatcacaaaactacatgtattttgcataatatatcacataactacatatttaagaacttgtttcacagaactacatatttaatatcttcatttatcacaaaactataggtttagtgtcttcattatcacaaaactatatgttttagtattgttaaaacctattgtcggtgacatggggccgggggtatcatgactagaggcttaggtagccgcggtcacccacgtagcctgaccccctcaggggggggggtcgggcccgagggtgacgtggccacccctccctctgtctccccgagggctggggcgcccccgtttcggccccgagggctggggcgccccgaccccctgtggttttggcgccacgtgtgtgggttaggtga

SEQ ID NO: 58945 - DNA, 14725 bp, Oryza sativa
agttggtatgtcagtcccggtcaaatccattccaagcttcagcgcaagcatggcaaggaagtcgctggccattgaatgaaggttgaaatgggcgtccaccggaaaagctggcgagcggggcagaaggcgtgggctctgcttgtcagaggtcacttccggctgtagactagccctcattgtaaaaagcatgtttcctttcttaggcagctggaggcccatgtggtgacccctgaccagataaaaaggaggcccaggcctaggaggaaggaaaaagggggagaaagaggaaaaaaagaggaagaggagttgggactctggcgaatgggtgctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtaggggcgcgcgtgtctttctaagccctcgtcctctttcgtgtgcgccaagcttctcccgctcagcccaatggccgaacgggcagtggcgcacagcctctctccgagcgctagcggtgacgacggggagcggaacccgcgccgtcgggctcgcaccccaccgtccccctctcgccgaaatcttgggcggggggaggcgctcggggaggtcgaaggatccgcgacttcgccgcccgcgggcgacgggggaggacggcgagacggggcgcgtcgccgcctcgtctaccgcgatggcggcacgccccagggcgcgctccaggctgcgggcgcgctcctgcgtcacccgcccgtcgtccccgatccagagactccagcccgacgttggctggatgacgtggccgacttggtcatgacggcgcagcagcgcctaggcgccggcggtaggcgccggcgggcggtcctccgccaccgaggcctctggcgctgccgccgccggctccatgtcgtcgaggaggagggcgcggcgagcggcggccgttacccgccgttcgtccgccattccctcgtcaacgcctccgacccaagaagatgtgcgtggggggccggatgcccgcctcgatatcgagcaccggcgcgacgctcgtcgcgccgcccacgcaacggagggcgcttcctcgtccggagcgccacttcggtccggacacgggggccggccccccgtgtccccggttggcggtgccggctgtcgagcctttgtggagagccttcggaacgtccgttggcccccaaggttccggcccaccatcaccgaaaaatacgacggaagcgtcaaccccgccgagtttctccagatctacacgaccgggatcgaggctgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggttcgcaaggaggaggcctggacctggaactcctccggttctggtgtggcagctctggccgcccccgggtccgccgcacggtcagggcggcgggacaggaggaggaagaagaggtcggcccgttccaacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaaggccccggcggctcccgccggcaaccggcgaagtgaggccaagcagaaggccaccgccgaggacatcgaagatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctaaaacacggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcagcacctccgtcccggccgccccaaggcagcggaggtcacgtgcgacgaggtcccggtcaaggaggttgccctaggcgacggcccgtccaagaccacacgaatcggtggtcttctggacgacaaataggaagacgcgctcgtctccttcctgcgggcaaacgccgacgtcttcgcctagagaccggcggacatgcccggggtccccagggaggtgattgagcaccgtctcgccgtgcggccgggcgcaaggacggtccggcagaaagtgcggcggcaggccccggaacgtcaagccttcatccgcgaggaggtggcgcgacttctggaggccggattcatccgtgaggtcatccatccggagtggctagcgaacccggtcgtcgttcccaaggcgaatggcaagcttcggatgtgcatcgactacaccgaccttaacaaggcatgtcctaaggacccttaccccctgccacgcatagattagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatcttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcgccccggagccagatgagccgttgctactctacctggcggcaaccccgcaggtggtcaacgcggtgttggtcgtggagcacgacgaggacaaccctcactccgcgcatccccaccctgtgtcgactcgacccgggagacagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccaaggtcttcggcacagaagccgagtgcgccccgcgcggcctgtcggacgaagagcgccctggagatgcggcccctggcgaagacgatcggccccgccgaaaggtgcagcgggcccgtctacttcgttagcgaggccctccgggacgccaagacccgataccctcaggcccagaagatgctttacgctattctgatggcttcgaggaagttgcgccattatttccaagcgcatcgggtcacggtggttacgtcttaccccctcggccaaatcttgcataaccgagagggtactggacgggtggcgagatgggcaatcgaactctctgaattcgatttgctctttgaaccacaccacgcgatcaagagccaggccctcgccgactttgtggcgaagtggaccccagcttccgagcccgtctccgcccccgaggccagctcgggcccctcgcagctgcctcacaccgcctactggctgatgcagttcgacggctccctgtctcttcagggcgccggtgcgggggtcacgttgacctcgccgagcggagacgtcctcaggtacctggtccgcctcgactttcgggcgaccaacaatatggcggagtacgagggactccttgcgggactcagagtggcagctggactagggatccgccgcctcctggtgttaggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagacgggataacacggtcgccgacgaactctcaaggctcgcttcctcgcgagcccggaccccaccgggcgcctttgaagaaaggcttgcccagccgtcggcgcgacccgaccccctaggggagacggacgcgcctgaacggcccccgaggcccgtcggagtccaggcctcaggacccgaggggagcgctcccagctcccctagattgattgcttggatcactgagatccaggcgtaccttgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtcgccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggtgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcacgctaccagcagagcctgcggcgctaccatcagcgctacgtccgggcccgatcactctgcgtcgacgacctcgtcctacactgcgtccaaacacgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcatgtctcgggctcgggccaaccccgcaccccccccccccggggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacgggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcaagagcccttgttcaagccaagacacagaaggaccgcggcacagaccatcctcgtctcatacacacaacaaacagaactgacgcagaaatttcctctttacttgattgcagattaaatcagtctatacaagaagggggcccgaaggcctcagaagaagaaggaaaagttattaagattggcgggggcttgggggctcactccgacgcgcccgggtcgccggcctcgtcgtcgctgtcgtccgcagcatcgtcaccgccctcctcgtcggagtcgagcgcgaacgcgagccgaggggccgtaccctcgaagctgtggacgatgtggttggcggcgtcccagacctgcgcgcgcgcgccgtcctcggttccgggagggaactcttccagcgctgcccacggggagaagtcagggtccctggcctggtagcttgccagtacgagctccaccgcccccccgggtgaggtccctcgaggatgacttgatcgtctcctcgagctcctcggggagccgcttgagggccccggccatctctgagaggcgctgggcgaggcccccctggttggcggcgtacttcgcgtaccgcccgccccagaggcccgcctgccgcccggcgcggtctagacgggagacggcgtcccgaagcatgccgggccctacctcgctcgccaagcggagggcctcgacctccccggcggacgagtccagcacgccctgcatctcggcgatggtgtgttcggcggcagcgaggcgggcggctaggtcgccgtggcccgcggccgccccgccgctgtgcactctcgcgtccagctccttcgcccgcgcctcgagttcagcggcccgctcatccagtaaggccctctcggcgcgggcgccttccagattgcggcgcgcctgctcctcccgcgctgcctcgcggaggaacaagctgtccgccagccgctgcgccgcggcctcggcctcctcaagagctcgcccccgctcggtgagcgcgtcctcgcggaggcggagtgcggacccttctttggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcacgggcagcggcggcgtcaaggacaccccgggcagcgtcgagcttctcctctagctccgccgcccggcttccgtattggaggcggaggtcatcccgtgcctcgtcgagaacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccggccctcctcgacgcgcgcccacgccgcgtcgagctccgcccgctccgcctgcagggcctccatctgggcacttaacccgtccagcaccgtcctgttcgcggcggccaaggcctgcaggaggggctccgcgctcagtggggcagcggaaggcataggggagagccgcctcggtgtgggtgccgcgcggctcggcccgccgatcgacgtgccggactcgggggcgtcccccgaagctggctcgtcccaagcgtcgcccgaggggtcgggcccgagcagcgcgcccgcggcctcgtcgtgggtggcctcggaagtcgtcgtcgcctcgggcggagtcgggtcgggggcttggcaggccgcctggcgtgcgcgcgccgcctctgcctcccggacggactccccggcccggcggagtctagcctcctcccgagcggcctcctcagcctggcgaacccggacggcctcctgggcagcctcctcggcttcccggaggcggtctgcggcttctcgccggtcagcttcccgcctccgggcctccgcggtcgccgtctcctcggcctcagaccggccggacttggaatggcggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggctcggtccccccatcttgcggggccgtttcttctttcgctccccctcgggctgcggcgtcggcacggcaccctccgggcgcctactgctggcacgcaccaccccgccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggcctcggggggcccgctcccccgacgccccgaccacctgcatggtggccaggatgctggcgcgctctggatcgcagcaaagggggaggaccccttgggggatgagggatgcctccacggagctgagattcagcacccgttggaccaccatcctgaagtcctcagggtcccagtcccatttgcgcccctgatgggtcctcacgtagtcctcgggcccggtgtactcccaggcgccccgggtgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgacgggggctggctcggaagtcggaggcgcgcttcgtcggcgagaggggtgtagaaccaatcgctcttccagtcgtcccactttttgcggaggacgcaaggaatgtagcggttcagcacctgcccccgcggctggaagtagcagccaccgactaccgtcggcggcgacgccggttgtacggtgaagaaccaccggaacagccggagagatgggcgcacctcgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccagtggcagattccggcatgaatcggcgcggcagcccagcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaggaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggctgtggcggttgagatgggacagatcgtgcgcgcattaactacgctcgccaaccgcgaaaagcgccatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggttttctgcccgcctgtagggacctgccccacctatcaccgggcctaaggagtggcgtcacgcccgagcgcttccctcgaggggggcgatcgccctggcgtaacgccgggggctactgtcggtgacatggggccgggggtatcatgactagaggcttgggtagccgcggtcacccacgtggcctgaccccctcgggggggtcgggcccgagggtgacgtggccacccctccctctgtctccccgagggctggggcgcccccgtttcggccccgagggctggggcgccccgaccccctgtggttttggcgccacgtgtgtgggttagatgagcacagcggggctcacctaaccgcatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcaaatccattccaagcttcagcgcaagcatggcaaggaagtcgctggccattgaatgaaggttgaaatgggcgtccaccggaaaagctggcgagcggggcaggaggcgtgggctctgcttgtcagaggtcacttccggctgtagactagccctcattgtaaaaagcatgtttcctttcttaggcagctggaggcccatgtggtgacccctgaccagataaaaaggaggcccaggcctaggaggaaggaaaaagggggagaaagaggaaaaaaagaggaagaggagttgggactctggcgaatgggtgctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcatcagatcgagggcgaagaacctcacttagcgcccccggccgaaccggcaaaggggggcctgcgcggtctcccggtgaggagccccacgctccgtcacctatagttttgtgataatgaagactttcacaaaactacatgtttaatatcttcatttatcacaaaactgcaggtttagtgtcttcattatcacaaaactaagttttagtattgttaaaccctatagttttgtgataatagagacactgaatctataatcttatgataaatgaagatactaaatgtgtagttctatgatgaacgaatacactaaatatatagttttgtgaaagaagttcttaaatctatagttttatgatagattgtacaaaatatctatagttttgtgaaacaagctcataaatatgtagttttgtgataaattgtgtaaaatacctattgttttatgaaatttactcttaaatataaatatatgttcaaaatttgagtgcatcatctattagaaacataaaaaccggaaatagcatgtgtccgaatacagggtcgtgaacctactacacaaggtatccatgtacaggcgtacagcaaatatttgcatggttcaagtgagacaattcgtgacagaatcatcaaacaaactctgcaggcaaagaattcatgagcaaattgcatggcagctgtgctgcgcgcgtctataccaattagtattgctaacataacagtgaatatcttttcctttcagatactgtcacaaaaaccgatacagcttaatttgatagaatctactcatgtagctgaaatgaggaacaaaacttagctcagctcaaaatatttctagtgactatcattttcgaaagggaacaaatacagtctcctcataaatgtaatgtcatttttgaaagcgaacaaaagcagctcctagctgtgcctcacaaagggagagcgtttcaggattcaatttcttctgaaaccggtctttgaggttaagctttgtcactgtctgcaatactcgggtgcaaaatctccggacttcttgacgacgtgacttgttttctgggatctttgtaagaacttcttgtatcagctcgcacaactgagaaaggtgcttcttcaacaccttcgatgcactcgaatcatcaccagcccaagatttgagtatgcagtctaccaattctagcgtttgaactcttcgatattcagcttttgtgcatccaatcttctgcagaacaaatccaaagagctcctctcctacccaaggattcctccggacagcctccttcacaaacccaagcttcaaccgcgatttcttgttgttgaagtagtcggtcaatatatattggaacttttcgacaacactcgcaagctcctgtttcgaatgactctttgaattgatgatcttcagaagccaaaatgcagcattttgggctacagaagcaaccgtggtgtatcgtgaccgcgatgccaattttagagctttctccagcaaactttcaagagtactaatctctacaccatcacccttaggataatccttggctttgaatatccttttctgcaatataccacctatacgttgcttgaattgctcactgccatcagcactatgtgacttcacaaaagcttgcattaagaaagaatagacctccagcaccagattatttcctgtggagtttagggcatagaaggttacacaacatataacaaatgtaaatactacagttaaaactgaatgaaagctggaccatttcctaataaaaaaccttgcagtaacaattaattccctgatgtgattttggaggcagattttcggcaatgatcaatttttagagtatcctttgactattatatgcatgtatacaacttaaaatgaatgaaaatatgaaggaatatttgaaatgtacctgtattcctctgaagatatatctcaagtaatgtaaggacacggagcttgacccgcataagttgagattgcttagtttcactgccaggaaggttgcgctccttgaaaatcctcgcaatgtaaggatcaatgcggaacatagcatcatcatccataccatctgatcatctgagtcatccccatctttggtaacttctgcaccatctccatcctttgactcatgggcaactgattctttcaaatcatcttgaccttcatctacttcatcagctgaatcatcatccatttcctcatccagtccgtctgcagtagaatcagtgtccccaacctccgcgtcctccacaatggtttcatcatcatcttcaatgtcaacacatgcatcatcttcatcatcatcactacctgactggcgacgagaacctttcaaatctatcttcacaactctcaacatgtcaagaagccctgtttctgtaatttcatcacagaccacacggaagacctgttgattcaaataaaagaccaagttagcgcagccaagtcaaatgtttagcaagaaaagcaacaaataaccgccattaaacagaaacaagaaaggaaaatgagggcagcacaatctatatgtactggtgattttactatgtttgttatttcgactagtatgatagaaaatggctatttactaggattaaatttctgctagtacaattgaaaatggctgtttagaaaggagtgtatactagataatttaaaactgcatgcccctaatttatttcctattatcatcaacatacgattcttcaaaaatgga

SEQ ID NO: 58946 - DNA, 5157 bp, Oryza sativa
atcattattaagagtgcatcaaaacctttaaagaacatcaaggctaaattgaaattaattgctcaatctgggttttctaatacatctatataaggattttatgcaatatcctcgatactaatattagaattttgaactttgctaatccaaacagttagcatgagtatgcaatttatcactagcccactgtaccgcccaaaaattatgcttttcttcacaattttcattcatggtccaaaattctcgtggttattttggcgaattcaaagttataatagacagatacttgcactcaagtggacaagcactacgccactacctactattgcatcatccccctgaaaagtcatgtgttgccttttcatttatcttagatatctactatgaactaaggggcaaacatccattcttgatgcaaagaaactggcaggtgcattattcctaactatcgtcctttccttatttacatccaactctgcaaccatatctcacctatcatgaacaaatatctcatctttcatgaagctcctaagttcccaggtcctaaccccctacacggagacacaacagcaaatgctgtttcttgttgctgccaaagcagagaacactacaccctgattaccaactaagcaatagtcatccaatcagattgcagcagagagtcaccacccccttccacaaagcttcgatgtggcatatgaacaattgaaacaggatgcattcctcatccacaggaagggagatgatttgagcatgttaagctccacagcttagaaggttgtgagcataaaaatcaaaacacatttgatgcagtgatttataaggtaaccaatttacatatatgtaaggaaatggagatcagagttgcttaaaaagaacaaattaactagtcgaaatagcgtgaaggcaataacacaagagaagtaactagtatataccttgctcaataacaaatgagccccacatgaaggatcattagagaaaggaagtacacgattagagttttgaactgcatcgatcaaaagtaatacaactgcccaagcatttcaggaaagtggctgaggtaccttctgaatgctcatggtatcaacagaaagataaacagcagagcaagtaaaaatagcaaaggccagcatctatgctcttctccttataattatcatgggcagagtgattaagtcagattttagaccaacaaaaatgctataccctcaaggtcaaacttaataaattaagaagttggatccaaggtgcaatcaagatttgctatcagtagaatctgtcactgccaacgacatcagaaagacacggacaccagagcttctgacgactatacaagccaaaaactaaatggacgtgtcggaaggaacttagaacacatgagataaatttgacctaatgaattaatataataaaaagggacacaaaggtttgagctccaaacacgaaataggagaagtgcaccttcgtgaagcaagcaacagctaaaacctatcctgtgaaattgcatggtcagaatagccatagcccaccacaattgacaattctacagaataattcttttgccatggcacggtaagaatatattcaagcacttggaaagcacaagcagagcgggagaaaagatcatcctgttgcaaaataccaacaccagaagccacctaacagacagaaccaccaggaagcaaaattggaataaagcatcaaccaaatccacttgaaggcgagtgtttttatataaaaaataagagcaattctacggtccttgaggaccatgagatactaaaattttagtgtaaaatttggtatctcatggtaccttatagtacctaggtaccaagaggtaccaaatttacaatagaaaaaaggtacctcatggtatctcttcaaggaccgtaaaattgctcataaaataaacaaagagaaattttggataagaatagagctgcgcgatccttgtatccaagaatgaaaaacagtgtggcttttagcgaagaaacacacaagacaactattcttcgaaccaagaacccatcaaaatcataccggaaataagctttgcacattgtgaatgggaaagtgcatattttccctacaaggcccactaccacatcatgctacaaattgctcgagctagaaggggttgctccaattgctaatagcatcaaagaaaagctaaggttcttacttgctaccactgaatttgaaggaattgttctgctgtgccaccaccaccacctagaccaagggaggacacatggtaggaactaaaacaagcagacagattgccgtggaacttgaccaacggaagaaacatggctggcactaaatcaaacagtcagattgccttggaacttggaggcaatgccacacgtcatttttttaccgaaatttcagagcaaaagcggggaagctttagaccgagtaaactcccggcgcgaccaactgaacacacaccctacaagtcaaattcgatcgagttcacacccttcaaccactcaatcgcatcgaattctcgtgaaaaaaaaggccagaagaatccatgaaaatggcagagacgtgagcttccacccatcgtacagcctgtcaattgatcaacccggaatccgagaaacacgcgagggttaacagcatcaccagttcaccaccacacaactgacacgaggcgggcaggtgtgaacacgaacctcgttcctgagctgggcgtcgggcggcggcggcgagttgcgcgcagggacgcggatggcggcggggagcgcgaaggggcccgggaccacctcgagcccaccgtcgccgccagggtggcgcgccagggaagacgagcgcaagggctgataggcggaggcggtgcggccgcggcggcggcggagccatctgcggacgccgtcgacgacccctcccccggccatggtggtggcgctgctccggcgacgccaagcggcattgcggaggcggcggcggctgctcctcccccggggttttgtacgccgccgcggcggggaggaccgcgccggcgtctcgcgccctcgtcgtcgtgagaatcgactgattgactgacgagtcgtcgctgcggaaaaaatcggacggttttgggcgagtattaggctcatggacggatgcgattgacggagatgcctttctattatttttcttttttttaagaattatacggtataacgagacactcataacacacgcacactcgttcctatgaacgcacgcatgtaaactctaccactatgagtatctacgaatactagaccggtaaatccttaagattaacgaagtaaccacagacacttgctagatcaaagaaaaaaacatatttctaaaattaaacacaatttatgaatatagacatgcaaatgtgcaattgcaagcatgaaagacgtataatgatgtcatttacttctacatagataaataaatagacaacataatagcatctacttctgcacacaacgaacggacatacaaaatcctctggttaaacgaacagacaacggttagacgatcatcaatttgataatacctcaaaaatctcaagggataatcaaattggaatggagggaatttttttttctccatcacacaaaagaggtatggcacacttaccactagacatataacaccgcaccctttttttaaccaagcatgcaacattattagtttttattttgtatatgaaaagaaaatgattccctcgtttttatacgaagttaaatatttttgttttcaccaccaacttttagaaatttgtgcattaaaaaacatttcttatggccttatgatattaaactatatgattttctaaaatggatagtcaaatatataaatatttgacacgaaacaaatttagaatgacaagtaatttatagcaaggggaagtacatttttacttttttcttttacattcttattatgatccgcacaagttttaaatttgataggttatcttcgtaaacaaaaggttgtcaaatcttgagttagacttgatctaaagacaaatatcatccactgaaacttgattagcagacacaccactcagtaattctccataacaaatcgcattcaagcagactagcacgcacaaatccaaaggaaaataagccacgactaggagtcgggcgtgcatagaacggcagatgcccccatccttcaatcacaaactcagaacacgccaaaaacgtcaggggagccaaagccacttgggcacttggcttgacaatatccataacttacaaacattgctcgaattcctggcaaagaaatcgaatcaatgcttggtgttcatattgcctatacaaaatcagatcagggcaaaagcactagtgcacggaatctgcctatctggagacaagtagttcacccttggggagtttctcttggtggatgtacaaaattggcagcagctgattgggttgacacagcttcacgctgccgggatctgatgggtgcagcggtctatttcttcgctggggccttgtgaagcttatcaaagatgggatgtctcaggacttctttcgcagatggccgcctcactggatcaggatccatcatggactgaagacaagcagaaagagaatgttaagttgcatgtcggattgcctgttataggagagcagatgcttctgagaaacattatttgaatttgcaccttcagcctaccagctagtagctcatgtactcaaaggttggtacctcagtacgcaagatatttttgcataaaatgcatatgagagcacattatgcttaaatgcttagttgaaccaaaataacagttagtatcacacatgctacgagtgtgactagacgtgttgggaaaaagaacatgataacaaaacagaaagatttaaccaaagataaagttaactggaactaaaaggcagaacaaagtagtgacagaaatgataatcatacccaacaaaagaacatttcttgtcttaaccaactatatgctaaaaatagcaaattgtactagagcagattcagcaaatgactatttaggtgttgttgattttagaaagagatacagaaaggccaaaacaggccactaccatattctatagaaatcactttagtgtatcaaaagtgaccaattaatacttcctccgtttcataatgtaagtcattctagcattgcccacattcatatgg

SEQ ID NO: 58947 - DNA, 556 bp, Oryza sativa
ttgtacaacaggctggagaagctgcacatcttataaggatcactcatctggcccaagtccaacagccagctcctgcgataatgaaatctgagttacaaaccagatgtcccaacccactgacgtatcactacccttgagaggatgtcaactgcgactaatagactatcacattgtgtcagattctgctaaattgtccttagtcttgcctatgttctccccccaaaattaaaccgcagacctaatggattagaatagagcccatactttgtcatcgcacatggcaaagataaacagccatgccctacaaaatgtgtcatggatgggggtgacaaaagatgatagctcaatagctgatgctactcctgaggagttaagcagacattgatgtcaggtgaaggcctgtgccccatggactgtgagctgactggccacccaaccatggagaaacctgtggagcttgagctgttaaggctcatggcgccactggctgttgcactgtgctccattacaccggtgtgggcttgcggatgcatagatgagacctgcggcgcatggc

SEQ ID NO: 58948 - DNA, 1503 bp, Oryza sativa
ctttcagatctgtgggtatcaaaaccggatagagtcttctggtaagcagtagccaccaagtgctaagtgtcctacactcctactatgaactaagccatgtgaatggcacaacaactaaaggaaaggcataaacaaagaggtttttaaaagcaacctagtagcttgccaaatactgtcatgtttatcctttttaagtttttataattaagaaataggcttgacaaaacaggtttgtccattttcttaaaactataattagtccaatcattagccgcctgatgaagaatatgaggcccgtttgttgtgaagtcaattgaaacctttgtatctgtggaaggtggcttgatgtggacatgcaaaataacaaaaggtgatgcggtggccttctttcatcgaaatatatgtggcaatgttcatgtaaacattgatttaactttctttcctgtcttgttctcctcttgtttttcctatggaagcaccaatcatttgaccgtaaagagatctaggtaccatagcagcatggcaaactacacctctttgacagttccttttcgtccattttcttgttcgattagctttctaccttctgaaataaataaacgtatgccatagttaatcacctaattatcagtaaaatcccgatgatctcagtcgtgtggtctatagataaaacaaaaaactatagatgaaggaggaggtttggtagccttgcctcctcacctacagaaatggattagagagttgtatctattactctgtcttccgaaagcaaaaagcctttgtacctctccaattattgactcaagccacaaccaaaaaaccaggcttaagttattgaagaaaccagtttattatgtaaaataacagtttaagttactgtacataaacttgtttttcagatcgataattcattttaagcatatgtttttaccaaacctgagaatttttttttgtcagatcttgtgagttgtgagacatgtccacatgacctatggtactaggagagcccacctcatcactcaaaccatttcaggtgggcacaaaaaatcatttcagcaacatgtcctcagatttttttttccccttggatgaaaagctgtcgcccaccacgcagtgactagtgttgccaagaacagtgagcctgttgcaacttgcaaaagcttatctcaaccaccaacttagattgtcttcttgcagagactaactattaaatctcatcaccatgagacttcaccgagacactaactgaagaacaaattcagagtaaatgactctgtctcagcctctcaggatgaacagttaactgatctagccacagagagcaatcaattcttggctctgttcttagctagatctcgtgaaatccaggacttggggagttcagggtaaagaaaacggcagatgttttttcagcaatttcagctgaagcagagtagaagcagcagctagtataccttgggcggaggaaggattggttggcgtgggactaggccaggtggccaa

SEQ ID NO: 58949 - DNA, 3428 bp, Oryza sativa
  unsure (1)..(3428): unsure at all n locations
caaaacggaaataatccacatatccggcaatcatcactgttgccatcctgggatgcatgtgttgaagcagattctggattatttccgttttgggcagtttccagattctgtaaagcgtcgagctttttgcaagctggagcctttgagcctctagtcaatactgatcttgacccaacctccgcaaaagtactagaatccatctcatattccatttcttcactgtaaccttcccgttcttccagttcagtcttgagttcttctgaatcaatgacgtgatcacatagtagttgcaggatcctaagcttcagggtaacaggaagcttatagtactcaatggctaggacacttctaccaaatctccggcctcctagatctttaataatacccatgacatagaggtactctagcaagaaagctggccaagtcaatgaatctagtaatgtccagtctaaatacctggaattgattcaagagaagtgaaaaggtcagaattgaaataacaagatataaacactcatgagaacaatagtggaaggttgaagaccacatacttcaagcaatttgaagccagttttaatccttcagaagatttggtctcaagatgccgcctaagtgcccgcagtagtgagacatgaacagcatccaacaatgtattctgcgtggtgcaattaacggatgaaacaaaatcatccagcccaaatggactgaggaacagctgcacactaaacgatcgcaggaagttgtatacagaaaaaagataacttatggcctcctctggcacagcaatgtcccctgaagacggaggcaactccaggacctgaactggtggataatgctctactggcagttccttagtgcagtttgatgaattgcttgaagattcaacatcctcagaagcatccgagccagacccactctcttgcgactcatcaggcctagtggacacctcagattcattgaccctctgcctagtaattggtggccctttcacctcagtggcgccaccggatgaaactagcaagtccagcttcctcttccggcagctcaccttcatgccaaatgcaccattctcttcaccaacaagttgtgactggagctgagcaagctctaaatcctcaccctgcccatcctcaaacaccacactgtagatcccagtgctgccatcataggatgcaaccttcccaagaagaattcgaccatgcccagcgacactccggctgatgtaacggcccacaaggcactccccctcctccttcatctgacaaccatcggcaggagtcgtggtgggcttctgatccaccaccccgccctcacatccttccatctttacctcacttgccacagcagccaccgtatgcacttgctcttgaacgccgttctcatacacctcggtcttcacttggatcggggtgcacgccgccgcatcttgctccttgtccgggatactgcccccgttcacctccgccttcacctcccctgcagcaggcgccacggccgggtacgcgtccgccgtcccgacctcgtcgacgtccatcttcgtctcgctcaccggatgcgccgcagcacgctcgtgctcgaccgcgatgacgccttcgcccgccgcctcactcgcggggggcgccgaagcaggggggtcttccaccgccgccgacgccgacgcgatgccccctgcgatctccgtctcgcgcgcatcatctgccgtcgccggggccgcggcggccgcggcgggagaggcgtggagcatccgatcagaaacctncatgggctcctccatattctcggacacccccgaaaaccctaagcgagtgcggctacagaaagcccccgcatcgcgagatcacgagcccggagtcgagattccggcggggctcatccaccgggacccgaggcgccgcccgacgcagatgcgaagccgggcacactcgcgggctacgaatctggagagagagctaaggggaaaaacgcgcaaccccccacccgattccgcggcgagatccccgcgcgacgagcggaaccctacccgatgattggattcatccgccggcagcccctcgcgtggtcgcaaccctacgcggcggcggtggcggcggcggcggcggaaggcgaggaggcggaggagaggagatgggggaagaggagatgacacaggagaagggaagagaagggaagggaaggggagcgaggcgaaaaggaaagaagtgaaccgcacgagcgagaggctcgcacccgagcctggctcgcgtcggtcggtcggtccgtgccgcgctgtggaagcggagttcgggtccggtcggttgcgcccgacccgcgtggggagacgtggagcggtggtgggatagttgtgggggggaggtggatggaccgggtggtgggtgcggggaacgaacttacgaaccgacccgggtggcgacgtgtgggggcgtgacctgacctgacctggctcgaccgcgcggggaggagtagcgtagtacgggtgtccactactagtagcacacgcacgcacggcggcgagagcagaggcgagggcgaggaggaaaatggagggagatgtgggagggagggagggagagggtgatgcacttttcaaattcaaaagtgtggagggagtcagccaggccagggtggtcgctcgcgttggcgttggcgtttgcgtttgcgtttgcgtaggtggatggatggatggatggagaggggaataccggagcagtgtgtggcgtcgttttccccgggactccgcgaggcttttgctcgcaacacacttgtgcactgtgtggaggtgtacgggtgtgtgtgtgtttctcagcttgcgcgtctcctctccttggcttggccttgggctctccttgcacgcacgttgttgttacacggggagtatgtttttcaatgtgctcaggtgttacgatttacttttgtcgatggactgtacattgttgcgctatacttctaggtagctgtcgatcatgcatcttcacatgcaggtactaattgttttattgtctgtgcctccaggcttatggtttggtgtttgcaccccgaaacaacggtgatcaagattgtaataatgcaaaacagcaagaagcatcgttaattgcagccttccctgcaggcacgggttctgtagatcacgctaactgtcaggaagacgcgtaaaggcctacaggatgcttagtgctatagacatgaccgtgagtaatggatggaagtagtatcagatacagcaacattaactatacacatctgtcccaagttcattagacatcagtagtagcatattgacatggatcagtttagttcgagtcatgcggcaaaagaaaatcaaaatcattcgtcagatgcaacaggaaaacaaaattattcgtcaggtgccccagcgctgatcacaattcacaaaaaaaaaaaaaggtgcatccagcgaagcagcctgcatc

SEQ ID NO: 58950 - DNA, 2033 bp, Oryza sativa
ggacaaaaagagtcaatttttttcacatagcagatgctacaaattgcggtgacgtaatggtaacatacaaaatttctctaggaaacagtcaaggaccgatctgattgcaacaaaagtaaaaacaatcataatatttcatataaataacactgaactactgaaggtataccttagcaagcccggagaagttgatgggcagcaattcggaggaggcctcctgcccctggtcaggggtgagaacaacagtgccattcgcttcaagggagattgcagcctcactcttgttcaccacctgcaactccgggccgacagtgtcgagcatgacctgcgcaacaacgagaggactcccaaatgttagtagacagcaagactaactagtagatcatgaatgaattgtcaggagaactcacagcacagagcttcttggtggacttgatggcgagcttgaggttttcgagggtttcctggtggtactcagcgtctccccacgagaaatcgaacctggcaactgcaatttccgccacacacgaagaaaggattagattagaacagtgcgcaatgggtggaggtaagaggagatcgaagctggctgatccgttacccgacatgccggccttgaggcaggaggagatggtgtcgacggcgcgcgacttgggacccagcgtccccacgatcttggtcatcgccgggaaaaagctcttggaggcgaaattaattaagcgagttagggttccattcaatccaattccaaccagaaccaaaaccagcaaaaatctgaggcgaaatcatcgaaggcgaggaggaggaggaggtcttaccggcttggatggctccaggatggatgccatcctgatgggctcctccagcagcagattcgtcgaatgcatcttgcccctgttcgcttcgctcctcggatcagatcgggaggtagacgacgagcgtcagcggctgctcgatctcctcctcctccttcttcttctccaaggaatcaatcaatcaatcgaggcagcgaggcgtgtgggttgtgtgttcctagctttcacctctggaatccaatacaataacgaagacgcctttttatttgggagaagaaaaaaacgtggaatcgcagcatatgccttgcctgcctccagcaacacagttaatccgcgatgcgaaacggtggatgctgacatccgcgggtttggaccggtcccctccaccaccaccaccggtttcggccgcaccagggaatgatggcgtttggatctactcgctcggttcaaaaacatcttcactttggtttttatatctaacgtttaaccactagacttatttaaatattttataaaaaatatttaaaaaacataatttatacataaagtaattattcgtattttattgtctaatggcaacaaaatacttatcataaataatttttaaataagaaaaaggtcaaacgttgtatataaattcctacgaatgaacttatttttaaacggagggtgtatagtagatctttttttttttaaatttcaaaaaaactataactatagtgcaaaactatcagtttgcagcaatattaataacctattttcggtttgttgcaatgatattatacaaaattattacaaaactatacttttacgtggcccaagcttactgttatcacctacacatactacgcaaagttacagttttatgatgatttcctacggtataattacaacaaactgaaatatgatgctaatgttgcagcaaactaatagttttctcactataattacagtttttctaaaatttactttttttttctcagttatttgtaagtaattattacatttgagtttataatattagagacattttttattacatggtaaacgcatacgcacacacatcactacccggataacaccatacttacattctataaagaagccccctaattcatgcttaaaagacgaaaatcaacaatacattctttgatctcactaaatttataggacaaaaatagtaacgagaattctaatcgagattataaaaaccaaggg

SEQ ID NO: 58951 - DNA, 2275 bp, Oryza sativa
ccggttcgaggagatgagactgagaagtcaaacagttgagaataccacgagagactccagcagcagcagccgccagcgagacgtcgccgtccggccgccgcttgatgcgggcttcccttttcgacgcggccgtatcaaggaatccccatgacgccaagctctacgctattggtccaacttcatgaagaaattcttattgcacttaagaatttatcactcgtaatccctccgtactcgtaaagtcgtttataacagcgacacggtctccaaaacacaactttgacttcttttttctataaaaatatttattgaaaagtgatatatgtatacttttatgaaagtatttttcaagacaaatctattcatataatttttatattttcaaactcaacaacttaagtgttattcatgatttatattcccaaggtttgacttaaacattgtcctaaacgacttcctttataagtatggagagagtaacttataactcgtggaattcttatatattcatgatatgtggattcagtgataaatacttaattgtcattttaagagtgacaaatagcaaaatttctctttcttacgagcctcattcaatttctgttgttcttttcacggttcaattaaataattatttatgtactttataatcataatatgttttgtaattaaatttctatcataatcttatatttatcccctttttctgttttcttaatattgtgcttcgaaggaaccttaagttcccaacaactgatgtaatatactaccttgatctaaaagtcttcttcgtatttctttaattactaagaccaagaagaaactacctcatccgattaatactccatatttagcaaaattctcagcatacatgcaatggtgttggactgttggaggatggctggtcggttccgaaataaacttaattcattgttgctaaacaaagatatactctcttcattcaagtcttggatacatagaaattacaaataggaaaataaaatagtaagaaaaatttaggtggagggaatatatatttcactacaactagacatctcttgttagctgaagtaacaagtataaaaacagaccagaaccagtagtacttgttttttagataatagatttatattaaacccagcctatacacaagtagtacttgttagctgaagtaaccagtagtgcccatcttacagtgcagaccaaaatccataactctacaactaaacttggtagtcggctgcagtgaattacagaattgcgtcaaccgggacaggatgccggcaagatggggcagcactacggcagcgtgccgtgacagacaaacgtgctggctccattcatcatcagacaaacgtgtaagatcgggcagaaacgatcccaactggccaactatgcgttctatccagaggcagcagctgaaataatgcacatgctctgaaacagtcacagctactcacaatgctccccttgaatcgaaacagtcacgtttctcgcggattgtagtagaattatatatttacatcattcattgctggagctcctagctagatatgctcacctcataacctctctgtatgaaataccaagatagcatatcaccttggcaatacaggctaagctactacagatcagagcagagcggtgcagcttcctgccaaccaactctaaaatgttccaaaaatgtgtccactcactaggataactactattacctactcgttgggaagtgaatggatcagctgaggagcagcatcacccaagacactggatgaagctttgttctgtcctgatgagctgctggatttacttccctcttcaaattgtcaagttgtacttatttagctttcgccagccagctttcagtgttttggtgccaacaagaggtacattttgacctatcatagattgtcttttcaacaagaggttgtagacaagctcattccaggtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcattt

SEQ ID NO: 58952 - DNA, 2331 bp, Oryza sativa
  unsure (1)..(2331): unsure at all n locations
atgtatggagaatttggaatgcaaacaacacatgattacaaaagctggtctataatgagcttcagagaaagacaaacactaccagcacaaagtatatgccctttcccacttctacaagaattctctccaacactaaaacttgtgcaggtaaatagtatttgtgaactgcctcacgcaattagaatacaccctatattgtggctatctgtataccatagtaccatacctccattatggagattaggcttcagtatttgtttgaactggatgacgcccatcaacatcaagttgaaatatgttacactcaccaagttaaaatagaagatctaagacctgtttgtttactctagcatgatgataagtgttccattttactttccaactgcatgtgttgtataccgtgtttgtaagaactaagaacccaaaaacttgcatgttttactcccaaagaccagaacatgcaccttacaaacatcatggtcaaataagagcaatcaattgctaatgtaagtggataacagcagagaataaacattatccatgaataatttgagccttcagaaagtatttaatatatgttgcagaaacttgtttggatgaattacgacataatattgttattatatcataactgcaacataacttagctacgcgtactgatccaatgacaaagaagaaacaaaatgaaccagtaaacaataagagtaactattgcgtacctggtacagcagttccagggcttccccacatttcagcggctgatttctatccatggacaggcagcggtcacacagttccatttgaataaaaagctgtttgttctcaaaccaagaagtgaaatatccaacaatgttctcatggcaccctgctaagacatgtaacagatgttataaccatgtaagaaatatagctgaaaatgaggaggttatagttaattttgctacctaaggctgccaaagcttgaacttccttcactgcttgcctcctgcaatgagagagacaacatacaagtatgcaacattagtttttcatggttaataattaagcataacgactgctgcaaggctacctttccctgtcattatgcagttgcctgatactccgttttactgcatataagcagccatctatcctcttcagaactttgaacacaacactgaagtttcacgtccaatttgctgaaaatcaagtgtgctcataagcaaaaccaacataaaatggaagtgtataacctgacacagataaccaatacatattcaaactttcaaagcaaacctcaatctcatggaaatcagttcgatagcgtgaaaggccatcaccatcaacagaaggagaaaaccctgcatataaaaaatgtgtattgggagatgtaaggctacacggtactgacaaacagataaatgatagttttgaggggatgtatcgagatgattatgatacaatagcatacaatgcatcaaaatgctacctgatgatttgcattgtctcccaccaaaaacattatcatctatttgatgatctgtattgaggtatggattcctgatgcatggtggaggcatcacccggcagcgaagagccactgccgattgggagacataactacctctcttgtgcgaactagattccttcagctgttcctcctctgaatcatctagaccttcaaactgaactggagcaatccactggctatcaaaaatgtcattggagccaaggcctttgggggaacaatctgtaagcattggcacacatccaattatacagagaataaataaacaaagggagcatatcaaactagtataagtgaagtctcacctctcttgtatctcttgctcctacagactgatttctctggagaaatggggcaagggatattctnctgcagatgaaccacagaacggacaaaaaaaatcagcaaaaattaaagtaaagctcaatatccatttctaatcgatcaatctcgcatcccagaaactaaagcgccgcctttcccccaatacccccaaccttattggcgtcgaagccgctcccgagctgcggcgcatctggcgtgatgtaatccggggtactgcagaacagcaagcaaatagatgaagaaatagggttaatccaaccgcactccaccccctcaagcacacgaaagcacagctcggagccggatcgggaaccctaccagaagaaatcctggctgaggatgccactatccttctcctccacgacctcgtcggcgtccattggcgtggcctgcggctgcagcggaggtaggggcggaggcggggtcgggtccgggtcgcaggacccctcgagcagctcctcgaagggcgtgaagggggt

SEQ ID NO: 58953 - DNA, 14900 bp, Oryza sativa
  unsure (1)..(14900): unsure at all n locations
tttttctttctcgatttgggcgttggtcgcatgggccaaaatggcgccctttgtcacatttgtaaggcctgcgaaacgaaaaataattgggccacaatcccgggcccttctagggctttttcgggttaatccaaccccaagaaaattaagaaggattttgagagatataattctacacctatcatgtgtagaattatttcccctcaatcatttttccttaaggattaatccaacaaaggctatgaaaaaagagctagagtttcgcctgtcataaacaagggctaaccgtccgaagcattgttcggttatttagggattgcagggtttaaattatctctttaaatcccctaaattcttttgtggtttggattaaccgaataagatcttatgggtatttaggcccacatatcagggtcattatgagagcccaaacccatgatgtcgtcttatcgttttgagtacgtatcaaagataactaaggtgtgtttcatttttacatacgtaattgttatagaagtattatttaggccatagttctaaaaggattatctctaaaattttttatatcatactttctctgtctaaaatatactcccttcgttttacaatgtaagtcattctagtattttacatattcatattaatgttaataaatatgggaaatgctagaatgacttatattgtgaaacggatgaagtatatagtagcttaatagtaggtggggcatcatcaagtcctacgagtctagatagcatcctgcccggattgataacatttggaaagggtgaatagataacttttttaaagttatttattgtttgataacaattaatttatttgtatgagcaagctttgtctatctataatctacccaattatctggttagaacaccgttatcttctagtgtaactattttcaattactacataggatacgcatatgtagctattgggaaatcatgccataatcaggttttgcaaagtcgcacgattatcatgtgcggtaatcttctcagttcttaaaaccgtggtaatcctcacgacaaccacacggttttcacagtaatcgcggtaaccgtcttatcgtgggggtgacattaaccccatccaaaatagtttggtgaactccgatcgtaacgtaatttgtctgttcaaagagtaaagttttttttccttcatagaagatatactacttagctaccgtatgaatcaggttaaaaatccctgtttgggaaacatgggtttattccaagtccctgttacatcggatgtttgatactaatttggagtattaaacatgcattaattacaaaacccatttcataaccttgaactaattcgcgagacgaatcttttgagtctaattacgcaatgatttgacaatgtgatgctacaataaacttttcataattatagattaattaggcttaaaaaattcgtctcacagattagctctcatttatgaaattagttttttattagtctatacttaatactctaaattagcatctaaacatccgatgtgacatggaagttttaacccccatctacacaccaaccttcgtggggcaacatcgcagtgactctgcgtcaacgtagtaccggggtagaaacaaacacgtccgccgccgggcgccggccagaaaaccggtagaaaagggaaccgacgagacgagacgagacgacatccatccgcgcgtcggcacttgacattacacgcggacaccgacaccgcacccaccaaactgcccccagaattcgtcgtcaacctcaactctgcacacgtttatacgcccaaacacctgtattctgatgtattttaagcctcaatttaaaatagattattgactaaattattgttacgtattagtatctgctaaattgtagtgatagattatatattttggtaaacaaagttaaaaattaattcaggacaagtggcctaagcggaagaaagttaaaaaaaaagagtgtttgttgacttgtaaaaaaattagtccgtttcaataattcgataaatagtatgagaaaacaatacgcataaatttctaaacagccagctcccaaatactagttaggtagttgaagattatattagttgtagttgttaggtacatgcagcaacgtgctctcgaggaaaaagaatacatgcccgatcacatgaggaagcgtattattgtagtggtatctgtgattccatggcctgtacgttttctttttcctcctttctgtaatgcaaaaactcgcaggggcatgtgaacctgtcggtgatcactgctggtggatttttttttttagataatgtagcggtgatcactgctgatgatggatggatactatgactctataagcctcataggttacccattattattcctaacaagtcaagacgtcttattaataaataaaagctaacttgtaaataaaacttttatatatttgtccgtagcgatttagaaaccaacgctaaaaattatacattgaatcttaaaatcatgttcgaaaatttaaaaatttactcttgttctgacttattagaccgaccgatgtttcaagcacgatagaagaggggaatggatgatggatcattagccaattaacaacgttctatcagtcgccttaaatacctagcttagctctcaccatatctcgtgtacagtagtacgatcagacttatcagaattaatgctcaagactcttgacgacgatgtagcagtacaccatcattgttgttgttcttgacagcttaagctaccattaggttgaactgttgaagtactgaaccatcagatctgactaaagcagagtgaagcggcagacgcgtgtgtacgtaccatcccgtatacaagatcgtgtgtgtttatgtacttgattagtatcatctatctaaccttcgtttgttctgatgcacttatcctcttttaattctgatcaaatgcacggcaccaaatgtggcaggcaagcaactagagtacatcgactgtgcagatctaaaaggacggataagtggataaccttgtactgtacaatatataagatatatagaaaaagtttcagctaaacatctgggcctcctttgaatggaacgaacagataaatggaaaaaatatataaaattttgacagtaaatgcaaagcagatgattaaaaacacacggaaaaaaataatcgttcgaagaaaaccgtagaaatcgaatgagacgggaaattcaaatgaaatttgccaacacattagagattttgctagtttttctttcaaaatattaatataattgtctattacatagaatttttaaagtaatcgataggactcaatccgtgcgtttcaaatgtcctcgtagaaattttttacaggaatgaaatactcaaaaatatcatttattttttacaaatcaagcttgtctgaacattataggggacgaaggaacgcacaaattccgccattttattctgtcatgtctgatgattgatgaatgatgaagatcgaaacaagtgtgaaacagaagacaatctttcatacatccttcctattttgttccatacttccactcggtttgaatgaaaaggcactttttaaaagaaaaatatcctcccaaaatagtgccctctggtagcaactttattgactcgttattatctcccctaaattaatcacatgttaatcaccaaagtactggagtactttacttctattttgagatgactgatgcgatgcgaccaggtccgggatcatcacatccgatccgaccccaaccacaaagcatgttggttaacaactgaaacaaaactactttgccctatcattaacccttaattaatcatccccttttgtggccccgagaatttagattatttaccatcaaatttacatgactcaacttttttaccacccaatccgtatgtcttctataatatatcattaggagtactaattagtataattggtaccactttctcagtttttcaagtatttatcatttcttttctcaatttgtattctttttcaagttttgtggactgttttgcccctgggcccacctgtcaggtgaaagggtgatttttcctcctcaggatcgatcgatccctccagcctccaggcgtcgttcgccaccaaaccccgtcgccgagcgccgttcgccgtcaatcccgccgccgggcgccgacaaccccgccgttcgccaccacctggacgagcgccgccaaccaaccgccggcgggttctaggccatgcgccgagcgccaccagcgacgaccaccgtgcgccgagtgccgctcccagctcaacgcccccaacgccgagcgccggccgcaacgtcgagtgccgcgccacgaccccaacgccaagcgccaccacaccgttgccgcccccgccgacactgtgcaagatggaggcgatgagcagagctggatttgtgcaaagttgtagttttcagcaactggaagatcagatagttttcagcacctggatagtggcaagtctgtagttttttcttcagtgtttcttcagtagttttcggtggggatgctgcagttgaaattgaaattaacgaggtcagagtgtctaaagtcagaggcattgcaggcaaagtttctgggacatatgttcttatactgttagattccttttctatggacaatagagaatctgatgacaatgcagtgacactggaagctctagaaaattcaggtggaaacttctcaagattttcacataggaaggttcttgagatttaaccagctcttcatttcttgctagagcaagtggagaggctgatgattctgaaggttgtgaaggggagggcatgatcgatgtaagggaaacgctgatcatagccacctctccctctctcccttcaaaccctaggcagcacgggggagacgtgttcggccggggtggcggcgccaggttgcggtggccggcggcaatgctcagcagtggggtggcagcgctcggcggcggggtggtggtgcccggcggcggagtggtttctcgctctagttgacgcgctcagcgagacgtgtgttaacagtgaaatttggtaagcccggagtagtcatcggcttagagccaacatcggcttcaaagtccagagattagccgatgagaattgtcaagtcgtcagttgtcggattcttgctatatttggttaaggaaattgatctactaaaggaagcttatccagaagagaccgaggtcaaagagaatgcggcatggaaagttatttattaattaggaatagtttgttagtttccttttatgtttaggaaaatgtgtttagtgtcctataaggactttatcttttccttttatctttaggaaagtttctttcttgtccggcaaagacttgtatcaacccatgggtataaatatgtacacccagggtccatgtaatctatcaattacgatcaatagaattcggcgcatcgccaccttttaccttttctgctttattttatcgtccagcgggacttggcacctgacgcggggttgcatcggtgttcgatctccggcgaagggataagtccaatgttccgtcggtccaggcaattgtattgtctacgtcggcgtcgttcaaggctgcatcagtacattcgacctcttggattgctctggtttggatgatatatttgcctacctatttatcatatgtctatgttaatctagtcttagcatatcaatttagctctatcggctgcttctcgttttagggtttctgccggtattggctaaatcgtgttgctatattagattagccaagacatctaccaccctgaaaatcagtcaacggcttgattgtctagatattgtgcttctttttatacttagtgctgcatcagttgagcttgatctactaagtcgtgcttagaaccataatctctagcctgctttttgactgccaataagggtttcatcggggtttcagctgatgagttatttggacgttgcatcggctcataaggattgcatatacatatgagttgcatctagccgatgacaacaaaggtttcacttattaatctaatcttgtggatttcatgacatcggacctccagccgatatgtgctttagtcttcggatcaatgcttattccatcatatcattatagccgattggtttatactggactatattattgttatattttattatcaacaaccgattgcctttacatcatcatctacattggacatatagccgattgcttacaccttatcgctatcggctggtatcggcatcggctattatcggctatcggctggaactactccatcggcttatcagccgatcggctgttttgatctactatttgcatatattgtcagttgcaggatcaaactgactggcacgcccgcatctcattaatctttggacctgcacaggagctaagcagatctcccagaccggtgtgttcgattttttcatcaacaacgacgagacagagagattgatcgatccagactcagagatatatctcaccctttcacctgataggtgggcccagggggcaaaacagtccacaaaatttgaaaaagaatacaaattgagaaaagaaatgataattacttgaaaaactgagaaagtggtaccaattagactaattagcacttctaatgacatattataaaaaaacatgcggattaggtggtaaaaaagttgaggagtacgaatttgatggtaaatagtataaattctcgtgggccccacaacccagcttcctccgcctcctcggccggagcgagccggccggccggccggcgagccgccgctcgtctccgccgtcggtggtaggtagccaagccaagccacgctgtcaccgaggcggtcaacgagacgacgtggccaccaacgcgcttccccccactgcctctgctgacacatgcggcggctgctaattactgggattattacttggtaaaccctgctactgcctccgtcacacaatataaaagattatgtttttttcttaataaattaacaaagtagtaaaagaacatgttatagtataaattgtgatggatgagagaataaaatatataagatttgatagatgaagaacaaattagcgcaccttccgtaaaaaaagaaaaatctagaattagatattagggtacgaatctaaacatgtgtatatctaggccctgtttagatgggactaaaacttttaagtctctatcacatcggatgtttggacactaattataaatattaaacgtagactattaataaaacccatccataatcttagactaattcgcgagacgaatcttttgagcctaattaatacatgattagcctatgtgatgctacagtaaacattctctaattatggattaattaggcttaaaaaaattgtatcgcgaattagctttcatttatgtaattagttttgtaagtagtctatatttaatactctaaattagtgtttaaatacagggactaaagttaagtccctggatccaaacaccaccccaaattcgtagtattagaatgtgtcacattcggtacagattgattttttatggggtaaatattattgaatcgtactaccaatttcctaccacggtatagatgaagtacaaagttgatatttcctcccacgaaaaacaaactatattttctaatacaacgaatctagatagtgtactagaaaatatcatatctaatattatattattttttttatagtacagaacgagaacgagtatgtgtgataaatgggaaataaagtatcgtcttaggatcagaaatctctttaggagtattatgaatggagtactaacctcgccgttaattgcataataatctggacaagtgatgcctaattaagccatagtttaatcggcaatttgcttcagatccagctcggcatgagactatcagaggcataagtgtcaaagcatctctcgagtctcgagtcttcccttctcagccagcttcgcctcgctcgctagctatccatctcttcctcctcttcttctcccttcccttgtttgcttggaaggagagggggaagaaaagtaggaggacgcggttgcgggttggtccagatctagggcaaggcggtggccggagtttgagctgggcccgccggcggcgagatgaagcagtcgatgcggagccggcaggagccgcggcgggtgagcaacggcgtcatcatcgccgccatgctgctctccctctgcgtcctcagcatcgtcaaggccagatactgctccacccccttcggtacgctccgcctccgccgtggcggcgcggcgctcttcttcctcctcctcctcttgatttgtgagttgggagtgtgaaatttggttgggtgatgtgcagttaagcccgacgaccagctacaggagcagatgaactccagcatcaggatggagaccgacgagccggcgaccatggcggcgggaggttcgtcctcgccctcgctagctctccggattgtgtgtgatttgtgctcaacgagtgcgttcttgaatttgcagagcaagaggaggacgaggaggaggagagctctggcggtggcggcgctgagcctgaggtcagcgccacccctgccgtcgtggtcaccgccgcagccggcggcggcggcggcaagaggaagccgacctgccgcatgacgagcaagcggtcggagcggtgcgaggcgagaggggacattcgtgtggaggggaacgcgtccaccatctacatcggcgggatcgacaaggagtggaagacgaagccgtacgcgcggtaccacgaccccgtcgccatggccgtcgtccgcgagttcaccctcaagccggtcaccgagtcgtcgccggcgtgcaccaggaaccactcggtcccggccttcgtcttctccaacggcggcttctccggcaacctgtaccacgactacaccgacgtgctcgtgccgctgttcctcagcacccaccagttcaagggccaggtgcagttcttgctcagtgggctcaagccatggtgggtgaacaagttcaacctcttcttcaggcagctcaccaagtacgacatcctcgacatcgacaacgacaaggacgtgcactgcttcccccggatcgtggtcggcgccaccttccacaaggacatgggcgtggaccccaagcgctcgccggggcacgtctcggtggtggacttcaagcgcgcgctccgccgcgccttcgggctggagcgcgtcgcggcgtcccgaggcggcgccacggggaacggcaagccacggttgctaatcatttcccgcaagaactcgcggcggttcctcaatgagcgggagatggcgcaggccgctgccgctgtgggcttcgaggtgcgcattgccgagcccgatcagcacaccgacatgtccacattcgcccagctcgtcaattccgccgatgtcatgatcggtgtccatggtgctgggctcaccaacatggtgttcctcccccgcggcgccgtcctcatccaggtggtgccattcggcggcctagagtggctcaccactgtcaccttcaagaatccggcgaaagacatggaggtcacctacatggattacaatgtgcagctggaggagagctcgctgatcgatcagtacccgcgcaatcaccaggtgctcactgatccctacgccgtgcacaagcaaggctgggacgcgctcaagacggcgtacctggacaagcagaacatcaagatggacatggacaggttcaagaagacattgcaggaggcgctcgacaggttgccgccagcatgagagcttgatgaactgatgaaagctcaagcccacgaggtggtggtggtggtggtggtagatagataggttggtgtatctatctgtgccttctcttgcttaacttatttttccttttgaaattctttttacgccttcttcttcctttagcaacattcatttgatctgttgttttggaaaagaaaaaaagaggatgaacaagaacatcatgttacatatgcctagctgatgagtaatttataccctttgtgattattaattggttgtttatttacaagtaaatgtcaagatacaaaattgtggattactagtaagtatcaaatgtgagtgtacctccctctaatgccaggggggcaaactgtattctcctatgccttcttcattgtatcaattcaattcatttcatccagtacattgcctctaccaaaccatgccaaaattgacctttcctctgcaaatgaaccacgattttcaacatataaacgaactacatttgatcttccattgtctcattagtcattgcacaacaaattagtagagtgatcagtcattgatgctagaacagtggatcaaaggttccatgttcagtttggcagatgattagtgccataattgggggataaataggccatgaacaggaccaggattctccctggattcaactaacacaatgagaatgaaatggaccaccattggccattgcctaccacaactacctgtcatggtggcattgcataagcaatggaaatatttcaactttgtcagttcctttctcttgtgaatcctttggtttgggaagagatgagcttccttcctgctctgaccggatcacagcaagccaaattcatagtctgattggcatgatgatatatcagaaaaagagagaattttttggccaacgaaggtttggctgatctgctcggccttagtcaaatctgtctctttcgacgaactgcgttgcgttgctaatttgtcactgatgacaactacttctacctgccatctcatatgtgagcctgtcagaaacatggagtgatatgctagtaggaacactagaagcttccttctgtttcctgtagggaagaactgaagaatggtcagcacatcgtcgaccgtcggatcttgatcagatggtatccgcgacgcgggacccagccatcagtggttgggactaggaattttgcccaattgcaatttggcatgatgaatgtgttgtcctttgtgaaattttctaaaggcaagcagggtttgtacttgtgtgagatgtgaaattgattgggtaataattgacttgttcatggatgattgagttttaatgggagagtgattgcaggatgaattacaagttatcggtcatatgtgatggtaggtaaattgacagggacaacacaagctgaagctgaagaaagaagaagagaacttgttcaggtcagcaactagcttgtacttgacactgaattatgaatgtgctggagcttgctgatggctaaggtgatggcattgtgaaattaaccagctggccagttgatttgcagctgaaataatcaatctctctcgtcagcatttgttgcttgtaagcaaaaatcaaccaccgacaaacaatatggaggcactgttcttgcaaaatccttttggcacaggccgggctttggagcttacccttggccggttttgaatcaacatgaattccagtcgaatttattcggaattggattagttagttccgacgttttttttttataaaaggaatcgagtagaattcagatagccatcctatattgattctcgggataatggagccatggactatactcccttcctgtcaaaataaattcactcttatacacaaatctgattagattcgtacataagagttgatttattttagtacataaaggatttccttttgaatgtgtgaaccatttgtcggtgtctgcttgagtacgaatagtgagtggctcatcatactcaagcacgatgacctcttaaacaaaagagcacgacgagacgatgcttgggatggcgttgaattgatgaattatacatccggaatggaaatgccgtcgtcggagaagcacacgaaagatgacatcagcattcccggccggtttccgccgccgccgtctcgccggcggcaagccgtcgtccgtccatacgccaccaacctcaatgactcgccgtcgtcaatccatcgcgtcgctttcacaacccaaccagtccaaaaaatccaaatgtccagaactgtacggccgcgttaaggcagaaacggatgattagccacacatacaacgaaagatatgattagcatataattaattgtgtactcctattaattattaaaaagtaaaaaaaataagtttatttttaagcgattttttatatagataaaacttgcacaaaatgtataaaatatatcatttagtaatcccttcgatccaaaagaatcaatccagattcatagccagagtttaattctttttaaaatgagtgaagtaatttaaaaaacatgctaatgaaaattgaggaagtagtcaatccgatcttcactgtaaaacggggcctactggttaggcaactacccaccaccatcatccatccaggactgcaatttctcaaattttcccacgtaatttatttaaagaccatagaaaagtttgtttaaagaagtttagtaagtactgtttagtaatgttgatgaagagagtttttgcaaaaaatgagctttgtaagggtgataacggtaatccgtaatctgacagctaaaagtaacacatccttatcagagaaattaaagatgttttcttttgtttggtcaagatgaagtttcgttagatgaaaaaggaggcagcatgcaacacaagttgaaagttcatccgaggaatcaagccaaataaataaataaaataaaataaaagcatcaaagcaaagtgaaaactgatgcgtgacttgtgaactgatcaaggcaggagcccaaggaggaaagggaagacacaaggaagtgcagccagggtggttcgacttcaactggtttccatatcccaggacaatgaccaggcaacaacctaaccatgctatccagctaattactccctctgtcttaaaatataagaagttttagagttgaatacgattattaagaaaagtaggtataaatgagtggtggaggattgtgattggataaatagtgnaggtagatgagaaaagtgaatgatgtagggttgtgattggttggaaagagaatgctagtgaaaaagttgttatattttgagacaaattctgatggttaaaaattgttatattttgggacggagggagtatttccttcatgctatttccatttttcctttttcgcgcaaacatcatcacacatgcacacacatcggtttacacacgctcaatagaataactttaataacagaattattgatccccttgattttatagaaaaacatgtatccataactcagtggagtcgtatatctaggagaatgattctctaacctcatacaaagtctgagaaatctcattcaccctttttgctctctcctcgctcccaatagaggtctttttttttttgggggggggggtgttgtctagatatacccataactccctttatcgcacatatacgagatgtatctctcgttccaagaatatattttctataattgatgatctcccattcttgtatatactatcagagcacagttatgtcaattaatatgcatagcccatgcatatattaagcaagatctgtatgcatcccatgaataatacaacccatatgtgtacctcataatacctccaacacagctattatcacaaaagacatgccaatgtgatggcttattaaacccaataattttgtgatggcatgttaacaattaagattccatccatccatccatccatccatccatcaaaatcaatgagtcggttcgttggtagatggtgatctaatgacaagccccatactaccgaccacctctgcgtcctcatatgcctaacaactgatgatgcttcgaattggttatggctaaagatgaccaatggcatagcatggaccgttctttttgcatcctatggattctggagacgatgacactcacaataccaaataccaaatgcaggttaaccatattaaactacgcttattgcgacgtgcaaacaactctggttgcatcagcagttttgcccctactgcttggaacacatatggttcttgcagggttaagaattataatacaaaggaatatactgcttttaaagattgttgaaatttatgtttgaacctgataaacatttgtcattttcatagagatttctacatttgaaacacaagaaaaaaaaagccttgtgctttcatgcttccagcacacgaagaacatcattcagattactcccttgatttcaccacttttgtaatgcttttgctatctatgcgtacatgacaaacacaaccttgcaaatcaaagcagacaaaagcaacgatcagaagctgcaaagcagctagtgatagggagctggatggctgccttttattattctctagaatcaattctattagtagtactgttcttattaaaagaaaaaagaggctccagccacacgatttttaggaccagctagctagcatcaagaattaaattacaatgatctagggatggcatcagtcagatactgatatcagtgctgaaacagctcccaagttagaaagtttcaagtaaatggattctacacaaacagcaacggcgtttcacataagctcaggaaagttcctccgttcaaaagcatcggataagcgcagtacaattctcccatcaattcagtaaaaaccgtactagttttcagtttatcagcatctcttttatcaattctgtaaccttgggagagtacgtctcctccaaaactcatctatttgcaatatctgcagttcccattactagaaggaacccaacagatcattctctttttattattttcgcgccttatttagagaggatcttctcaggcagatttaagctccatatttaggagctttccagagcttaaatgccacctcatgtagaaagcgttcagcaagcatagcaagatttccaccacgctgttgattaaatagcagaatgaaattagttatacagttatactcctccgagacaaccatattaaacgg

SEQ ID NO: 58954 - DNA, 898 bp, Oryza sativa
gccagagaaggaggaagccggcgagcgcggcagctccactccgtcggctgcttcggccgccccgcgctccgcccgcgatgcccagcagaaaagaggatgaggcagcgggaaacattgtgtttatctgcatgataaacaacaattgtttatccttatatttcatcttgctagtgggaatttgatcctgacagtttagctttgaccatcaaatcaattgttgtttcagcaaatcgagcttggagtgcagcgacgcgccgaagtcgccgtctgacaccggttcggggtcgtccgccgccgctgcgccgcgcgggcgcttggggtcacggcggtagtcggcgtagtcgtcgacgaggcggtcgagcacgtggtgtgcctcgcggagcttcttggcgaaggcgaggatcgatgcgtccttggcgcgcgtctcacgggcaaggcgggcgcgcgcgtcctgcaggtcgagggtctcctgcagctcggcgacggcctcgaaaaactgcatctggagcgtgttgagcagcgacaacgcttcttggtgtaggagagtcgccttcttggtgtaggagatcggggccgggagtggcggcggagaggagagtggagatggggagagagaggaggaagaagaagagggggggtgagaatgacatatggggcctacgtgggtcccacctttttgaattaatttgtgtgaaagtgacgtgtgggtcccatggggtttattattatttttagatcgaattgccacgtaaccgccacgtcaatgacacgttagatgaagaccgagtcaatagcacgtaggcgccacgtcagccaaaaccaccgtccaaaccgttaagggacctaatgtgcactggttttgacatttgagggacgtgttgaatctggttttctagtt

SEQ ID NO: 58955 - DNA, 4306 bp, Oryza sativa
agaagaagagggagagaaaaaggaggaagatggtgtatcagatactgacgtgtggtcctagtaagtgtagatggagatgttgttaaagcgataaatgagtttggcttgataaattatttgaagagctggttaagtgtttgaagagtccgatttagaaatgttgttggagatgctattagttcttaaaaaaaaaactactgttgcaagaactgcagctagtaggcacatcatcgcacgatgcattgcaggcgacgtcatctgctgcactcgagtgaacccaagtcttatcgatcccccgtcccatctacgagatcatcatgcatctctctgccgcacacagcttaaattaatcactcttgtgacatgcatttactcgatcgtgctatttccaatttcccaagctctatccacctcaaccaacacaattgatattgagtgtgactgatagactgtttctcctctttaaaaccattgggggggttaatgcactgtcaaatgacaaataaatgcacattgtacgacgaatatataactatcatattggtattggtaggttgtgtctcttttgggctgaaatacaattataaaacaaagaactgtataacataaaaaataaccacaagaatggttgttttaatactttatccgtcctaatacaagtgcacatagtataggagtaaaaaacattgtaccaaaagtttgggtttagatttttctgaaagttcactctctctttttttccctgaaaatatggaagtaaatttgggaaattatgtgggtgtagggagaaacccagatgaagataatgaccacatatatatctagaagttttggtaattctaaaatttttcacactaaaagatcatatcagaatttggtaaggcttaaaatcaaatgtatccaacctactaaaatttaataacactaaaatgtattaaatcatgattatggttcaaaggtgaataagtccttataattataaaattataagggtgatcaacaaacatattgttggtcagaaaacagaaaaccacttgggccacacgtgcgggctgcactgaggaagtagtttcctctttttctcaatctcaggaccaagttgtagagaagatatagattaaaagttgcattaaaccaggatcacactaacaaactacgtcatgtactcctcatcaaacacgataagactcttcatcaaacacgataagactcttctaacataactactccctacgtcccattttaagtgcaacaataaatttccacgcttaacttttagtccgtattattttttataattagtatttttattattatgatatgataaatcatgaatagtactttatacgtgacttatgcttttaatatttttaaaaagtttttcaaataagatggacggataaagttgtgcatggaaaatcatggctgcacttaaaatgtgattgaggagtatatactttctccatctaaaaaacttaatctagatgaagatgtcaccctcatactataacaaatctggacaaccactatccaatttcattagaggtggtgtttgaatctcctgaagataaaaataaagataaagattaagtgtttaacgtaaaacgaggtcgtaataacgtgtgatttatttagttttaattattacaaacttgaaaaatagattagtctgatattttagagcaactttcatatagaaagttttcacacgaaacacaccgtttagtagtttaaaaagcatgtcacgaatatccaaaatttaatcctgtgcttacaatagaaacgaataagacctaaacatcatagattaagttttttttttaagtacggagggtctaagtcagatagacgtgtgtctctaaccccgcaggattcacctcagtttctcgccaaggcatgattatccagtcaaagtataatactcgtccctaatcgattttaaatcgaactactactactccgcaaaaacaaggctcaattagtagcaaaatgtttatcaggtaggcagcctactatgccacctaacctaccgtcgccacccttcctcttcttttttttttttgaacggtcacccttcctattctcaaccaacgtagaacaaacttaaaccaccttgatcgcattcgcattccatcgccatcgatcgatcgcctcctccgcacgcgcaacggcaagccggcgagctatatatactacatgccactactagcaccatgaaattggcaatggcaggaggcgacggagtgaagggcgccgccgccgtcgtcttcgttgacgacgacgacgacgagctgttcgacatcgacatcgccttgctcgaccgccactattaccaccaacgacgacgcgacgacgacgatgaagctgaagacaaagatggcggcggcggcgacgctcttcttgccaactgcctcctgccggtgagctcggtgagcaaggcggtgcccgtgacggcgacgacggcggcgagctcgtcgtcagcctctaccttccttccgcccgtccggtacggcggctccaggagtatgctcctcttcaacggccccggcggcggagggaggaggctagtgcggagaggcagcaactcgtcggcgaggttttggctcgccgcgagaggactcgacgccgccatgggaaactttcagaggtactagaggtcagctgaaacgaacagaatcgaacaagtcaacgagtcaacttgtggagcccagtggtatatggcccttgtgggcccaattaccgcaggcccataaaggttcggtttagtagcacaaaagggcctgtatttttatttgggaataagttcactttaggtccctctatttatcgctcagtctgattttcatccctaaaccgcaaaaccgggtacgactcatccccaacttacgaaaaccgggcaaacgaggtccctcggtggttttgatagtggttttggctgacgtggcgcatacgtggctaatttgactcggtcttcatctgacgtgacgcttacatggcaatttgatcttaaaaaaataataaaactagtgggacccacatgtcagtttcacacacaaatagaggaaaaaatggtgggacccacgtaggccccatatgtcatcctcactcctctctctatcctctctctcccctcttctctctatcccttctctctctccggccgatggagcagggcgggcgacgggcggggcgggacgtggccgacggcgggtcaggtcgcggcgcgccagccattctcccgcagcgcctccttcttcgcggggagggcggcgaatctcccccatcgtctttcggattgccggcggcggcggtagctagccccgcccccgtggtgaggtccgtcccgccggatagcttgcgctcggtgctccaggacttggtgtccgacgagtaggaccggcacgccgtgaagctacgacgcttgtagaggaccaataggcggaaggcggcgggacccggtgggagcggatcggcggagtcctggagatcgtcggcggtgagcagcgcgcacgcgtagagcccgggcctgtccttcccggagaggacggggaggaggatggccatttcaccggtcatggggttgcacacgacgagcttaatgttagttaaatcttgcatgcatgtagctactaagtgttagctatgggtttcaattctgttattgcattgtgcatgagcttccggtctatggatgccatgcatgtagtggtagtcgtgccgaccttggcgatcggaggcgtgagcacgttgttaggatcgtggggatggacatgattgtaccgcgacgtgggaacgcatccaatgcgctcacctgcataatgaaagggagagagaaaaccagaaaaggtgcagcttcatcgcaccacaaaactcagcgtgtttcctcgtggtcgcgtgtgtttccacagcttgttcgtcgatcacttagggaaacctgtcacttaagggcggcggagctcgacgacgaggcggcctttccgtgatgcgacgaggcgggagttcttgaagaggccggggttgtcaaacaccctgtcaagctcgccgccgccgaacctggaggaggccgagggcaacgggatgaaccgaggcagcgcgaccgaggaagacgagtcgtcctcgtgggtctggtggaagaagtcgacggcgaggtcccggatgaggtggctggaggccggcatggagcggcagatgtacaccgcgttgccggtgaggtggtgacaaggcggcgccaccgcctacaagtggcgcggtgcaccgcacgagatcgtgaagatccagcgagctaagccgaaacacgaggaggagg

SEQ ID NO: 58956 - DNA, 3407 bp, Oryza sativa
gccctgttccatcggccggaaagagaagggatagagagaagaggggagagaggatagagagaagaagaagtgaggatgacatgtggggcccacgtgggtcccaccatttttcctctatttgggtgtgaaactgatatgtgggtcccactggttttattttttttcggatcaacttgccacgtaagcgccacgtcagtgtcacgtcagatgaagactgagtcaaattagccacgtaggcgacacgtcagctaaaaccgctatcaaaaccgccgagagaccttgtttgcctggttttcataagttgggggatgggtcgtacccagtttcgccgggccgaatgggcttgtatttgtaataaactcaaatgtgtcctatctaaggaataagttcatccgaggtcccttaacttgtcaacgaatccgattttcgtccttgaattttagaaatagaatcgaatagcaactgcagcaagcagtttccaatccctgtgaagtcgtggagactggagaggggggaaggagaaaatggcgacgtgctaaccgttcgcttccggaagctggcggccgaccagatcaagggcgcccgacgccgatgacgccctcctctatggcgccgcttacgtcccgccgccccgctcctgcgccaccgccgccagtcactagtcactaccgcttgcgccctggggccccgcgcgccgccggcgccctccttgacgccgccgctacttgcaccttgtggccctgcgcgccgccaccgccatgctcccgcgccgccgacacccaatcgccgcattggtggctcggtgccctcctcaaacccgtcgccatcggcgtcgtcgtcttcgacagtggcggcgggaaagcaggtggagagaagcgggagctcgcccgccaccgcccataacgaggacgccgtcgaggtcggtgagcggcgcgaaggacagtggaaacggtggcgggggccgcgatggtgaggtgtgcgtccttctcctcgcggaggacgctgctcctttctcgtcggtcgccggccgcctcctgcacatgcgcgccgctcctttcctccctccggccggcgcctgtgcgccgcttcttatttctgccagcgagaggaaggaggagaggggagagagatgaagacgacgagagatggggagagatcaagaggaagaagatcaggggtgagaatgacttgtggggcccacgtgggtcccaccatttttattaatttgtatacgaaactgatatgtgggccccacggggtttattattattttttgggtcgaagtgccacgtaagcaccacatcaatgccacgtcagatgaagaccgagtcaaattcgccacgtaggcgccacgtcagccaaaaccacaatctaaaccgccgagggaccttatctgcaccggttttaatagttgagagacccgttatatctggttttgggttcaaggacgaaaaccgaattcgttgacaagttaagggacctcagatgaacttattgccctatctaacgagaggcctgggtaacggattacggccatctgggcccactaaaaatactcgtagaaatacggctacggtgtgtacgcggcgtcgtcagcccactcgccgcacatcctcggcgaggtcgccggcgatggcgccgccaccgccagggcggcagcggctgccctgcgacggcgaggaggacgcccccccccctttccaccgccgccggtgagggcctcctccgtccagcgatcgcttccggcgggacgtacggggcccgccgcgagcctggtgagggttttgttctcccctccctctctgacgatatgctctctcttgcttcgctttgattccgcaagccgccgctgggatccagtaatttttttttcacttaattccactcgcgcgtttcagtttgtgcgggaattcgtggatcattcaaaggattgtgctacaaattcccaccatatcatcactatatcagtgttgtcttttactgcaattttttttttaagaaaatgggataaaccgggcctctaaatccatccggatgtacgcagccgattttatgtgttacttactactacatgttaataaataataacctgcatagtagtatgcaatctggatgaatttgtacaaaaaaagaaagctggattcccatcatatcagtgttgttacttactgcatttttttccattgtgtcacatactacatgttaataacctgcatagtactactagtatgcaatgtggatgatttttgtacaaaaataaaactggattcctatcatatcattgctgttacttactactgcactttttccccgtgtcacttattactacaagttaataacctgaatagtagtatgcaatgtggagccaccaagcgacaccatgtggagccaccaagcgacatacaaatagataaaaagccctttctaccagttgggtttgtccaccagcatgaattggcttatacatgacttaaaaacattaataataacgtggtttacatattagtgcactggaatttgccaacatggctatcaatcttactgcttacaaaataatccactaatatgttcttgatacggaaagaaatctaatactaatacatgctgcaaaatgcatctggtttattcgcagatatactggctgctgatgtagcagaagaacgttgattcatgagaaagtaatatggcagaaaaggtttgatttcagagaatcgtaattttgggacaattggagctgcatttctcagcgcctcctggctgcagtctctctctgggcattgaagtagacagcagccacaggaaggccaagatcattctcctcggcgaaccggcgggtgttgaaatggtccctgaaggatggcacaattacagtttgcctgcgcttctgcttgaagagcacaaaaatgaacctatggatgccaatgttcggctttggactctcatagcttatgacctcgcgtccttcaatcggaaagtggtacagttgtttattcacaaggagaaactcaatgaataagatggaaaaaaaaactgacacaaattagaggaaggacctaccaaaagaagcatccgttgtcccaggtatatcagtaacaatcctgcgtaaatgttaaggtgagatttgctgataatttagccacattactattcatgttaagactagtcagattatgtgttgtttgtatgcatatgaaagctaaagtaattgtcctatcttccctagaaacataactaacatgtctagctaatcggtaaccacccacaagaaacaaatatatagtatttagatacaaatgttcatggttggttaccaatgaaggtgctcccttagataaggatcacttggtcctggcacatctgggtctgtcataacctgaaacatgaggagttatggttaaccagggaaa

SEQ ID NO: 58957 - DNA, 8501 bp, Oryza sativa
actcagggaacgtgtgtaatctatctaaggctaagacaatccaaggataacaacgataggtaggctaggcaggctagagaggactttctatgtgttttaattatctaagctaagcaaaggtaatttcctatctgttgcttcgggcactgacccctcttggtctgcccgcgtggttccgactatagctctatgatgtatccgaacgtggaggattactgggtcgggattcagggcaggcaccacctgccgcctacctctgacaaatccgtgggatacacagcaaactaaagtaatctctaacctagacaccacgtctaagttattaattactactctaatacttgtacaggaacttccttctttatccagagtcctagtactagagcacttagtatgaatactaaacaatgaacccgcaaagatggaaatatatcttacttagactaagcaactaaataacataagaaaggaacacgaatgcttactttatagaagaagttctccgaacccggagcagagtctaccgacagcttcggtactcctcccgaattccttctacgaagctacacttgtcaaggtagaagtcggatgagcaccaaacttccgggcactcctccagagcttcccctcactcgctaccttattctaatatgcaaaagatacaatagagcctcttgtaattcagctcaaagttttgtgttgtgaatgaatgagaggagctctctttatagcctccatatgacggttacaagtatgggaaatgaccaaactaccctccaaccgtcatcaggaagtaatcagggctgtccacgtcgaatctggcgatcaacggccacgaaacgggttcggccgaactggtggttcggccaaaccagaaaaccctcctctcggccgcctcttcagccaggaggtagcttaatgggcccctaacatcatatactatgttttggcccaattctaagttgtttacattaacatatgggccctctaatccatgtaaacgcgtcctgaatgtgcggaggtgcattttatcgcatgatggatgtgttttctcctcaaattacctgcgtaaacatatttcaccaccactagtggaaatgattggtaataatccctaccactaagttggataccatgttttatttcattatatgcaggtattgatggtcagatattatgatttaaggaccgtcaacatggagccgccgctgttgctgccattgccgcctttgccgtgcttgcgacaatttttgttgttgccgctgttgccgttgttgccgccggagttgccagaggtgttgccgctgttgccgttcccgcgagcaccacaggcggccactacgacgaaggcagtggcggtgccggcggagtggccttgtcccttgttgatctcggcgagaagaagttgcgagcgtgcctccaggaacatcgggaacaggtgctgcatggggagaatagtctgcaagttgtggtacttttcattcaaacctcaaaggaagttgaggatgagggtcttgtcggttatcggttcgccgaggtccgccaaagaatccaccatggcatgaagacgatgatgaaccctgagttcctctcaacactcaaggctgttgttggcccgatcttttggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaattgaagaaacaagcaagaacaagaataaagcaatctgatattgcaaatagtaatttaatacaaatgataagtggggttccgaagaacaagcagacggacggtctagccgacacgtgcgctgcaagcaagtagcaatggctaaactttaatctaacaaaacccaaaaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgaggccaaacgagatagatttccgagatgatgctggatccgttggaaggaggacttcgagagctttccatcaagtactcacgggcccaaaacgaagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcagcctgcggcccaagtctccatcttctccctctctttttccttccctctctctctcttgggctgcccctccctccttcccatcggcccagctccctcctcctccctctctcccccgggccacctctccctcctctcctcctgggccgatcgcccggcccaagccgcgccccccctacccgagccgctcccctcccgcgtacgcacgcgcgttgcacgcgcgctgaccgcgcgcccgcgtggggcacacgcggcggtcgtcgtcttcttcctccagccgcccggcctcctctctctctcccaaaaaaccctagcgccatttcccgaaaaatccaaccattctttccaaattaattggagggaattaatccccattccttcctcttcaattccccctaattttccgcttgaatggcgccgtccatcgcccggaacggccgcggactttccaacctctttccatggccaccggccgtgtttcccatcgccgttccgccctctcccatgcccggctccctccccgcgcctataaaatggagcatcctccctccgttctatcgttttagcctcctcccgcgtcttcccgtggccgcaccacccctccccgcctcctccctctctctctccgagcgccggccacctccaaccgcccctgccgcagtgtcagcacgccggtcggccgtgcagtcgccttccccggtgtagcagccgcctcctcttccccggcgtcgcctccgtttcgcagggaaaacatcggagccacctcctcgccgacgaccagtgatgtcgccaccactccaccgcctccagccggctgtgccacctcgccggtgcggcggctgtcgtcgtcgccatcctccctcgacgtcgccacatcgccctctaccccggcctgccctcgatttcgccggaacactgccgtgccgcgccggcctctccatccgcctcgccggaatttccccggtcggcccttcctccacccgtgcgccgtcggccgcgccaccaccacctccggcatcgcagcggcaaggtcgccctcggcctcgcctcccctccacccgagccttgtcggtgttcgttgtcgtcatctccgttcgtactcgtcgacgactcctctggtcggtcgttcctcctcgctggctcgtcatctcgttgtgccacctccgtcgtgtcccacgccgtcctcgtctccgtgcagctgctgccggctgccctcgtcgcctcctcgccggtcccggtcgtcgtcctcatcatcgtggtgttcgtccctccgtcaagccgttctcgtcttcgtcctcggctccgcgtcgtcaagccttgtgccggccgcgtctcgccttcgtccaaggatcgccgccgaagtcgtcccctcgccgttcgtctccgtcgttctcgtccgtctccgccgcgcccgttcgtcgttgtcgttcccacgcctcgtcgcatggtggtaaggatccctctccctcgctgccccgtcctcgtcctttcggtgtcgcccgtgcccgttgtgcggttgtcggccccggtacccgtgtaccggtgtcggtagtcgttcgtgtgtgcgtgtggtgaccgtgttagtgtgcccgctcggtagccgcgttgtttccacgtgtgcagcccgcgtggtgtctagtggagtccgtttgtcggccactcgcctcggttgacacacagcgtctgcttccgtcgacccgtagaccgtctccgtgtactcggtctaccgtggtcctttaggttgacatgtggggtccgcatgtcaacagcacagccttcctgtcttttccaggctagcgctttcacatgttttatagttgtaaaacctaattataataatccgtaaatctccatgtaacagcattaaacttcggatgatcatatcttggtcatacgaactccgaatcgacccgttcaagtctcctaatgtttgttataacctaaagaaccatgtgctttctttttatgtattgttattgcttctttataggcttgtagctttgcttgtgtgcttcgcgtagctttcgtcgttctggaggttcccgaagcgtggttcgtggtcatcgccgaaggttcggaaggccattctctttgagcaaggcaagtcacatcatccttgagcatattgaatcccagtttataaaattattttgatttaaattaatgcattatcgctttatgtaaattcccgcgttatcactgttttatttagccatgcctatttacctttcttatggccttattattattgctattgttattattaccttgttcaccctaggaaaataaaaccccaactagtgggtactctatttatggttccactagtatgaacttaggtagatgctgcgctggttaattaggcaacattaggtggttttataactttagactttgggaattctcatatcacttggacactttggaatggttggattatggtggaataggacatacacctctcttcctctttcaaaacccctaaaacctgttttccggtggggtttgggtgcatgccagttgtgggaagtagcaccccggccactataaggattaagctcgggcctctgttgcaaagcactaccgtacttccacatatctagtgggtaaggctcagtttgtggctcagtctggttataaacaaaggtacacggatggagattgacgaattcgggggtcgatggacatctctaggatagatgaaggctacacgagctgcgtcccggtagtcgagatgtcatggcacagggctggtgtcctgctgctaggggctcaatcctacctacctatcccgggggttctggccgtaggcggggttgggtcgatactcttgtttatggctaggatgggttgggaactatgtcacgtctttcgtccgtatgccgtggtggtatgtggcacgtggttacacgtgaggaagatgtgtcttgtgggtaaagatgtacacctctgatcagagtaaatctattcgaatagccgcgccctcggatatgggcaagcctagcaatgtacccaagttagtgttttaattcttaaaacctgcttaacaactaaaatgtggaatggttggcctgggttggcttgggacgagctgggacccagggtcgggttgccagttcggtctgaatcattgtaggccttgggttaaggcgggttcgtgtgggttcacggccttgtttaataaatattgtgtagctctaggatcgtgtgtacaaagtagctttgagcaactacgtgtcttttaaatgctgtttactgcaaaatttaacccctatattattaccccttgtacccccttgcattaatcatgcatctaccggtgtggcttgctgagtactgtggttgtactcattcttgctctatctttccccccccccttcagtaagagaagctttggagaagaagtcctaggtggagttctggcttataccccagttgagcgcctgtgaagatggagccgtaggcccgctagtccgctgctatttatttttatatgtcaggcctgaagtgcctttgtaataatgtaaatattatcgatataataaagatgtgccttttgtatcatgtttgtgtggtgtaccccggcttttcctgggacggggattaatacactagcgttcgggaaaaggtaattttctcagttgcgacaccttgtcccctccattgttcctaatcacaatataatcattaggtagcaatctattctcgaattcatacaaagaagaacataggaacgagctcacctctaaatttaattgtcgcacacgagcacttgttatcggtccttgaatgaccgttggaggattgatgtgtgtatccgaggtagtgatgttcgcatcatcctccccctcttgaattgaagtcatcctcgactcaagctcatcctcttctcccaagtatggcttcaaatctgaaatgttaaacgtgggactaaccccaaactcgggaggcaactcaagtttatatgcattatcattcatcttctcaacaattttaaaaggaccatcagcacgaggcatcaacttagactttctcaattccggaaatctatcctttctcaagtgcaaccaaactaaaccacccggttcaagcttaacctcttgcctacctttactatcagcaattctatacttttcagtcatcttttcaatgttgagcttggttgactcatgcattttcaaaataaattcagcgcgtgccttagcatcattatgaaccctctcactagtaggtaaaggcaaaatatcaataggagcattagggttgaaaccatacactacctgaaaaggacttaacttggtagtagaatgtgttgcccgactctatgcaagctccacatgaggcaaacattcttcccacatcatcaattttttcttcaaaatagccctcaacatggtacccaaagtgcggttgattacctccgtttgtccatctgtttgtcggtgacatgttgtagaaaacaatagctttgtacccaacttgttccatagcgtgcaccaaaaatgacttaagaattttgcatcacgatctgaaacaatagtagaaggcataccatgcaagcgaacaatctcatggaaaaacagatcagcaatatgaacatcatcatcacttttatgacatggtataaaatgtgccatcttagaaaaacgattcaccacaacaaaaatgctatccctccccctcttagttctaggcaatcccaaaataaagtccatagaaatatatgcccaaggaatagaaggtacaggaagaggcatatacaaaccatgtggattcaaacgagactgagctttctgacaagtggtgcaacgtgccacgaacctctcaacatcttttctcatccttggtcaaaagaaatgcaaggccaaaacatcttccatcttcttagctccaaaatgtcccatcaaccctcctccatgcgctttctgtatcaacaaaagacgaacggaaccaactggaatgcatagacggttagctctataaacaaatgcaccattgatcacaaatttgttccaagtacgtccctctttgcaatttaacatcacttcattaaaatcaggatgaagcgcatattgttctttaattgattcaagtccaaaaatccgacaatcaagttgggacaataaagtatagtgcctagacaaagtgatgaaccctgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcaaagaaacaagcaagaacaagataaaagcaatctgatattgcaaataggaatttaatacaaatgataagttggggttccgaagaacaagcagacggacggtctagccgacacgcgcgctgcaagtaagtaggaatggctaaactttaatctaacaaaaacccgagaaaccctgaaggggtaactagctatatataggggtgggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcagatcatcctctccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaag

SEQ ID NO: 58958 - DNA, 6494 bp, Oryza sativa
cacatttgttcagcttggaacgtggaattggtactggagttattgtacactgctccttggttgtcattttattccgtgcaaaagttaagtggacaacaaatatcagagggactacaaagaattggaaagattttatcatagctcaagattaattgttcacttccgcgctaaaatggaattggattcaaaacttaagaagcgtggatccctcaaatttgccataattttattttgtcattttttttagagacatttcttcttccttttttttcttgaaaacattttttttcaaaatttttattgttcaccaaattttcggtaagcaaaaactcatacggggcttaagataaaattacacgatcataacaaaagagaagtatacttactgtgcaccttgaaaggtgatgtgttacttctttgcttgttgcaatttatcgattagtttcctgggccctgacttaccttcagtgtgaattgaacttgaggactcacccatgaatttgaaaaccttcctgcaggggttagtccacagaagatatatatccaatgtccatgaacatattaactctaaaagttcattaatcaaactcgactcagttctaattcaatgaattgtaatggtatatttcaaaatgggtaaatttataatggcatggatccaattaaccctaatatatatgtgtttgataggcataggatacctaacaatttttattttttccctcgcactggacacacacgtcacgcaacacacgcaaatagagccacacatttgcccacgacatgaggagtagcacatagtggttgttgatactggtcaatatttttgcgctagagatgtggagtggatcaagtgcgcttcatactgtactacagtggcataacatacgcctccataaatccataatatattggcatagaggatcgatttcttcaaagatttataggccagctggccagggaacatgattagtggaagaaaattatacaggactgaggtccttccctcacatgaaatactttgtcttcctgcacgacacctgtccagcacaaattacaaagcatgcagcatctttcttttctccaatccccattctgttcttcaatatgctcggcaagacggaactaccactgtaggcatggcagcggctgccggcttcgagctaccaccaggaacgtgcttggccagtagacaagtaggagtagatggttaaatgttagaatggttagatgttgctcttgttactttaatttcaatctccattacagataatcattggtggttattgaatttatccaatcctttgaggattctttccgataacaagctttgctcgattacaagctgacagcccttctcaacaagaggcttggtgctgcaaatgataattagattgtattatcactgttatgtgaactcttgaataagatgacacattgtgaccagatgacgaatggagtacccacgttgcggtaaggcatggcgcatgcccttgatgtcgcactctcccagcggccgtccataagcccgatttctgctcaccgccgtggccacgttggtcggctcaagctatgccttgttggttgtcgctgctgagcacgaaggacggaaggatgaagaatggggattgggaggggagcgcctgcttgcgttgagattcgtattggacagatgtcatgtagggagacgaagtctttcggatgaaggaaggacttgggtcctatgcaattttctgtggaatactttattccgtatgcttgcttatgggtctaggaggcactgggaatacatatattactggcaaattgttgatatttcttaatgaaattactagaaatataattcccaacaataacgtagaaatattcatgctatatttatggtcacagatatgacccgcaagcacacggatataccattgtagcatttcatccggagtattccaaggtatcgtatttatttaatcctaaggtaagatatgataagagagtactatgctaatagtttatatttcacccgggagtattccaaggtatcgtatttatttaattctaaggtaagatatgataagaaagtactatgctaatagtttatatattacttgcatatattaaggtctaagcaggggttaagtgattcaaagggtagatgacacacagaagaaagaactatgatactctcactaaatataatctaagctaagtggagaaagaataggaaaagaattcatttctatacttctagtatacatacatctttagtctaaacttgttagtatatagtcatgcacccaataccccctaacagtgccctcctggtgtttcgagagaccaccccggattgtcgagttctttacgacaacctatcatggccatccaaccggaactaaatacgcaggagtaccgtccccaggaaagtgtcttaggaatatatactaacgcggaggaatacctgtactgagctatcaccatcagcagcccacctctactctcccacatcatatacttaataatctagacaccacgtagtgatacttaataatctagacaccacgtccatattattaaatactactctatatcccccgagatgacatagagcaaccgagtattcggacactaaacccacacaattgcacctctctgataggctagctacacaactatattgatacaagtataaagtaaagtcggtactcagataatataaatggaataaaataccgaagatgtataaataagaatattctattaattcaataaatcttacaaaagaagagaggaatgctactagagccatacccgaattctcttgaagacccgaggactcataatacaattctaattcctactccactagcactaggatactactaaacttgagagagggagagatctcttcttcttgagtgtgttgttgaagtggagggagtgaagtccttatatagggcggttatggcggttataagtatgcggaatgtccattctgcccctgcaaccgccatcaggatatcatctggagcgtccacgccaaaacctggaatcaagggcgcaaatgggggttcggccgaaccaaccagaggctggcccaaacggcccaattttcagcaggccgtctccctgttggctcctcagtccagaaggcctagtggatcgcgtgaattctgtttattggcccatttatccataagtttggatctcgacaatgtccgattgattgatcatttattttctgtcaattctcctccatttatatgtgcttcttttgtatacatgatagtagcatagtacatagtggaagtagatattttatttgaaaattatgcattgcaagcatagctagttttcattaattaggtaatattgtcgaaattggtcgataatgaccttcaacacaaactcagaaggtttaggatccctagtattgtagaggattactgtatctgtgtcgcctataataaatgaatccatagagcaccagcattttaaagtagcaacagtgctcaaagcgacatggcagccaaaacttggctttcctgttttcactgtagcggtctaatctgagctgttggcccaatccaatcagtaaagaatgtgccctaatgcacccgaccctaatgttatctgtagcaatcctcttttatcttatttggtggtgtatgcacgtactgaaaggttgccgccaagacaaatagttctcacttcagcgtgtacttcttcactcttacaagtccattagctgtgaatcgaaactgcaaactcaagctacagaagttgcttcttatttcgtattaacaaattcattatccaaacccagagtttctgccctgttgttcttattgttttatatatgctattgttctataataaagtatagatatcactgtatcggagttatcgaactctatgaatttccctctaggatgttttgttttccgataccatcaatacaccagatgaatggttttccatgagttgttagtcacttttgtccaaagtccaattgagaaacaacaattcattgacattgttttctatagctctgttttattttgagctcctggtgacccttacttttcacaaataatttatgaatagtactacaagaaagaacattcattccactccaacccttttttatcgaacctacaacccatgcatttttactaagcctcgtcttaccaaatggtataagtattaaaatattaaaactgagtatgttaaaataaagacttgatggagtgatcaaacaatgcttggattatcaattccgcagcaagacattcttggtggtagttgcagttcatgcatgcttctatcaaacatgtcaatgacctcactcatggaaggccggtcttcaggtgtacattggatgcaccaaaaccctattgtcaccaacttgcgagcaacctctgatatgcaagtgtttctactatcaatgccttcggtagcagcaccacaaaattgattcaagttgtcatataaccattcagggaaatacttgcttacggtctgcatgcttgcattggtattttcccttgctccaaccatttgaagaattagcatcccatagctatatacatcagacttggtggtcacggctccatggtgtctccaaaacacttcgggtgccatatagccaattgttccccttgcaccaccaatagagattttgctctcttttggcttacacaactttgctaatccaaaatcggatatttttggacggaaatcttggtctagcaagatgttttgtggtttgatgtcaaggtggacaacacgatgattacaccaacggtggaggtaatcaagcccttgtgcaattccaaccaaaatctcgtataacttctcccagcttagggatttctctccttgcacggtgtcaactacaccaactgcgtatttatcgagggaaccattgggcatgtactcatagacgagagctctttttgatctatgcaagcacaatcctaacagagtgacaacattgatgtgtgatgttctgccaatgctgaccacctcattgatgaagtcctctgcatcatccttcgtgtcctccagcatcttcactgctatctcactgccatcagacaagctgcctttataaactgtaccatatccaccctttccgagggtgtgggcaaaagatttagtcatctttcgaacttcagagtaagtgtaactttttatttgtgtccgtaggagggactcaattcttggtgaatttgttgatctccattgccaaggggacaaatgcatgtgtttcttataaacttggaagaccgcaagaaccaatatgcttatccccagaagacttgacgtagaagctattatgtctgaaaaggaattggagcttcaaggcataagaacataacatatggcatgtttacaatgttggtattaagagtcctcttatgtagttgtaaccaatcaacaccaagaggtacgtttatcaatcaatatctcctaattaatgaacacttaacagataccatggcaaatttacctttctgtcccttttatttccaaatctacctctccacaattttaacttttcatagtaccatgcatagtataaataaatcttattcattggaatttgatcacatggacgatccataatatccaaaggtactttgcaaaatctattatgctgtttaatttcggactgactgagagtttcaggtagtagacagaaggtgtcgtaatttctttgcatccttgtccacaatgtaaattagaaaagcaagggtgtggaaattttcattattagtgtatctcttgcaaaatatttcataaagggtataataaaacttacagtatatttaaacttaaaatatataaataattgtagtttttgcattaagtagatcctatctaaatattgtaaaattcatgcattctgcagaagccgtgtatgaacttgagatggatgggccagtgtgtgttggtgaaagtctataccaccatgaagaaaaatataaatatttgacagaatcaggatatatgaattgtaactacttgaatggtactctcttcatcaacaaatataaacattctggttatttgaattttgtttagaaatatatgtaacaactcttacaatactacctgtactatcaaccactacatatttaaatttttgctcatcttatcccaacctttctcccaccaccaaccattcctcgtttattgagcggcatttaatatgtccaaaaaacttcttacatttaaggatgacaaaataaactttacatacacatgcaaaaagttttgtataacacacaaataaagaagttttgtgtcctacagttcaaaattatttaacaatataaccataaattataatttgagctgtatgatatcaaagcagcgaagcacgaagggttgggatgaatcattccttacatgtttttgtcctcttcttttttgattctggaacaacgggaggatctgatgaagagattgaaccatcagctgaaaaattccaagca

SEQ ID NO: 58959 - DNA, 20447 bp, Oryza sativa
ggaatatagttgcaaggtgtttcaaaaaggctataatcttattttggttggagcaagtgctatgtgttgagcaatatagataagttgtaatgacgtagtttttgagaaacaaatgttcattcacctatgaaagtaatcttcaggggcacccattgcactcggttttgggatttgcttaaaaggaggaacaacactgtcacaccccaatctgataccgccatacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacacggacgaggcgaacaccaacaacggcagcagcagcggaaccaacggtctaacacccaacaccacaggcgatggctgggaaccaggacgaaaccctaatcttcacttcactttatcttttcttcagggcggaggaactatatatatatatttatttagagcaagagtgagtactttcgtactcagcaagtcacgggaacttaggtgtttaatgcaagcttggaagagaggcaaggttgttttgcaaatcttttatttgaagactttttgaaatcactaggtgatttacttctttctaagtttgggccgaaaagagacttgcgtctcgattcgactttaagagatgtttttcaacagctcatttagtaatgtaccgacctcccgggtcagatcattacttttcggctcccagagccattccacttgattaatcggctcccagagcctttttcattttctcggactcccagagtccagctgcccagcagcaaagcaatccgcttccactcgggaaacctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttatctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccggcgttcccaactattggcatgcgaggtttccctgaaccgactagcttcttagccagggtgtcccattccaccttgtggttgcactttgattatgtgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgattcaggagaaatcagcatatgcccctagaggcgcccggaccccccttatatatgggaaggagtccgggttacaaaagataatctatattcctaacggaatatgaagatacaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagagtatggtgcatcgaatagatgcacctaattaggtgtagcccccaactatgtgattagttaacaaactaaacatatagttgaaagacaaaataacaacactattgtgcattatatgacaaaagcgtacgcggcgcctaaataggcatgctagccgactgctttttatccacaataaaagaaatccgagtggtttacactctaaaaggttcacgaatgaacacactggacaggcatccgaatataaaactctaaagattacccaccaagtattataaaaattatggtaatgaataagtctaaatagcctaggctatgactatttaccataacaaaaataggtatataacataccaaggaagtgactatgataaaaacaagtcatcccaaattaacccagacagcttttgtagcctaataaagctaacaaaaagcagtataacacctttctgtcgggcaccttttaatttgcattgcaataattccaaagaattatatgaccgcataaaaaggatttttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaaatccgatatccaagcgacgcttcgtcttccccgccggaactctcgccattttccccactccctgctacagtgtaaagctgccgccggcgaactagggttctcaactccggccaaatccacctccgaaaagtgcatcaaaatccctcccgtgatccaccgcctcaatccctcacctctcccaagccatccctcaaatcaaatcaacacatttgagtgaaaccaatggcggaagagagagaaagcttcgaaggtcaatgggcgccatccgacgtaacggaagagaacttgaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaattcttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaattctcttccgatcggagatgaagcagtacaagccttggagttgttggatcgtatgttaaatcttaaagaacaaggcttacagggagagcagatcactcggcacttcattaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcaactgccagtcgtgccatataatgcattcaatctgcctccacaggtatgcatcggaaaccctcaaaccgtgatcagaacataattttatcttcaggctgagttgactaactatggaagcatcttgttcaggaatatgcattgatgaagtcagatccaccagtctctcagcgccggtctcctcgccaacacaccgctcagggaggtggagggccaacgatcagaccagatccgcaacctcagacctccaaattggctggtcaaacaggtcctcgcaagagaaaactggtacttgatgatgatgaaggcgacgatgataaatctggggataatggctcgccaaataaacccccaaagcgtaccatgcccaggaaaaaactggctggccgcgcaataccaaagatcagaacatcttccaggtattagacctctcggtatgattccgcttcggcatgttttccgatgaaaataatgctaaatactgaaagaacactctgcaggaaaccatctgatatagatccatctggaaaagaccctgatccggctatgacagagcaaaatatatccaaggaccccgagccgactactgaaaaccagccgactgctgaaagccagccgactggcgcccatgcttcgggaggtaaggccaatccgagtgacctgccgccgactggaaaccagtcggcaacgactgaaacggcaacaactcaagagcccccgactggaaaccagtcggacgcaggccctgatccagagattcccgaagtagaagcgcagacgacgacttcgcaaggaccagaggttggtaacgactcgatagctgggtcttcaggtaaagaacaaagatctcctcacgctcagctaggtacatcttcaggttagttgtcttctcaaacaatggcgacttaaataacctcagtttatccgtctaatatcttggaaacacaccaggaccatcagatgatgacggggaagaaattcctcgcataaaggcgaccgacgactctcgtcctcctatcttgatcaaatggtgggatgagaactcacaagccgccggtatagtcataaaccgtcaaaaagaagatgaagaagtgtgccagctaaagaaagcgcttggagaagccactcgtattgtaaatgtaagtcttccgggtgacagccttcaataactttgttctctttttagcagaaactaaaccatgatccatcatgcagagaatccatcttcgcaatgaggccaagactacaactctggaaaagctggttcctcatttgggaactctagaagcagtcagggaccagctgcatgaggccaagggtgcgccaaaaagacagagaaagagttaagggaccgaatcgcccagctccaggatgcaaacttcgaactaagtggttcttcaaaaggtaatcatcccgatctgttccattgatttatgctgtcataattgcatcctcaaccatctggatttcaaacagcgcaagccgccaggatggaacagatggcgaggcaaattgaagccctggagagagacaagacagaactggctgcgcaaagggactcagccttgaaggaagtcgaaggtagcgccagctaacagtctgagcttctctccttataatgcaacagatgctcatcatgaatgtgttttgtagatcgcaagatcaaatcccaagctcagtttgacgtcctggttggcaagatcaagaggcttgaaggagcaagggatggcgtcgccaacgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccagccgagtaatgaagactctgatgatgaaagaactgattctgactgatcatgaatgtaatgtatggaggctcaatttgtacaatactggtgtatttatgctgtgcttgatgattcttgcaaagtttttgatttcttaaaagtttttgctaagctttgttgagcctaaaacccaaagaagctattaaaaaccttcagtcctcgcaaactaagtagaaaaaccaaacaaggcaatgataaaccaagtaagcaaactgaattgataaaaaatcacactccattattatgatgatagcccccgactgacaacttcaaggagaaaacttgacgtttgacagtcaaaatagggaaatacaatgataaggttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcgatgcaagtcgtccactcgatcttcttcatagcgttcttcacggaaattacggaagcgcaaagactcaaattcgacttcactcggcaacattgcttctgccccatagacaaggaaaaaaggtgactggcctgtggcccgactgggtgtagttcgcaaagaccaaagtactgatggcagctgttgcacccatttgccggcatagggttttagccggtcaaaaacacgcgctttaatcccttgaagtatcatgccattggctcgctccacctgtccattgctcatgggatgtgccactgaagcgtagcaaatcttaattccaaaatcttcacaaaagtctttaaaaactccgccagtgaattgtgtgccattatcggtgatgatccgattgggcactccaaatctatgcacaatgttgatgaagaagtctcgagcattgtccgctgtgattgtgacaaccggtttagcttcgatccacttggagaatttatcaatggccacaaagagatgcgtgtaaccaccgactgcctttttaaacgggccaaccatgtcgagcccccaaaccgcaaacggccaagacagcgggattgtttgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtgcgcgcagcagcatggtttccgcatatcccagaatgtatgtctttcagcaattgtctcccttcctctaaagatatacagcgttgcagaattcctgaagggcttttcttgtataactcggattcgtgcataacataaagtttgctccgccttgaaatccgctcggcttcatctttatcttgagggagctcttgagaagttaaaaatcgcatgaagggctctcgccagtcggcttcaaccatagcgacatcatgagtgcccgcaacttgagtggtatctttgtgaggtacagtcggtgtataaaggtgttcgacgaaaacatctgagggcgccgcctcacgcttggatccaaaattggcaagtctgtcggcggcttcattgttgtgtcgaagaacgtgactgagttcgagtccatcaaatttgtcttccaacttgcgtacctcttgtcgatatgccatcatgttgtcgtcgaggcaggaccactgtttcataacttggttaacaaccagctgtgaatcgcctcgaactattaaacgctttatccctagggaaattgcaatccgtagcccatgaaggagggcttcatactcggcgacattgtgggacgccgaaaaatgtatccaaagcacatagctcaatctttctccagttggggaaatcaaaaccactcctgctccagtgcccgaaagtcgtttggatccgtcaaaatgcatggtccagtgctccatgttctccgcgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagtttgaagaagggcatcccccgctcgccaagtcttgaaacgaatcggctgagcgccgccatgcatccagtcagcttctgaacatctttctgggtgcttggtggtttcatgttgaggatagcagtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgaaatcaaatcatccttttgtttggtcttgacaactacatcatctacataggcttcaacgttgcggccaatttgtgttgagaagcatctctgaatcatacgttgataagttgctcctgcattttttaatccaaacggcatggtgacgtagcagtatgcaccaaaaggcgtgatgaatgaagtcttcaagcagtcggattccttcagtcggatctgatgataccccgagtagcaatccaaaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttggtctcggcttcggtttccccactttttgaaattttggcagcgggcacttctccttcgctcaccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcggaacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccaaaaatatggttgagctccttgcggtggtcctgaaatccagccggggtgtcgccgtcgtccttcttccttgacgtgctttgttcctcgtcggagttcttccgagtagacttggtgtactgctccgcgaactgcttgtagatgaagcactctttggccacgtggttggaatttggatgatgcgggcattgggagttcatgatcttgtcgaaggtgttgacgcgcgaacgctgtcgagaagagtgagtagtggttgcaacaagttcctcaggcttacgcttgcggtccttatgattgttacttccacctcctcccgtagccggcgtatttttcggcttccaactggggcccgactgctttgatgcggtgacggcgtcttcagctttggcgtactcgttggctttttcaaacatgagcttgactgttctgggaggtttgcgcccaaatttgccgaccaattcttcgtggcgaatccctttggtgaatgcggcgatgatgacgtcgtcagtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgctaaagccaccggtagatagttcgccatggccttgttgtctcctcctgctgcgcggattgcgagaccgtagacggtaagccacgattctggattagtggtaccgtcatacttctctattccagtcggtttgaagccggctggccaatccactcgacgcagatcgtcggtaaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagatcgctcgtcgtgacccctgctcctgcggttggatcctgcgccggtgatgctgaggcttggatgacggtagtcatgagatcggaagtgggggactcggctgccagtcggcgtgtggacgctttcggagttaactggaaccgaggccgcaatcatggtctttgtctgattcaagatgttgacgacgtggtcggaacgattgagctcgttttggttgagaagggtgtcgaggagggtgatcgcggcaaccgcattgtgttgaggggtgcggaaaaccggtgtcccttcgacgtcttgttgaccgatgagatcacgcgctcggcgccctgcttccaaagctcgctgacgtcggtcctcagcctccttcgcagtccgctcgcggtcctgctgctcgcgccgtagccgttcttgttcttgtgcttgatgctcctcctccagtcggcgacgttcttcggtctcccgggcttggcgttgctcctccgtctcattattggccatgaaaacgccaaagtagagaggggtatagttgtcatctaggcttccgtcgaagtcgtcgaagtcgttgaagtcgttgtagcgagagctaaattcgtcgtactccacgatgtcagtaggacgtgagtcgacggtgggagagctattgtagtcatccagctggtccgttgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggaccgatgggtaagccccatcatcttgatctggtgacgttgaagaagatgcgatctcagccgagtggtttgaagccgactcgattgagatggtcttgaagtaggtttcagccgcgtttgggaatccaaacgggactgagatccggttctctcccgactggtccgattccgagtcaaggagagaaatcttgccgaagttgtcggtgatgaagtcgaggctgccgaaccgaaacgtctgcccgggagggaagacgaggtcgtcgatgccggagatgggacccattgcactgatcggcgaaaagcttgacgcaacccctacctggcgcgccaactgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgattcaggagaaatcagcatatgcccctagaggcgcccggaccccccttatatatgggaaggagtccgggttacaaaagataatctatattcctaacggaatatgaagatacaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacattatgttcgatgagtttctcacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtatgacctacggaaattagtgcgactactggataggtccgtcggtttggcacgcaaaccgaggccaagcaagttaagtgtgagattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattagatagatcttaattttacggaattactggaagttgaacggagtcaaacgaagctatggatcgagagatatgaattttggaagtttaaatggattttctggacgagaaatgatttatcggaatttatagaaataatattctcaagaatattattggcattcgttgatgtgcgggaccaacggaaatgatttatggaatcttggaatagagaattgatttatggaaaaagggaaaaaggatttatcaattcctttggaaaaggaaaggaaggaggggtgcgaattggacttcctcgggcgtcttaggcgcggcccaaggaaaggcgcgcggctcggccgagctactgggccggagcgggcccattagggttcgaggggggggggaaacggccgggtggacgcggtccacctcgcgggttctgggtggggcccatgtgtcggtcgacacggtgcatggtgcggagggtgcacgcggcgcgggggggctagggttagggtcggagtggcgcatggtttggtgcaccgggtggaccgaagggcggcggtgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaattggggtataagccaggactccacctaagacatcttctccaaagcttctcttactggagggggaaaagacttcttttagggttttctttttataaaacctttttaactttgtttatttcttttcacttattatttgtgctctgaaaattccactaaaatttgagggctccttttagaccaaggagaatttaacaaaaattctccgggtcacatttgaatttttcttgtacgtattttagggtttgccaatttcttttcgaattttaattaattctattattccttttagaagatgatttttatttcgggataaatttatcaggacgtgacaggcgggccaacgcgcagccgctaggctctccgtggattgcgcgcaccgagagggaggagagagcggacccgccttgactcggtctttgccgaggtggcgctgacgtggcgcctccgttgcatgccacgcaggccggcgagaggaggaagaaggaggccggccgagatggacggcgggcggcgggggtctcaccggagcacggatcgacggtcttcggtcatgggggagcacaccgggacaaagaggcggacgagaggggacgatcccatggctcggatgcgacggaggaggtccgacggcggcggattgcggcggcgaccgttggcggcggcaaaagaggggaatcgccggtggtcatcgggggttcgattcgaggcggcgggagcatatccggggctcggtgaactcatttccggcgccggatggggcaatggacctccgagggaggccggcgacggtgagctacctctaggagcgggcggcaacggcggcaagcctatggcgggcggcggcgagacctggggcagcgtccatgcgtgttcggggggggctagccgagctaccacgcgaactagggagggagaggacgagcgagaagggagaacgggggggtggcactaccgagccgagacgggcgcagtgacgagcggccgacggctcgggagcgagctctccggcctcgggccggggaagggaagaagagggatggccggagtcctcgtctcgcgtccacgcacgcaccggcctccgacgcgtgcgaaggcaagaggtgggagcggcggcaaggcgtcaacaatggtgcggtgagtgtgtggcgagcgaaaacgagagaagaaggggggtttggggcggcttgggttttatagtggaggcgatgtcggtttggggagggagggaaaccgaccttggtggcggtcaaggagaggagctggcggtcgcacccgtggtccaggcggtggcaggcggtgacgccgatggtggtcgggcaaaaggaaaaaggagggggagaaagggagctctgcacttgccgaaacgggaaaggaggagggagaggggagcgaggccgagggctctgcctccatccctgggacgcatgcgcacaggcagcagcgggccgggaggcagcgcgggcacaggcggtgctagggcttgacgcggcgggatgccaggcggtcggccacgcgcgagcgcgcgcgcgggcgcgagggcgcggcgaaattcaaaaggcggcggcgggagatcaacgccgggagggcgagaacgagaggggagaggaagagaagaacgagagagagagagactctcggcttggcgtcggcgcacgcgcgtgcgccacacgtgcggagcgagggaggaggacggctgaggggggggtgggcagaggggaggggatccggcccatccaaaatatgaggaggcaaaatagactttcacagagaaattgaattgggagggatttggattttggatttcgaatttgatgcttggtctttgggacacaaggtggagtcaaggaagggaacaatattcggaggcgagtcaaagggagatggataatttagagaaagagagtgtaacttgggagtttgagtttgactactcaacgagatatgtgggtaaggattttggagagaagtctgaatagaagggttcggactttgagattatttcggaacggaaatcattttggggagaactcaaggcgaaagagattgaatcttggggtttagagttcaagggtggaagtgatctcgatttgcatattcagacttgggtcagaagttcgagaaataaaacaagggtagattgacgaaccgataaagagagaaagatagatgaatcaaaacctgagaggttgaattcgaatttgagaatcggtttgaacgaaccaaggagagagtttatgacgtgaaggtgaatccctggacggagttagggttcgggcattcgacaaagttcacggatggggttccaggagggtatttcgaatagaaggaatcgagcttcgggactatattgggatggaaattttgaggagacgatcgttgataacagggtatcgagacaagggagggatttaaattgagatctttggcacaacttagactcaacactcaaagaacgaaaattttcgcaattagaattttgccgaattagtttttaacgtctcacgaaaagcggagcgttacaaacaccatataaaagtggcgtgtcgtcttttggagaatactttgttggagatattcaccaagcatggatggaagttcactaataggatatgtgcttgattttccacatatttaagtttatttcctttatagtgtttactactttatggtgcagataacaagtagcacattattttaatagttaacggctgtgtgcatcacatgatgcagaggctgggatttttattccattatctaaaaaataccccaaattgtttttgtgctcaaaactataatgtttggaatctactcttcatgcaattattgatctgtttattgtgagggcacagttgttattctcaaacttatgataatgttggtttccgaatgtataaattggttttcaaatacaaatttaggctaatgagtatcactatcggttcgtcctggttatcactagcttggtgtgagaaccgatagtgatacccttgggtgtgtgggagtctaattcgtgcagttttgttcacggcgcacagttccagcccacaccatctcctcctgcactaacttgagtcgcggattcgagcgtcacatgttttgcatgcaccacgcgctctcacgatgatttccatgttagtatttttgtttctttttttaattcgttagcacttttttcaatgtaaagtgttgactgaaattaaaaaatcaacaaaaatataaacccttccaattacattttgagaacattcaattcaaatttgaaaaatttcaattgaaacttcaaacttccaattccaattttttttaaaaaaatattccccaaaatttgaaactttcaattaaaattttttaaaactctacccccaaaatttcaaactttgaattaaaacttttgaaccttcgtctcaaatctaaaagtaaaaatggaaactcatattttttaagacattcaatcaactatttagttattattttatttttgcgaatgtcaaaaaaggctaagcattgcccctatcattaattagttgtagaggtgaaaacggatcgaaaaatatctggtcttatccactccgaatcgattcgaaacaaggatatggtttgagcttatagaaatatggcagatatgaatacaaatgtggataatatggtgcaaattaggatatggatgtggtatctctaagatctatcgggtgtagattatatgaaattttgtatcatattatttgataagtcgtttaccagacaatccaaaattgttgaaccaatgttaccactttatttgttccatacaacataagatggcccatttatagactacttaatttgaggcactcaccgtcttatctcatacttatctagatgtattttcatattatggatgtcatgtatcaatgttgtttagcacttaagcatatagttattaccggtttgttaattgattgttatattgttttccattgtattgctaacttgatgttatattgatcacatatacacgtaacattcattaattttaacatgtttccgaatcaaatccacaccaactccttaccatttccgatatttgaaacaatccactcttcatccgcatcggcaccggctccaaatgcatttaaaaaatatggtatgcctactatccatccaaatttagtccgtttttcactgctagttaggtgagagatcagctttatcacgtcgatctataagctatgcgagatagcaatttcggggtatcatgttcagatccaagatttgaatttctatcatctcggagccccccccccccctcgcgcaagaacaaatctcctccaaatttttcagattttttttcaaatatttgtgtatttggttaaaatttattcaaattcagttaaatatattaaaattgcaaataatttcggtaaaacattgaaactcacgaatttttcaaaatttcgcaagaaatttcggtggttaccgaaattgcaaatactgcttcagataacctacgcggctatacgccggtttaagtgaccggtgtacaccctccggttttataataattgatgttttggataaggttgaggtcaaaattttataacttcgacgatcaataactttaaaaatattttgtttaaagaaactataacaacatatatagatttgtcttacaaaacactataataaaagtaaacatgtatttatttattgtatatattataatagaaaagtaagggtcaaaggtatatattttaaactgtgtcattattcaaaacgtcagttaaaatgaaaccggagtactagtgaaatacagtttgatagcacggaccgtatggcacgtgtccaagagaaaattttcgtcgcgtggaaaacatggtatactagtaaaatatgctgatgaaaagccacatacctgtacttgagttgaaggaccaagagaggagctggtgcgactcgacaagttccccggtggccgccgagaatcccacggccgcgtcctgcggcaagccggcggctctcaggtccaccgccgcctccacgccgtagttcgacccgttggccgtcaggttgacgaccatcttcctcgcggcggcgtcgtacctgatctccgcccgcatgacgccggcgagggtcaaggtcggcagagcggtgaagttctgggacacaatctggttgacgtcgacgccgatgtggtcgatgacgccgtcctgtggatcccaggggttcctgcaggtgtcgaactctacgccgacggtgcgcggcgaggcttcgccggtgttggggatgaggccgaggaaccctccggtcatgtccggcgcgagcgtgtccgccggtggcccgacgtagaacgccatgccgtccgcctggttcgtggagttgcggccgatggcgaaggagaaggcggtggtgaagctggtgaccgacccgccggcgccgtcgtcccagagccgcacgagctgccggtgcgccacgcgcccggtgctccacgtgcccagcctcgtgaggttgatccggtcgccggcgtaggaggcgttgcccatgaacacgaggtttgcggcggcgacgtcccgccccacggctgcgaagtcgtagtcgaaggagagcgccgccgcggcgcggagggtggtgcagcagaggaagaggtggaggaggacatggctggccatgttcatctgctttgctggccaccttacattgttattgctgcggctacttagcgtgggcgtcgtggtggcagaattgcagatagaataagctagtgtacatcattatcgttgttgactttgactacatgcgacgaccaaatcgcagccggcgggccagccggctgcgcctcgattagatgatgcttaattaaatattaattatttttaatttaaaaataaatttattttagttttttaaatattacatatgaaacttttttagaaaaacaaccgtttagcgactaagacttgagaagcatgctgcgcacccataataatcttagtagctggtagcctaaaagaactaagccagtccggtaacattttcgtcaaaaatgaaacggatttgctataattgtgtcgacagatttttttcgttgattatagtcggttctctggccgttggatctgtgtttaagatccgtgcttccatactgactttttcctctcgaagagaccttgttgagggaagatccacaatagcggggagtcgtgagaccccccatttgtgagttcggccgggggcggaggctcgtctctcggaaatcactcgctcgtccctaagattaccggcaagcttgcacgcagtcggattatacaggttcgggccgctatagagcgtaacacccta

SEQ ID NO: 58960 - DNA, 1444 bp, Oryza sativa
actttcatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgcattgttgagcgcaaaattttggagaatccaatggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcaccttgtttgttcatccacggatgacttggatagaatttggtgatgaggttggatccattggaaagaggactccgtgggctttccatcaagtactcacaggccgaaaacggagatcgtatgcagattcggtggccgtttgaagtcagttgtgtagcaagtggccgaatcggattctagcacgtggagcacttgatcttgttatcatcttattcatccatgatgtgagcaatggtcgtatctgtagtagccgtggtcacatcatcctccccttcttcacagaaaactgtcctcggtttttccatatggtgctcttcgcgtagtccatttaaaacaacctgttttttccaatcaaaacaagacaaactcgagataattttgttaggaataacatttctctctagcttgcatgttttatccacatgtataggaggttctaaatctgaacatatgtaatccctatgcaccaaatatattcctctatcatcagattcgccaaatatatgaaaaatagcagtagttggacaaggcaaatcagacttagtaaataatttcttcttcaaattatcaagctcacaaaaatcatcaaactgaacatagcccaaagtatttaaagaagatagcaattcacgttcctctacttcattagcaatgtgaacaacatgcttaaaatcagcacacaaagaaacagcttgtggttggtgcgccatggctctattcaaccccttctgggttcgactcccaccaaacacccctttttcctatatttgctcctacttctcatgcgtgcacatggtctggcagggtagcgcccacgattgagcggtccaatgccggttttctgac

SEQ ID NO: 58961 - DNA, 4229 bp, Oryza sativa
aatccaatatgtccaaaaatcatgttttggtgctttttgaactttttcattccggtcaaaaacatcgcacccgtgtgggccaatattggcattaatggacaaaagtttgctgcgcgaatcacgaagtgagtttttgccacgaacgcacccaatacactccaatatgtcgaaaaatcatttttggttctttttgaactttttcattccggtcaaaaacatcgcacccgtgcgggcattatatgccaatattggcattcgaataaccgtgtccgcggttatgggcaggtctaacaatgtctatcgtgattagtctcacacttctcaccataataaatgatgctataactggtaataatttgattagctcctggtttagaatggtacattcctagtttggagatagatctgtacagccgggtttggttgttcaggatggttgggcctgtgcagcatgggtgtgttgttcagtgttgattagtattgatgattaattactctactgttttacaattctcaaatgtttcctaaatgctgcttttgcaaatgagccctatattatgccttcctttggtatccttgtgcacttgcatatttgttgcgtggcttgcggagtattccatgtactcaccttgcaataatcaatcaaacctcagttgaagacaagtcgcaaaggagaagacttttggcttataccccagttgagctgcctgtgggagtggagccggagcttcgctagaccgtaattccgctgctgttctcttctcttttgtaagtatttaacattattattatgatgaatctgtatattaaattgtcagtttgtgtacctcggctgattactggacgacgattttatgcacaaattagttcggaaattactaatgaatttctgggcgtgacaagttggtatcagagtcatctcgactgtaggataagccaaatggccaaaccttcaggactgattttccgaaaacatgatttgtgaaaatttttcctttcttccttctctagaattctttgcgaattgttttatcgtcctttccccttcctttttcaacttgagtagttctgaaactagttgttgaaacatgaagacgccaatgtggtctacttatcaagtggatcgaggaatatgaaggtgatgatcgatctgaagtgtccaggtgtatagatggaatgaagtttggatcctaccttagaacctaaaccaccaaagtgactttgaagaatagttagtagggtagagcgtctgttgcttgcttgtgtgtaggtatggttgcatttccatcattggtgtagatcggtgatgagcgtgtaactataataggttgcttgcttaatcaacttgaacaatataatggtctacacacaccagatcagtggtaacctggttaaggtcttgtctttagtgtaacccctatccttctatcttctctaatctgcaacagatggtgaacactcgcgctagtggaagcggaaacaataacaatgaggagaatccaagtcttgcttaagttctggctcaacagactcagttaatgaatatgatgatgcagcagatgcagaaccagctcaaccaaaggaacaacaatcctccaccaccgcagaacaagctagctgattttcttcgtgtgaggccgcctaccttttctagcactaccaacctagtggaagcaggtgattggctgcacactattgagaagaagttggaattgctccagtgcacagatcaggagaaagttgttttcgcttcacatcacttgcatggatctgcttcagaatggtgggatcacttccggatgaacagagcagaaggacaaccaatcacttgggtagagtttaccgaaggattcaagaagacacacatacctgcaggagttgttgctttgaagaagcgtgagttcagggcattgaagcaaaaggatcgtactggggcagagtatcttcatgagttcaaccgtctagcacgttatgctccagaagatgtacgtactgacgaggaaaggcaggagaagttcttggatggcctgaaggatgatctcatgactacgctgattttcaggaactagttgacaaagcaattcgacttgaagacaagaagaacaggatggacaaccggaagagaagatgattgttttcccaggaggcacagggtaatagtcagaagccgcgtatcaagccagctcaagttgatggatcaagtttgacatctcaaaaaccatcgcaacagttgaacatcggtggtgagatcaattcagagattaatgcaagcaatgaagttaacatcaagcaagctactcaatcagagccagttcagcaggatcagtctcaagaaggtaatagtagtggaagggagtagcgggtatgtttcaattgttatgagccagatcacttcgcaagagagtgtccgaagccggagcgtctgcagacacaaggtcaagtcaacaacatcgttgtcacaggaagtgccagttgcgtcttcaagagttgcgtcttcaagtgttacagctcagccaccagtttcaaagcagcagtagttttctttaaagccttagaaataattatcagagttatggaataagatagactgcagtttacttatgcccttttctttctagcagttccgaatctcgggatgagattctttgtaaggggaggggtagatttgtcacagcctgattttcgtttttaggatttataaattatttaataaattatattattaatagaatttatattaaatgttcgttaatttacaagtgaagttaaatgtgggaaataaaatttcctagatataaagaatggttggatttaatttttattaaattctccatgattaattatactctctggaattttctctgatttttcagagctcaattcctaattttaataatacaaagaatatttcagtaataattcacatattaaattaatcattaaatgatctggtttcaattttgttaaatactttgagtgtccaagtatgttcaagatttttcttggaattatttgagcattggaagtatttttaacaattgaaagatcatttcagtgattaatttaattgggaaaagtaattaaaattcccttttccttttcgagccgaaacaggaaaagttgacctttactcctcggcccattcttccttctattcgtccggccttatcccttcccaaagtctagtttgcatccctccttctatcgggctgtgcaatagaagcccagacaaaagtctgtttggccacccttagacactgttcattttccagctcagacagagtccgagccagccatgcccgtgcacagttcccgctgatccccttccaaaatccggcctcctcgttgctcctttttccaaattagttgcgggaatgaaatcctctcaatctcctctataaattccccaagaaattcccaaaagtttctatggaaatcctttccagttttgcggatcaatctttcctttttccgaagaagatccttaactttcccagagtttttcccgacgatttgggcccggacccgagttcccgtgcctatataaaggacccgctagtcatcctctgcctatcccctcaagtcccgtcttccgccgtcgtcggaatcactctccccgcgagctccttctctttccacctccggccgccgctccagccgcatctcaccgtcgcctcggtcgcctccgctctgtgccgtcgctaccaccgggatcgcagcaccaagacaaagcccggccacccccccgttgtcgccgcacatcgccggaaagtcgtcgccgccgtggacagtacctcgccgcccttcgaagctcgtcgccggccatcttccgtcgctgtccgtcattgcgtaagtgttggtaaggaccgtcacctcactctctttctcccggtgttctcccttttcgccgtcgctcaatagttcaccgatgatcgtcgctcccgtgtccgccatccggtgatatcgtgtggttgtcttatctactgccacctaaccgcctatttgtctctgccgtgccatgtctatctaaaccctagatcagattcaatctaatccgttggctcttggccaactctatgtcaaaattaatctcagccgtccaaaatcaatataaatatgttctctcttttcaatggcatattagtccttattatcatatgtcaactaccaaatattatttaatcttttccggaggatgttttaatcttttatctcagttataaatcatt

SEQ ID NO: 58962 - DNA, 8836 bp, Oryza sativa
ccgtttcagttttatttccatctccgatgctgaaattaccaaatttggtcactaacacatgccccccaagtccagaatatttggtaatgtttcggatttgccatatccgttcctccaagaatatcgctcaatgccgtttttccgactgttaccgcctcgctttaaatactaaccatcgtccccgagaaatttcacaccattagctccgttttcactgcttaagccaacctcgtcttttctctctccggcgatcccctcagtgcaaaaggcgatctcaaggcgacttcccctccggctaaatcttccgcccgcagagatgtcgtcctccgctagcccgtccgtcgcaccatcggccaaatatgtggaggcaagtacgcatcggctagatcctctcctttcgcaatagattggtttttccttgcctcatcttgttttcttcttctctgttcttgtttatatctggagcacttgtccaatctggttacgatcccaagtctgtcacatgagcaccactattttcttggcccaatcggcaatctcgatcccactgaatttattatcgctaaaaccaataggatcccttttagattggccaacccgaatttaagtcactggaagaataccttcaaatcttggccttctcttgagaaaacttcccctgagaaaagttgggctgtgtggtataagcgtgtgtcggctagcaagcaagttcattgggatgaactaggaatcagccaagtacttgctcttactttagcaaattcggctaaagatgaacccctgatggcctatgctacttacttctggtccaataccctcaatgcttttctattcaatcaagggccaatgactcccaccctgctcgatatcaccatgcttactggattggatgtaacttgcatcggctaaccccatgagcttgaacatcaaaaaccagtttgattttaggaccaagagcataggtggctagtctggctatgttgccgcatacatgggcaaaggatctgtcactcccagggagcacacatcttttcttctgatgtggcttgagaaattcctcttttgcggatcaagctgtggccctaccaccaattggcaattcttagctgaagcccttgagactaagaggtagtttcccctgggcaaaatccttctcggctatctataccaaatgttgagcaatgcatcggccaagatagccacaggttcagtagtgggcgcgggtggaccgtggtggttgttgcaaacatggctcaaccttgttgttatgaaggttgtgaatcggccacctctgacagatgtagaattcccacggctggagcccactaccaatgatgatggagaagaggtcacccatcgccgatgcatgtcgtatggagaagctgcatcgacaccagccgattctggagcaaagctatcagccaaactactcaaagactggttctgcagtttctatgagggattccagagagatgctcgggtttggttcccatatgaggattcagtgaactttgacctcccagcaaacttcagatttgaggatatcgactccgagaaatttgacaaatccagagaagtcttctcggctgctattagtccttgcatccttcctgttggcatccaccaagggagaaatatacaagtgtcctatgagttctaccatccgatgagctcagctaggcaatttgaaatggggcagctaccaatcggcttgttctttgccgataagatctagtgcagaggagaaatctcatcaacattgataatggatcggttgcttaacatcccaggacctcctttgggcagtatcgagaacatagaactggcaaggttcaagagtaggaactttgacagatggtgggttgaatggaagcaacatatattccatcagtcggcttctatgtacatgacagacctatttcctgatgttgtccctcaggtacatctttagtttatcaattttgtttgaataattgttagctaacttgaatcttgactaacttctctctttaccttgtagacaacagaatcttctcctcctcgcaagagcaatagcggtagggacataatatatgctccaggccttctaccaaatggaggtggattagctcttccagtcatcggctaccatgccccaggacctcaagtctacttcaagggcagatgagagaacctgccgatgttggtaggaagagaaagaccaagtcatcggctattgatccatcggctctggttcccaaaaagaaaaccaagaagaataaacccaagccagccgatgacttgcctgccttagatccatctaccttggatgaagaggaaatcgaagaagatgtcgatcagcagcagccgaattgagtgatgaaggagataaaaccccatcggcttcacccaagcaaactcctccaactcctgctaccccgtctcacttctcaagggtaaaccactcaccatgactccttcttgtaatcattttattcatagccgatcacttataaatcttgtttttgcagaaaaagaagactactgtgaggaagaaatcggcagcaacaacacttaagctagctcgaccagtaagattttctatacaaatcctttaacacatttgaccatagctgatatttacttaacacttgtctctttgcagcctcctcctcctcctccttcacctcatgtgcagcaaatgtcaagtgaccggactccatcggctacaggaagtcaccaagttgaggaagaataacaaaccagccgctcctgccatcccagtaagtttttcactatcgtaaaattttagatcggctgaatttgtttttaattatcttcaaatttctcttttgcaggtcttaactgatctattttcttttgacatcaaggattatcttgatgaaatagaagaagacaccaccagtaaagccatagctcctctgtccgatgatgtgaaaagaacacttgaagacatctctcatcggctagaagcatcatcattagatagcttagtagtcgactgtggatcaatcaggactagacttcatgaaattcagtctttgatcccagatgacctagctaatattcttactctagcagtttatctcgaacaacatcaattcaggctggagaaagccaaacaaagattagctgaccggcgggaacgcgaggacattgaagctaccaagtcaatcggcaacttgtgcatgaagaaaaggccaagcttgatcaactctctgtcgggccgattcaatccaatatagatcggcttgaagctcgccagattgatcttatagcgcaacttgaagaatgtaatgtcgagttagacctaaaaaaacagaaattggtcaatctccctaatgctgttgaagaacaaaagtcaagattaaaatcggctattaggaatgttaccgatttgactaagtccctcaagatgatctctggaaccgacgctcaaaacgctcaaataattgctgaggtggaagagatcaggcaaaatgcaatatcggctatccagtgctatctatctgcatgattggtcttgtaataggatttagaacaattttttgtaatcggctcggaaaccttggtgttccttttgttactgaactgttgtgccgattaatataacttctcaatgtgctcgctcaaaaatttacaaatttgcaacttgtgtatatatatgcccccctaattttgcaatgacgaaggcattgataaaattataatttggactaagggcgatataacaatatcggccattgtatatcggcaaaacacaaccgattacaatatgaaaacaactaagggcgatataataatatcggccattgtatatcgacaaaacacaaccgattacaatatgaaaacaactaagggcgatataacaatatcagccatctcaaggcgatgtaaatacatcggctatcatgtatcggcaacacccatacccagccgatcatgcattaacccaaacacttggtaatattttttcaagtacttgccatttagtgctcgtccataaacttctccatcaaatccttgcaacatataagcccccttggacacaaccttgtggatttggaacggtccttcccaattcggtgaccacttgccgaatttgttatctcgagtctctatcggcaaaatcaatttccaaacaagttcaccttcagaaaaagacttgggcaccacttttttgttgtaatgtcgagcaatgcattccttatccttggtaacttttgcaagggcttgttggtatttgatacggttacagataaaatctgcaagcgcacggatataccgtgtagcacttcccctactgagtattccaagggtatcaaatccaaggaaacatgtgtgatcagatcttcctctggttcatccaaggacaccaagcaaatgataggccaggatagagaggatttaatagtgagaaacagtgtctagggaaagcttaactttaatcctaacgcaatacttcaagcactggcaacccgctgttcccagatgtcgctctactacgtacccggatagggagaacttaagtgatctcgagggctttcaccacctctacacccacctcaaacgtactgtgggatatgcatcaattactgaataacaattacctaaacaccacgtctaagcaattaatatatactttagtgtttataactcaccaaagcaatcactatattttagttgattatagtgaacaataatcccgtatgctatttaagaactaaccaagcgataattctcacaagataaatctaaattactcaagaagaatattatagtgaattcagagtaataaacagaataaaagaaataggagaagattaccgacaactctggaattcttccgacttcttctactctactttcttcctattctagtatacaatatagtacaatagagcctcttataattcagctcaagcttggaagtgtgtgtgagagtgaatgaagtgaggtccttttatagggcagttatgacggttgtgagaaggggaattgtccgaattgccccgcaaccgtcattgggagaacaactggaacgtccacgccaaaccccaggatcaacggtgatcagggggggttcggccgaaccagggggttcgaccgaacctgggccgagccctcctggcctggccttcagttggtggactccttggaccttcctctgtccatttctcggagttttgggttgattcactgatgtcttgatgaagttcacaacccatccttgtattgatacatatttctcctcactttagtctgatttacctcccaacatcggagtttatcatctgcatacaaatatataccaacacttgtggaatatgtgagattaagcacctatcactatattggttgttttattatccgagctttatacagatgttggcggtatgaaatcgacttttaacagccgccaacaaaaccccccatacttagccctttgctcgtccctaagtaaagattagtgtagaatgaatttcttcaggatataaatcaagcatataaatcattcacaaccatacctgcacctgtgaactttatgagtggctatcttaccatcttgagtaattgataaatggaaagatcttgattccagtccttcttgcttctctgtcaaactcatgggattttatgaattttcgcaaactagctcttttcctcatattgactttctctcttgtccctcaaagatgtatattttctttggatcctcaccaaggcaaaatgtaccagaacttatccctattctaaggctaatatgtggatcttggtagggataaactgtgacgtacctgcatcatatatattgcaaagccaaaaatatggactcaagaagatcatcaatcatactcctagatcaagggtctttattcatggtggaaaagtaaaatatgttgtggaatggtggaataaataaatgattctccctttttcctatactttctctccaagttggttctcttggcatgattgtggaaggggcatggctatattttctttgctcaatgttttcagagcaaactttttttcttcttctctttttttttcatagccatgcctttccctccttttctcattttctttttgccaagaacttttccaggagaagaaagcatagttcactgtaggagtttatttgaatggatatttttgtggaaagccaacatccagtgtagaagccgagcttaattttatatgtggaaatggaaagtggaaatgataatgaccccttgatcatgagagtatgaaagatatctaacacaagtcacacaaatttgacaaagctcaatataatgtcaagcagtcatatgcataacaaggtttatcaatgatatacttgcatatggccttggtaggtataaggtaaaatcaattggaggattgagcctttaaaaacaattttactttaaaaacaaatgcccaagagtcataacaagagttgcaagaatttctttcatcttaatcatctctcataaagcaatcacttggatgtataaagttccctaaacatggatgggtgttcacaagctcgagttcagctgagaataatgaatatataagatcaagggttaattagatccatgccactagaaatgtggaaaatcaaaaatatgccactactattcaagttatctgctgagtgccacagtaaatttctaaaattagaaacgtgccactctagtcactctttccgtcctcctcatcctttctccgtcctccccatccttaatcatgccacagccgcagccgcagggcggactcccgcgcgagctacctcccgacgtagaacgtgaaactggcggagctcggcaacgaggcacaggtcgcggccggtgagatgttggtgatggtctccggcacggcccggcgcatgatacggccgatgttggccatcgacaggaatcggtcctgctccttccctactcctcctccaccgccgccgctctccgtcccgtcgaacccctccgacatcgctgggccctggccgccggatttggacttgtcttgtcttgtctagtgctcaatggattcagaatggctgcagcgatgcagaaacgagagggaaaattagagttaaatcagctgctcctgtctctcagttaattttgtactaccaggaggtgagacagtgcatgcacagtaagtagtgttgattgatttatacaacggttttaaattttgtttattttcctgatttgaaattgaacaaaggtctttagaacaaacctatttgtgtgattctatcccagatcggcaaggaactccctgcatccagtggaaaaacctagcaaaagactgccaactctgcatcaagcatcatcagttgcaagcagattaacgagggcgggaggaggaccgccgcttcttgcaaccaccggctgcggcgcagggcgcggagaaggcgaccacggagtctgcacgctcgatgcggagctcggcgacgaggcgcaggtcgcggccgttcccacggtcggcgagataggcgagcacagcagtgtcggtggcttcatccgaggcggtggaggaggaggagaacggggagaggatggggatgacggacaggttgacggggaggatggaaagagtgacggcggtggcatggttccaatttgaaaaatttacaatggcatctagcagataacgtgaatagtagtggtatatttttaatttgccacatttgaaggggcatggatccaattaaccctaagatcaatcacatgaggaatttcattagttggaaattttatctgatacttatgcttgaaccaattgttttctgaattttcagctctagtactatgccatggtggagatatacagatacaagacgtgctcacctacttacctgtgaaaattgagaggtattggggccaacactggctcggccgaaccactctggtgcccaatacctctgcaactttctgcagagttcaatgcttccaggtgttcaaacatttaatcaattttccgagtatatgcatgtcaaaggctgggatatatcccccacacttattcaaaacctgaactttattaagcatgaaacaaaacaaactttggcaaacattggggttaacaccaatgagccacattattcatagcaagtgcttacatgaaaggaaagataaagaccaagcacctactactattttatttatgggaaaggaaatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctattctggagcggccgcaattgtcattttactcccaactattttttgtccatggtgctgcgtcacctcttttggcccaatgggctgtgtatacatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaatcgcccgtctgcctgtaatcggaaccccaccatattgtgtttgatagtgaaactttcatctttatcta

SEQ ID NO: 58963 - DNA, 26036 bp, Oryza sativa
taacttgcagagtcacatggccggagggaaaataattcccctctacttcacatacccccgggtccatatctccgacgtagcccccggcgctatatcagatatcgatttcctgagatcgttctgacatggcgcctcacgactcctcgagctggggttgtgggcccggcaggaatccaaaaggatatcgccgcgtggccaggttggcgtgctaaccataacagcggtttgaccgccactgaccgcgctcatgatgaagatgcttgaggcgtgataaccgagagggggggtcagtcagaccacgcctcgattctctcgctcgctactcctgcggcggtagttgtgacggtttgctcaacttgcgctcatggccgttgcgcacttcaccttgagtgtgccactgacagacgcactaaaggcgggagcggatacaacgggcgacgtgatgagtgggcgcaggatgcgaagagacaaatgcgggcgcgaggatcgtgggagcaagtatgggagcgcgaaacgaggaggcgagcgcggatgaggggaggcggaggcggagactctgtccccttcctttcgccaaccgcccactcgtcctttcgcttctcgaaccctaacattctcgccacctcatactgtctcgcgctccacgctctccgccatttctccgccggttgccatggcccaagacaccggcgacacagtgttcccttcctcccgcatcacagcagacaggcaccttagccttccccgcaagatcatgccggacggtgccgtcgtgcgggcgggacagtcgcggccgtggccacgatatccggagcgatccgtgcacctcttgtccttcgccatggcgggcttgattccgccgttctccagattcttccatgaggttctggatttgtacgaaattcatgccttgcatctcgcacccaatgccgtgatgacgctggccatcttcgcgcatttgtgcgagatgttcattggggtgtgaccgacgatgtggttgttccaggccttcttcatcccacagctgctacaaagcgcggtggtggggggatgctacttccagccccggccaggcacagcgggtcagtacatcgagagccatctccgcaagaaatgggaggactggaagaaggactggttctacattgcgttgccggaccattcgcgacttcgagttcccgctggccctcctgaaaggtctgccgcatggctggcgacttcggagctgggcgaggaatacgacgcggtgtgggatcgcctcaggggcctgcggagccttggcctcacgggggcgatggtctttggcgattacttccgccgccgcatcgcacctcttcaggaacgatcccgtagagcgtgggaatacaccggtcccaacgaccccatgcagacgcatgtgggcgagcgctgggactggggtgaggaggacgcgaagagggtgattcgccgggtgcttggcctagactctgccaagccaacactaatcccagatgggattcttcccctctgctgcgaccgcgaccgggagagcatcctggccgtgatgtcagccgttggcgccggtaggagccggtccagcggaggcggcgccagctgtagcgccgtcggcacgggtggcggtggtgcgaccttgagcgggagccgggccggcagtccaggcggcggtggctcaagggcgcctggatcgagcagcggacccagagacgattccgccggcgacccaaaggggaagcgaaaggtggcctatccccggccgccctctcccccgcatggaggaggtgccgagcgcgcaacggatcattcgccagcgggccacaagcgacctgccgggcccgaggctggtcagaaaaagaagcggctccggaagatagggcaaacggagccatgccgggggggtttcatcgagcccccaaagtggaccttcaaccaccctccccgtaggtacgattgttggcgctcacttcggtgcccttacccaacccattctcttgtttcttctttttcttttgttaacatatctaggttctcttgtagcgagattccttcttagggaatctcagggtcagaccccttgcaagggacgaaatccgaacggtcggggcagtgtgggcccggccagtccaaggccgtggggttttcgcagcctcgcggcgggacccagaggacacgcaccgggcctgatcccgagcgaccctcaggcgggacccgtcttgctgcgggcgacaggggtggcgacgctcctcccgggggcggctccgggaccagggtccacgcggagcaccaccctggatcggggggtgagggaggtcgcggcctgggagccgaagccggaggtggtcccgagcctgaggccgaggccgaggccggggacggtcccgagcccgaggccgaggccgaggctgaatccactcgaggacccgaagcgggggggtgagagggacagccgttccctcttgggcgcttggggcgccctcgaggctggtctcgcagaaggggggccgagagcagctcccagtctcgcgagggatccagcagtaccccgtcgtcccggggacggaccacggccttttcctccccgactccgacgagtatggagccacttctgcaggtgctcgccgccgccgactccactgtacgagaggggctgaacacccaagttcaagccctggcggaagagcggacggccttggatgcagagtgggcacagctcgccgcggaccgcgcgcgagtcgacgaggggcgtcgcgccgtagacgacatggtaagggtggggcgcaaaatgcgtcaaacccaactaaccaaaatctaggcgcgcgaggaggcactggactccgtcatgcgggaggcggaggaggagcggcaggcggcgctgatcgcctcgagcgtcctggatgaagcgctgggcgatatccaccttcagtacgaggctcacgccgaggacttggcgaagaggatcagggacgcacgcggcatcctcgacgcagccgctgcccacgggcggcgggcatcggaggccgacgcctcgctgcgggcctggacgacggcactcgaggctgaacgcagggccttggatgatcgtgcccgctccgcacaggagttcgaagccacaatccgtcggcggatctaggtcctcgatcgaaaccagcgcgagcaaaatgcgcgcggtgaagaacaggcgcagcgggcccgggagctggaggagcgagtgcgcctgcaagatcagcgggagtccaccttggccacccatgagagaacggcggcagaggtggaggcttcccttcggctccgtgaagaggccgcggccgagcgtgatcggatcaccctcgccgcgaaagcttccgcggaccgccgcgcggaagagctacggctgcgggaagaggcatgccgggaactggatgccgcactcgccgagcgcgaagccaaggtgaatcgccgcgaggtagcctcgcgccagttaggcgagcaactcgcgaaacgcgaggaggccgttgtcgggcgcgaggctcgtcatctggagagcgcccgcgccgagcgtgcggcaatatcagcgaaggcctccgagctggaggcccgggagaaggacttggcagcgggcgggccgcccggcggcgcggggttggcgagccagctcaccatggctcagagtacccttgccgacctggaatgcctggtgcaggatcaggctaggaaaattgcggccctccacctcaccaacgagctcgggcccgggcaactctccgacgccgtcgaccagctggagcgcgcggggtgccgagtcggcatctctttgcgtcgggacagcaaactcctgcccacacagccagcactcgcgcttcggctggacgggctggcggtggacctggagaggctggaggaggaggtcggcgagaccataaagtctccgtcagtttctttggcacgggctacggtggagctggtcctcgcgagccaccaagcgcgtgaccccgaattcatgccatggcatgcgctcgaagattttcccccgggtaccgaggcaagggcccgggagcaagtccgggaggcggctgacacgatggtctcgagctttgaggggtcggccccccggttcacctccgggcttacctcagacgaggaaaacggaagcgggggtaatgacggtgacgacgactgggacgacatcgtctgtggtgccgacctcggggggccgggcactcgatgaccactcgcgcctttaattcccttttgctgtgtgcccatagcaggcacttgtatttaggccattgtgccatcctatcttgttctgcaactgaaacttctttaaccccttttactcttttgctttttccattggatgcctgtgacatagagagaagaaaaaactagggcaaaaggggataattagactgcctgcgattgatatgtcgttttgaccccatccccccctggggcttgttctagcgagaagataaatccgcgctcggtccatggaatctaagtggtgataggcaagaccatcaccccgagggagccgcccagcgggactggccagaccgaggctgcgacgacgggggtcggggacgactgtgtgtaggcccttcggatcccccggggttcggcacaacccgtgccgcggcctgcgttcgtgctccctttcggcggttttcaggccgccttatggcacttagggtttagagtaaacgcggacccatgtcgtcacagtaatcgccaaaaagctcactggtgaactgggtgccgttgtctgtaatgatacagttgggcactccgaatcgagacgtgatgcccctgatggacttaagagcagaatgcttgtcgattttgacaaccgggaaggcctcgggccacttggtgaatttgtcgatggcgacgtacgagtgctgatacccgcctcgagccgccttgaatggcccaaggatgtccagcccccaaactgcgaaaggccaagatagcgggatgacctgtaaggcttgggccggctggtgggtctgcttggcatggaactggcatgccttgcaccactggacccattcttgggcatcttgtaatgcagtcggccaataaaaaccttgccggaaggcttttccgaccaaagttcgtgaggccgaatgtgctccgcactcaccctgatgggcgtcggctatgagctcgatgccctgctctcgagaaatacactttaagagtatcccgttggcggcacgccggtatagggtcccttctacaaggacgtaccgtttggagatgcgcgtgagcttttcagcttctgcgcgatcctcaggatgagtattgccttcgacatacgcccggatgtcagtcatccacacgacctgatgaggggggtcggggttgaccccctcgggccccgaggggcgcgggtcgcccggagtcgggtcggagggcgtgtcattggggtccctcaaagggctcggtcgcgccgatggttgcgcgagcctttcctcgaaggtccctggggggagtggggctcgtgctgacgcaacacgcgacaactcgtcagcaattgtgttgtcgcgtcggggcacatgccggagctcaagtccgtcgaagtggcgttccatgcgccgtacctcgcggacgtacgcttccatttgcgattatgccgcacgccgttccggaatgcatatacaaccgcgtgtgttgggatgcacggaatggtgttgcggacctgacagaagcgctgtatgtacgaacggagggactcatcatcattccgccgtacagcgtgtaggtccgcctcttcccccgggcggggatatgtgccctggaagttcgtaatgaactgctggcacagatcctcccaggagtgaatggagccggggggctgggtcatcaaccagccacgcgcctaacccttgagggccatgggaaagtaattcgccatgacccggtcgtcaccccctgccgccacgataaccgtggtgtagatctggaggaactcggaggcattgatgctaccatcatacttctccgtaaggttggggcgaaacttcggaggccaccggacattccggagactcgccacaaaggccctacaacccgtccccccaggggtgagtgtggggggagggccgcctcgtgaagaggagcgtggcgctccagatgaggaggtgccttcccccatacgggcagctcggcgctcgtctcggcgtcgctcgatgttgattcgagtgtcctgcgtcccgtagaggccgtcatgacgcctccggcttcccgaggcccccgacgatgttggaaccgtggaccgcctcgagatcgtggctgatcgacgagcccttctcctcgccgacgaggagagggtgaccgaggtacgtgatgtaccagcggcagtggatcggccacccgtggccaactgccggccacccgtggccaactgccgctgggcagtagtaaccaagttggccacatcgtccaaccagcgctgaacaggagtctccggctccgggtttaccgggggatgccgcagaagggcgcctgctgcctgaagcgcgccttggggcgaaccgtcgtctccatagtcgagacggcggcatgccccgacgcgtcgtggcctccctccgccagggggtggagagagagccgaaccatccgaacgagtgggatcctccttccgcgaaggttcgcggtggggaggagttggagaaccattgtcacgcccggaatttctatccaaaattccaaacgcttacatgtgtgttaaaccctcgtccaagaatcaaccgaggcacccaatgacaaattgataatagagtacaaataaataactatttaatattcgcaaataataaaagattacagaggtagatagttcctctcaagaataacattttacgcagcggaaatataaaactataacaaactacggaacagctatggcgactccactccacaggcatcttaaccaagaacaagcctaatcctccagatcatcaccttcactgagatactcgtcttctgatgaatgaatattgcaagaatgagcatatgacatactcaacaagtcacacagcaaatatgcaagtgcacaggataacaaaggatggcataatatagctcatttgcagaaacaacatttaataaatattgaagagaatggtaaaaacagttgaataattaatcaatattaaataacaccatacaacacaaccatgttgcataggcccaaccacatttgaacaaccaaccccagttgaacaaattaaacctccaaaccaggaattatccattccaaaccaggagtcaaattaattatcacattattaacattgatgagtagtgtgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcacaacacaactcaccacagtgcaccgtacctggatcataatcaccccctctacaaccagaggcatggactccccagcgaccccacggacttctcgccgcttctcagtctggcactccgtaatgaatcatgctatacaaaaggtaaagccgttgcccacgctggcttgtggttggcacggtaaaagtttcacaacagtagctcgcgaaccggtccttaattgtcatgagcacaaccatcaaaaccatatgctcacaacccaccttaactaggttttaattatcaattaattatcatcacacgattaaccatcgtgagctaccatttaatgtaaccatagttaaaaataataatgtgacatagtttataattaatccctttagttagctaatgtttctaagcatggctaagcaaacttacatatagcatttagctgaaccaatccaacatataaggttcatgctatccaaattataacccataggaaaataagatcatcttcggccattaattaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagatttaatctattagaaaatcgggaaaaagaaaaaccgatgacgtcatgatgacgtcatcaatggcggccggctcggatggcaagctcgccggagattgaatgatcggccgcgaatttggagagcatgtacacgtagaggacgacgaggcgaacccaacggtactcaccctcgtgccaaacgacaaacgacgacggccggcgacgaaggggcggtggcgacggctcggcttgaccgacgacggcgagctacggcggccgacgacgaagggggaggtgcggctgaggttcctcacctccgtgcgcacctaacggcggcgagaaaaggcggcggcgacgacgcaagtggcggcgcggcgcggctggtggttggccggcgacggcggcggctaaagcgacgcggcggcgactctacggcgcactagagagctcgggaaagggggcaaacgaaagaggaggactagagggtcctatttatagccttggattgaagagatcggactcctcccgcaagaaatcgattcgggaaaaatctaaactcggttttggagataaactcgaaaacaaattcgattcggataaaatacccaatgatttgctccgattcttgaggggaaagatagaggaggatgtggggataaaaacccctcaaacaatcggaagaaaaagggccggattgggtgcggatttgaggggagaaggcggcggctcgggcgggcagctcggccggcttgggctcggccggaggtaggagaaggctccgacaggtgggtcccacctgtcggtggctagaggaggaggggcgggcggcggctgggtgggccggttttgggccggctcggccgcgcgggaaagagggagtgttgggccgaattcggcccaacgacttaagggagggcttttggaactttttaaataaaataatttgtgaaatgttgtttcaattattaaaaatacttcccttgctcaaataattcccagaaaattctagaaaatagaagagcaagcatagtatttaataaaattttatctagctcatttttatgttgaaaattttcctagataattagggtttagcttgtaggcttttaaaatattttctaaaaatgatttaaaatatgcatttttaatttagtcgatttttagggcgtgacaaccatggcaacggtgacgaggacctcggctctcgccggaatccccactcccggacggggtgggagtaaacgccaccgcctcctcctctacttccaggacctcgaccatggtcagctaaggcctggagaaaattgggacggaagaaagcgacttcctctcggaatgcgcaaccgcccctacctggcgcgccagctgtcgagggaagatcctcaatagcggggagtcgtgagaccccccatttgtgagttctgccgggggcggaggctcgtctctcggaaatcactcgctcgtccctaagattaccggcaagcttgcacgtagtcggattatataggttcgggccgctatgaagcgtaacaccctactcctgtgtttgggattatggatgagttttacaaaggtttcttcactctagaaagcgcgctcgcttcctctcttctggagttcaggttttctgggcgtcgtccccttatctcagtgggcagggtcctccttttatagctcaaggggataccacatgcgccgcctccacctaccctctatcggagggggatcccactccacttttcctgggctttaaaccgtgccttctcccggaagctaggcaacaaccggttctcgagtggaacccggcgccgccccccgcctgacacgggggacagccctgtcattccctcataaatgaacgatgacttgcgacagcccttcctcgagtgacgctcggatgtgacgggtcatacccacccccactccgccgggtacaagggcgacgtgaggacatggttgccctatccatcggatgtgacggtgacaggccgttcacagaccggtcacatccgttggacagaggttagctaggcgcgccgcacgtctgcccttaccgcattaaatgcggtgagggacagttggggcgtcgcacatttatggctgttcagcctgtgctcccctctcgctctctccctccgccgcgtggcagccgggtgagggcctcggggcgaagccgcgggatagcccgagggggtgacgccatgccccgaggcccccccccctccccgccgcttccacgagtcgcgtgacgcgtgaatggggctaacttgcagagtcacatggccggaggaaaagtaattcccctctactccacatacccccgggtccatatctccgacagacctgaaagcatatgctattgctagctaatctctaaagtcatgcaaatccaagtgaaacgtcacctaatttcgttctatatgtatgcatccttttctttaacacaaatttacaccccacttacatcttacttacacatataattactatgtaattttgagacttacatatgtaattttaaaacttacattataaatacactaaatttacatatgtaatttagagacttacaatgtaaatacaagctgactatttttgggtgaaaaatatggcgccataaatatagctacacccaaatgaaaacatgaattcagtatttgttatacgggatttcggatacatgatattgttataatgatgtttgacatcccaacatctcatattattcagtgtcccaacagactttctcacgagtcgcgagaattgtgacccctcgacttcacgagtgccctaaggacaattattttgtgaccgtatgattgaaggcctgaagtatatatgagtgtaggacgccatgccatcaggttcgtggagttgcggccgatggcaaatgagaaggcggcggtgaagcgcccatcggtgccgcatcgtcccagatgttcaataatataggggagagagtaccgtgcctactcaacatgttttattgtattgacatatattggtagaaataagaaatgattacatataaggaagcataatcataccaagatataactctaactagcatatgtttttacatcctgacaaaatccaagcgtgagcaacgcgaatggagaaagctcaacaaatatgttgaatagcctttgtgcaatagccaatatagccgaagcaaagggtgtgagaaagcgtggttgaagaagccatacgtagaataagcgtggtcgatgtcgtgtgccgatgatgagcgaggatgctaagccgcgatgtgcaaggagcgccaaggaccaaggtgcacacatggtcgccagcgctgaacgtatggatgtgcgctatgagggggcatgttactgaatatttgcctatatgcatgtgtggttatatttgttagttggaccgactgggatgtcaggttctttgagggggtgtgtgacatactagcccaattaggatttggcatgtgtggtccatgagatctgtgtgcgcatgttaagtaccaccttactaatttagcaaggttggaaccaacttataagagtctatccctccaaccatatcactcatgggttaactcttttacacaaagcaagtacgaaagagtaagtgcgtatgcccgttcgatgggttggctacgtggttctggagggtaggctgttacaacgatgaggctattgccgcagtcgttgaggaagatgacgctgaagagctaatgctatcgaactgtcgagaacaagacgtcgtgccgggtttgccaggctcaaggacgactcaggttgaatgcacacagtggtgttgttaataccacgccggcggaagtagacaaagacgaatgcgaggtagcaggaccaacaacctggaacagtgatgtcggtagcttgagctacagcagctaaaccactggcctagagcggcgatagtggctgcatgaagacgtggtggtgcgcgtagtagtcaaagaaaatccagacagctgtgttaacaccaaaatttggtaagattctttagtggattcggttaaggaaagagcacaatcaaccattaaaaagcttatctagaagagtccgagttcaaaaaagaatcatggagaccatggcataacaatgtaatttatctattaattaggcaagttttgtatttagaaagtttgagtcatgtccgatgaggactttatgctttttcttttatctttaggaaagtttctttggtgtccaatcaagactagtatccgccgataggtataaatatgtacacccaggatccttgtaatgtatctctcggtcaacacaatttcggcacatcgccatcctttttattttcgtctttctcgactagttcttgtttcgagtttggctgcatcaacttcgatctccaacgaggggtaaggcttattatggctggttgtatcggcgaggctagggcctcgacactctaatcttgtcaatgtaaacacctagtatttatcttatatcttagttaatctaggtagattctcaatttacttgtatcggccaaatctattttaggttttgttagtatcatttaaattgttttaatgatctagattagctaagatatctgttggtatttcttaaccttacagataaaatccgcaagcacacggagaataccgatgtagcacttcacccgggagtattccaatgtatcaatttccacaaggaacatgtgttttcagctccttgtccggttcatccaaggacacgaagcaaatgtaggcaaagggtagagaggatttactagtgagaaacagtttctacggaaagcttaatttaatcctaacgcgatacttcaggcactagccagcttgctgctcccatatgtcgctctactgtgtacccgaaaagggaggactttagtgtaattgagggatgtcaccacctctacacccacctcaaacctactgtgggatatgaagtaatcaccggaaattaactacccagacaccacgtctacgcaattaataactactttagcgctagctaaacactaaagaagccactatactttactgggttatagtgatcaatgatcccgcacgctaattaggaactaaccgagaggtaattctcacttgaataaatcttaattactcagaatgataattctattaaagcagtgtaattaaaaaagtaaaagaaataagaagaggattaccggcaactcaggaattcctctgacttcttctactctactctctctctctctctacctaactctagtatacaataaagtataatagagcctcttataatttagcttaagtttggagtgtgtgaaagaagtgaaatgaagagctccttctataggcaggtatgatggatctaaagcatgtgaaatgtctgaaatgacccgcaaccgccatcaggacgtcatctggagcgtccatgccaaacccagcctgaacggctgagattgagcttcagccgaaccccttcggctgaaccctggcctaaccaaacaggcccaggatttggcctgcacctctccctcagcctgccttatccatttccaggagagttgggcctgctttctgatgtttcgatgtagtttaagacccactcttgtatggatagaattcttctttcacttaagtctggatttcatcccaactttggcggtttattgcctgcgtccaaatatacaccaacactcgtgaaatatgttagaactaagccttaccagtatgttagatgttttattagctgtcaacaaacccctcacacttagctctttactcgtccctgagtaaatgttaagatgatagtgtagaataaaattctctaagacataatacaagcacataaattattcaaaaccattcacgtacctgtgaacttcaatggtggctaacttaccatctttggcaattgataaatggagttgtgtgtgcatgtttagtaccaccttgctaattagcaaggttggaaccaacttataagggtatatccctccaatcatatcacttacaggttaactcttttacacgaagcgagtatgaaaaagtgggtatgtccgttagatgggctaggttgcgtgattctggagggtaggttgttatagcgatgaagacgaagacgataaggcgatcgtagtagtcgttgaggaagatgatgccgaagagccaatgctatcgaactcgggatgaatgcgcacagcagtgttgccaataccacgtgggcgaaagtagacgaatacgaatgcgaagtagtgggaccaacaacttggaacgacaacgttggtagcttgagctacgtcagctaaaccactggcctagagcggcgatagtggtagcctaaagacgtggtggtgcccgaagtagtcaaagaaaagttggacagctgtgttaacgctaaaatttggtaatattttttagtggattcggttaagaaaaaagcacaattagccgatggaaagcttatccaaaataatctgagttcaagaagaaatcatagagaccacggcatagtaacttaatttatctaataattaagcaagttttgtatttaggaaagtttgagtcatgtctgatgaggactttatgtttttccttttatctttaggaaagtttgtttaatgtccgatcaggactagtatccgcccatgggtataaatatgtacacctagggtcctagtaatctatctctcgaccaatacaacttcgggacatcgccatccttttcattttcgtcttctcgacgagttcttatttcaagttgggctgcatcggcttcgatctccaatgagggataaggcttgctctggctatttgtatcgggtggggatagggcctgcacactctaatcttgtcaatgtaaatacttatttatcatatatcttagttaatataggtcgatgtctcaatttagaagcaaatagaagtacgtgagtatgtctttaattagataaagaggtcatattactatataattgaaatagaaaatttattaaattaatatatctttataaattcatctttagtatacaagaaaaatattacttaaaagtttaaattaagatgctaaatatttttaataaagaaacccatgtagtataaataatagtttcatatgaaccaggtctattgttgcaacatatttttttcataaatttaagacgacatgattcaagtaattttagtttacaatttgtaacatcccatcctccagaacaccgtagtccaacccatccaactgacgcgcccatttacaaagatcaccttactcacacttacgttgtcgcttcgtgtaaaatagacaaatggttggagggacgatgccttaggacatgagcaatgtatattgcacaatcagtccttattgtgggccctaggtgggtcccactgagatatatttcatcttcacaatgtatattggagaaaggaggttttaaggtggaccccacaattattaccattccaaccatcctactctccctcagtcaccagaattttccccaccccactgaggcatcgatgaaaatagcggtagctcgcgcgagtggagccatggcgacggtggtggcactcgcttgtggcaacggcggcagtggtcgcgtgcagcggcccatagaattcgcagcagaggccgcggagctcgcgggtatacacggagtcgacaacggcgtttgcgggcacggatggatccggcggcggcaatgatgaagctcgcgggtagatctagctacgagactcatgggcgtggatggatccggcggcggcacacatgggcacaggtggatccgacggcggcggagctcgtgagaggacttcggctgcaacggtgctcgtgggtgggcgtgagtggatccggcgacgacgctcgcgggcgcgggtgtatccggcggcagcaggaattgggcacaggtggatccgacggcggcggagctcgtgagaggacttcggctgcaacggtgctcgtgggtgggcgtgagtggatccggcgacgacgctcgcgggcgcgggtgtatccggcggcagcaggaatactcgccaccatctcccggcggttcttcagcaaatctatccaggtgtattcttcccttctcccatggaggcaagcaactgaattagagagagatgggctagcagtaccatagcagagagaagaacgaatgttttattgcttatagccggtccttagccaataaacaatcccgaacaaattatttataaacgcagatttataagagtaaaaaatagttttcttgaaaaatccaatacataaatattcgtaacaaaatgtcaaacaccaaataaatttagttaccttcctactttacatagaatgagcgatcatattcgacgaccaaaatgcaaccggccggctgccggcacgcgcctagtctcgtgacgtacgttgtcgtcacacgtggtcatgtagaatttttattgttggatttattatggggtattttgagtttcttgccggcactcataacctctggtagacttactattggataatttgaatatccttgatacattgatgttgctacaaggatgtcgacgtctcaacatgatcttattatatactagcgcgccggtagtctctatgaccaacaaattaccccactcctcggccattgacctctccctagtcttcctctcgactcgcgagaattatgacgcctccacttcaccagcacagtatccgtgagttgaaagctcaatctgtgaccaagctcaatccgtgagttgatttcaatttttgtcaaaatgctgccgaaattttatcaaaattccgtcaaattcaaattttgtccaaattgtaatgtcaaaatctgtccaaatctgtcatttaattttaaacatattcaaaaaataaaaagtaaattgcatattggtcctggttttcttacctgtgttgcacaatggactggatgctatcccatgttttcattttaatacatatatgaagttaccaaaactttcatcttggactagtggcccacatgtcatgtagaaagtgttttcttccatctctccgtcttcaccgacgaatgcatcaatctcatcttgggcccgtggtcagtggccagcagtccagcacgagtgaagctttgctggtgtgatttgcttggcgttgattccaatcgaagtccgatcttgaggaacgcaggttggccaatggatggaccgagatcgatcgagcgccaagctgaacgcgaggagattaagctcctacccgaggatggatcgacggttgtacgtgccttcaccagtcaagctcgaggggcgcccgcactcgtctcccagtggcaacgccaatgacagagcccattccatcttgcacatcgcgtcagccggtggagcggtcgtcgacggtggcgccatttcatcccacgcagcgggcacagccaatggaacggacgagcggtcatcttcaagagagagggatgcggggaagagctgcagaggacatgccggcggccactcaatgttcgtgcagcctgccaggctgctactgctgcattactggggaagagatgagctctgcccgatcaggatagggactaataaaagaggaagatgaatggctgaggctgacatgtgggtcaactagtccaaattgcatagtttagtaacaaaacctggttcaaagtgaaaatggttgtacgttcctagtccagtatgcaacttaggtaattaaaactagtccaaagtgtaattcactcaataaaaaaaatttccaaagtcattgcataatggggaaaaacacaattgatgaatagttatgggagagggcataaatatcctatttaacaccgttaactcctccatccaaaacaggggcaaaagtatctttcggttcaaaaaaaagtgggggcaaaaacgaaaaccctaaaaagtaggggcaaaattaatattagaaatcaaagtgggggcaaaaacgaaattatcccaataatgccataaaaagttgctattgctttatatgtcactgctttatctttttctttccctatatgtcatccacattatcatctttgtaataggaatgcaaaagtacaacataatcctttaattcctcgagagatgtccactcgttttttttcatgtcctccaaataattattaaaaaatatttttaataagatagaataatatgtgatatattagtccccaaatatgcaagtttaaatttcaattttacaagttttctttcaaaaaaaatcaaatttagttgtaagcacacgtatactaatttcaaaattttgagagattgtcatgcggaagaagacaaagaacaagttggatgatgtggaatttttgagttacatcacttttagttatgagaaaatttatatatctctactattattataaaataacagtcgtccccctcctgtttccacccacaacatccagagaaatcgctcagtttatgcccattccacactctagaaaaaaaaccacatcgataacaaaaagctgaaagaaaaaacacgttccagatccaaaacattcatatgtactactccctccatctctaaatatttgacgccgttaacttttttaagcatgttcggctgttcgtcttattcaaaagatttaagcaattattaattcttttcctaccattaattcattgttaaatatacttttgtgtatacatatagttttacatatttcacaaatttttttaaataagatgaaggttcaaacatatttaaaaaagtcaacggcgtcaaacatttagaaaaggagggaggactgtaaaagacatcgtcctctagttcccactcatgacatcctagaaaaactgctcagttttccatatcctaggaaaaaccgcttagaaaaataaaggaaagaaaaaaacacgttctcatatctaaaccactaaaaaaacaaaagaaagaaaaaaaaaacacttcaccagatcccattacaatacatgcgcctgtgagtatatgactagtatccaggtatccttaaaattccagccaatccattctatgcctcctgctcattccctcgcatatagtccaaaatttttgtttggctcccttccttatcatttctactggttgatcatttaattccaatgataaggtctattttggctttagacatagaagaaatgtagaaaagctctatgttgaaagggtacaactttgttgtacttgtacgagaccatatatcatataaaatctattgtttttgcctacaacttttgccctggtactgtattactgttttcttaccagttgattgatgctatctgcaacgtccgatctagtttatggaaaattttactgcaggacactgctactgtgtggttttagccttaggacaccgcaaaaactaacttttgagggaaaacacttcataatcgtggtattttgccagtggataccacgccgactagaataataattttcgtttgaacaggagagagaaatcgtgtgaaatgtcaaaaacgtccttgggcccacatgttagctctcctatcttgtatgtggggtccacatgacagtgactagggcgagcggcggtggcctgcagccgagcagcgaggtcgggcagccatggtggacgagatgtggcgtgggcgatgcggccaatgcctgcggtggcgcgacctggcggaggagggtggcccgcacagcgcagcctctggtggtgcgatgtggaggaggagggcggcccttgcggaggccgagcggagcagcagcttggtgcagtgcggcggcgctgccccgcggcctgattggcagagctgcagccggcaagatcggcggcgaggtggccagccagcgccggcatacggtcgccggcgtggtcggcttgcggcaagcggcgacggcgctgcaaatgttgttgtccacttcccctccccctttttcattttgttttctttggtttcttctttctttgcatctacctttcctgccattgccatgtggaccccacatttcctgccattgccatgtggaccccacatatacaagatagaagagctaacatgttggcctaagggaatttttgacatttcatacgatttctctcttctcttcaaacgaaaattattattatagtctgcttggtgtccactggcaaaataacacaattatagagtgctttctcccaaaaaagttagttttgcggtgtcatagggaaacgactacgcgtcgggcgtctgattggggtgggaaaaatcgggtgcccacgttagcatgacgttagcaagcatacatgcatgcaaaactactttaaactattttttctcttaaattatttatccaaatcatgatctgaatacaccgttaaattcgttacaattaaatctttaaaacaagaccacatatggatatattccaatgaaaaaaattagcttattattaaattatttttaaatgttttacaatattccaccaagtagatcggaattgtttcactaattagatcgaaaatatttcaatcgtttaaatcgagtgttgttttactttatataaaaacaatgtttcatcaaataggaaagaatgtttcaagtcgctgcaattgatccatacatagtgaaacattataagtaccctggatgaaactttttagtggaacaaaaaataaaatgaattcctttaattgagagtttccataatatgtgggtgatttgttacaaaagaattttctgtcgacgtttgatgtcgcaattctggtatttgcatggtatggggatcgtcggtgctaggatatacgcaagactgaggtaaaagagatggagacaaggatttttatacaggttcgggcccctgagttatcaggtaataaccctacaacctgttggccgaagccggtattgctcttattcaccataatcacacaagtacaatatttggggtagccaatctaactgttgtcgacatggcggtttgacgatctgactcgtagtcgacaacggagtagcctttctcctcgaatccgtgcccggcgagatcagagatagcgctttcgtttctcctgacagtatccggagacaccgtagggttttagccgtgcttatccatgaagtcgatatccggcggtgtgtcttggcgtatgtaggcttctatgttgattgtgttgggtgttgatcctatcgtgtcggtgacatgggaccgggagtatcatgactagaggcttgaggcagacacaatcgcccacgtggcctggcaccctcgggggacgtcgggcccgagggtgatgtgttcgccctcctcttagtctccccgagggggtcggaccactccagcctcggccccgagggccgaggcgccccgacccctcgtgggttttgctccgcgtgtatgggttaggagagcacagtggggctcacctaaccacatttattgcggtttggttgagcgtgtcacgccgcatgtaacgcagtgcagtgcactcttttatccggtctgtgatcagtcacagaccggtcaaatcacgggttaggtggcgacaggcgatctgacgcacgcctcgccccatcccgtcaggacgagggcttctaggcgcttgtccccagctggagctagcgtgttacctcccagagatggcacgttagtcctggttagatatatgccaggcttcatcctaaccattacaggcgagatgttgtgtgaagaagggccaacatgtagattgctaaactgacacgtggtggacaagaatgaccgatttgtgaccagtctggcactggtcatgtcttcagcagacagccatcctcccacgtcacacctgtttccagcggaagtggaggtaggtatgggctatcccatcagaaggtcatttcggacagcaaccatacaaatctccgtccgtttatgaagagaagaaaagtccagtttggaaagagagaggagaagtctccacacaaaagagagagaggggtgcatgtggtatccccttgagatataaaaggaggaccttgcccacttagagaagggactggatttttccagattcgaaacccagaacaagggagaagctggctcatactttgtagctccttcatacacagatccaccaaaacacaggagtagggtattacgcttctcagcggcccgaacctgtatacatcgcccgtgtcttgtgctctttcgattgtcgcgatccttccatatacagagagcttagaatttcacccttagtccccggccgaaccggcaaaggggggcctgcgcggtctcccggtgaggagccacaagctccgtcatatcgggtgttgatcccgttgggtgttgattgtcttgtccccctctcctcctagggggccctatatttatacccataggtgtccccttgtccaagtagaactagggaaaccaatatggatacaatccgagtagtacttgtcgtttccatgtagaactctggttgtctttctttatccggaactcccccgaggtcagtttccgtataagacatggtatgtagtggatcctgccgagatttagtcaactactattaggtatgtggtattcataaccctgacagtagcccccgacttcgatgcaaatgaacgagttcatattctcaaccgtagactttggaggaactgttatcgagctcacgtgaccgttctcggtgagtttagagataacgttagagttcctttatcagcctcgtgcgagcaccgaaagggtttgtctaagccaatctctgatgtcgaccgagaaagtacagagcgtacgactaagtctcccgtcttgctgtaatcgagaatttggattgaagtcaagaaattttatctcggcgagtacaccatttcttcattccgtattccttgtcgagatccagcaaccgttctccagtgatcgagaaggcgtagagtctgcgatggagccttgtcgacatttgtcgtactcgccttagttgatcttggtgtagaaccatagagacatggagtcttcgataatgtcgaatagaattttcctgaaatcaatactcagaaaagaatattagatagaaatagcccccgagcgaatgctcaaagggtgaaatgttataatatgacagactggtgaattgaatgtacagactagtgctttgtatatgagcgtcttctctcttatcgactctgatcagtcagtttgtagagtcatacactctccctagcccccagccttgtcgtcggagaatcgttctcagaagataaggctcttggacctttgacctgcctcggttgaacaagcactgatcctagcccccagccgtgaagctggaaaatccattttcgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcattaagggatagtaggataggtttcaacgctaggtgtcatctgggtaagggatctctgggtaaaacacttggcgatcttgtgcacctgatatcagctttgttgaagcaagggtaataggagaatcgctacatcactggtcgaggactaggcagtagtcgtaactcgaccacttgaagtggaaatagtgggagaaacgctacatcgctggtcgcagaccaggcagtagtcgtaactcgaccacttgaagtggaagtagtgggagaaacgctacatcgctagtcgaggaccaggcagtagtcgtaactcgaccacttaaagtggaaatagtgggagaaacgctacatcgctggtcgaggaccaggcagtagtcgtgactcgaccacttaaagtttggcgagagagatcactgcgttttactagttcgagaaccagaagtaggagtcttttaatcacctataggggtgctgaagttggtttattacatgtgcatatcatgtggccagcatgactcacatacccaacttatagcatatccggatgtccgctcgcaatcatgtcgggtgatcaaaccgacgccgtttgcgaggaatcatccgttaacaaccttttcttgagtagtccagcaatggccggtgctataagataggtcgtcggtcttcgttggtaagttgggtgcgacgactccgcatttgtcgagaatgttctcgatagtggggtgtactcaaccacaacctactcgagtgctcaaatgttctcgaaaaatattttctagaaggcaagacatgcagtagagaatatcgagtatgtactcaaaaactgcatggatcttctagtattatcaggacataacgagcagatgtaaatgtcagggcattatgtaaaccgtaaacaagaatgatttatacagaagaagacagaacgagcccccagcgttagatcgtagtcgatttaacatcggggacacccgcgcaacagatattattgtataaagaacatgctctgggtaaatataataaattatagatctaacaatactgtgtgatctgaatatgtacgataaattgcagataaaatattgcgtacctttgtagatacatgccggatgtatttacgaaattagtagatcaatttaaaaaaccaatctaccaattaccttgttgcgtactcgttcgatatcatgcgatctgacatcttttggtacgccacggagcttgaggcttggatgatctcgatagaccaagttgtcgatgacgatgatggttccgatctggttaggttggatctccccctcagctgaagtcatcgagtagctcgttgtcggagaatccatcttttgaacccatctcgtcgaaatcctgaagcaccaaaatccccctacctggcgcgccactgtcgacgtttgatgtcgtaattctggtatttgtatggtatggggatcgtcggtgctaggatatacgcaagactgaggtaaaagagatggagacatggatttttatacaggttcgggcccctgagttgtcaggtaataaccctacatcctgttggccgaagccggtattgctcttattcactataatcacacaagtacaatatttggggtagccaatttaactgttgtcgtcttggcggtcagacgatctgactcgtagtcgacaacaggggagccttcctcctcgaatccgtgcccggcgagatcagagattttctcctgacagtatccggagacaccgtagggtattagccgtgcttttccctgaagtcgatatccggcggcgtgtcttggcgtatgtaggcttctatgttgattatgttgggtgttgatcccgttgggtgttgattgtcttgtccccctctcctcctagggggccctgtatttatacccataggtatccctttgtccaagttgaactagggaaacaaatatggatacaatccgagtagtacttgtcgtttccatgtagaactctggttgtctttccttatccggaactcccccaaggtcagtttccgtgtaagacatggtatgtagtggatcctgtcgagatttagtcaactactattaggtatgtggtatccataactctgacagtttcaattcactgcaacactagatctatacatagtgaaatattgcgagtacattaggtgaaacatttttggtggaacaaaaaatgaaacgaattcccttaatagtgggttttcaaaatatatgggtgattcgaattccgttaataatggattttcaaaatatatgggtgatttgttgcaatggagtatgtggtggagatacgtggcaggtggggacagggacatgtggtggggcccagggggcagcgcgcgtcgtgggggga

SEQ ID NO: 58964 - DNA, 2074 bp, Oryza sativa
ggggttccaaagaacaagcagacggacggtctagccgacacgcgcgctgcaagcaagtacaatggctaactttaatctaacaaaaacccaagaaccctgaaggggtaactagctatatataggggtggaaggacgacctaggggtgcctagggtcgtgctccaccaacttggggcgcaccccacatgggccccacctgggccggggtcccaaatgaagttacaagcccataggcccattataggtgatgcaataccttgttcctgtgattctggccacacgagatagaattcagagaagaggctggatccattagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcacaaagcatctgcaatcacattatcttaccctttctcttgtttgataacataaggaaaagattcaataaattcaacccatttagcatgtctacgattcaaattattttgagaacgaagatatttaagcgattcatgatcggagtgaataacaaattctttaggccacaaataatgacgccacgtctctaaagaacgtacaagagcatacaattccttatcgtacgtggaataattcaaaacaggaccatgcaacttctcgctaaaatatgcaacaggcttaccattttgcatcaacacacctccaatgccaactccagtagcatcacattctaactcaaaagtcttaccaaagtttggaagttgtagcaatggtgcgtgtgtaagcttgtccttcaaagtgtcaaacgacttctcctgtgtctttccccaatggaagaccacccctttcttcgtcaactcattcaatggtgcagcaaaggtactgaaatctgtgacgaaacggcgatagaatcctgcaagaccaagaaaactcctgacctgtgtgatagtttggggaaccggccaactctttacggcttcaattttcatctcatccacctcaattccctatggagtaacaacatatccaagaaatgaaactcgttccatgcaaaagatgcacttttcaaggttagcaaacaaacgtgcatcacgtagagcattaaaaacagcacgtaaatgatccatgtgttcatccaaagacttgctgtaaatcaatatgtcatcaaagtaaactaccacaaatcgtccaatgaaaggcatctatgaagaaggggaggatgatgtgaccatggctactatggatacgatcattgctcacatcatgaatcaacaagaagacatcaagatcaagtcctccatgtgctgcaatctgattcggccacgtgttacattgctgacttcaaatggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatggacttgtaactttgtttgggaccctggcccatgtggggcccatgtggggtgcgccccaatctggtggagcacgacccttggaccctcttggtcgtcctcccacctttataaatagttaggtaccccttcagggtttcttgggttttgttagattaaagtttagccattgctacttgcttgcagcgcgcgtgtcggctagaccgtccgtctggttgttcttcggaccccacttatcatttgattaaattcctatttgcaatatcagaatgctttattcttggtcttgcttgttcttcgaattgctggcaggaataggggtgatctgcaccggcaagataaccaccccacggagaggtgtatcgatcgctaagcgcaacataacgtctcgtacggttgtagtcggatcgtcaacgttcttccaaatatagtgatcacaactcaccgaaagatcg

SEQ ID NO: 58965 - DNA, 649 bp, Oryza sativa
ccgtggatttattccaaatgggggtgcattctcatttctcaccggccggtgaccttcttcttgtgatgcttatatatgactatgtatgtagtgtgcgctactctgtccgaaatccgagtcgtttgaggtttcttttgtcgtgtcgatgaaatgaaggtagacaaaggtgatcctgcgatcgacggagtagtggcggcgctctgcgtggcgtcagctgtgatggttgccgtcgtcgacggcgccaaggaagatgggcgcgtcacgcagctgtcgaatggcttcacggcgaggcattcgccgaacgcgccggctccgttcgagccggtgctgtacgcggtcaacggcgccttcgccttcgggttcctccgcgtcggcgcggcgtcgctggacctcgacgtggtgcacctcgcctcgtcattcccggtctggcgcgccacgccggcgcgcgtcggggactggtcgcgcccggcgacgctcaccttcgacaccggcctcgtcctcgccggcgccgacgacgccgccggcgtgctgtggcagacgctgaacgccatcggcgacaccgtcgtgctgctcaactcgtccaacctcgtcgtccgccggttcgcggagacaaatacggcgtgccagagcttcgacaacccgtcggaca

SEQ ID NO: 58966 - DNA, 2944 bp, Oryza sativa
tgctgcaaggcagttcaggagctctccagccatggttgagatccagaagacactcattacaaaggaaattgtggtgcttgcaatgttttcagttattggggcttctttctcaaaaatgaagtgggacagggctaaagaaatgctcacgaaaagcaccacggaccagatggggaaacgactttgagggagaagaaatactattcggctatcaaatggaatgaatgaactgaaagaatacaggagtaggagaggacatagacagatgtttgcacaaacataaaatttgttccattcagtaggaagcgttgatggtattgtgagcttaagaagaaatgctacaggccactcccaaacttttgtcacctgccaggggtagatgacaatcagtgtcatgaaaatgcagatgccgagaggaaaatattcatgttttagcaaagtctaataagaaacaaggagctaaatgtcacaaaaaattggaaatgagaacttaggatttgccagaacatgccatcgatttcctcataaaaacaaagttaaacaatcagcaagtctgttaagtttaaaaatcttttgatcattaagcaattgtatatattcaatacagtagtcgatgcattcttgtcatagtagcaaagctgacattactaacttcaaccattactataaatgggaatatttatcataagctgcctaatcacatacagataaataaactcatagcgaattgatcccagcaaggcatgatgttggtgcagctaaaaggacttagcttgtttagcatgatacattattcagtacactgagtaatcctatttatatcaaatgtacattagcactcagtgtgctgagtaattgtatctatgttaaaagtacattatcctgtgcatatagtaaatcagaataggttgcatcatgaaaaaatctacttaaaattatcaaagtacacaaacacaccatgaattgcagcattgttaccagttacctttctgtcaaagtgtactactgagttatcaaagtatttaatgtttgtttctacttaatatctacaattgtatgggtattgtataaaacaactattttttcaggggaacattggctcactactaaagtttctactagccataaagtaatctgtttctcgctgttgattgcagccagtaattgcaaactaccagggtgaagttaacactcttgaacataaaccaatcagcagcttatagcactgttcacattagtactgtattttcaagtcaagtgcacttcgaaagtaactatctatactagaatcgtttgtacaaattgaaccatagaaaagcataacaaacaagttggaccattaaactaaagcttaccctaaatgagtacaatacagtcagtgagttcaaactagaagggtaagtcaacaatcttgcacagttgtcagttgcacataaacaaattgacggtttacgaccatcttcaaatgaataccaaagaaactatttatattagaatacttgtccctgactactcaatactatattaaccacagtggagacaaaacaaactaacgggagccactcattggagcattaccttactgaacatcgtgcacaaagtagggtgttgttgcttgcgatcctccactgttaccggcaagtccatcaccacgcgaccaatgccattcaccacctccagctcggtggtgctcaccgccttcccctcagcatccaaatccatgtataccactaagcccacgaagaagacgtagaagagcacgagcccgatggcctgccagaggtatatctcggcgctaaggtagatgtagaagaggccggaggcggcgaggaggtagaagaagacgtcgcgggcgaacgacgcgggcgggacagcgaacggcgcggcgatgagcgcgacggccccgacgacgaacgcggagacgaaggctccggcggagaggatcgcggcgagccccgcacgccgcatcccgccggccccgccgagcgcggcggcggaggcgaacgcatcgggggcgccgttgccgagcgcgaggagcgtgacggcggccatggacggggagaggcggaggcgggccgcgaggcgggagaccgcgggggagaagtgggtccccgcggcggcggcgaggacgcggaagtggaggaggaggaggagcgcgagcgccgggagggaggcgcggcggtccccgcccaggaggcaggcgtggatggcgccgtagtcgaggatgcccggcgggtcggcgcggacggaggcggcgcacgcggcggcggcggcgggcgccatggcccgatgcgccgcggcggcgcggtggtggtggaatggcgagctgccgagtggggagtggagggaatcgcgggggaatgtggtggggaatttggggagtgagtgagtgcgtgcgtagcgaacagacgggacgccgacgcggagagggaatggggcggtgccgaacttggtgggtcccatcgcgagggaggaaggtcgaagcgcacacgtgatggtttggcgtgagggacaatcggcctggcctggtttggcccaagagctggttttagttccatgggccagcaccgacaattttgcgtctggaataagttcactttagatccctctatttgtcggtcagtctgattttcgtcccttaaccgcaaaaccgggtacgacccatcccccaacttacgaaaattgggcaaacaagatccctcggcagtatggagggcagttttggttgacatggcgtctacgtggagcctttgactaggtctccgtcccacgtggcattgacgtagcgattacgtggcaattttatctcgaaaaaataataaaaataatgggacccatatgtcagctacacaaaaaattaataaaaaaggtgtggcccgtgtggtcccacatgtcagcctccctcttctctctatcccatacattgccaggagagaagggcgagcgg

SEQ ID NO: 58967 - DNA, 2687 bp, Oryza sativa
ctcggtaccccgtctacggccagctcaatccttactcgttaatatctcctttctctctgttgacgtcagaaaaatgctgcaaatcagcaccctgttggattagacgaacccttgtcgtaatgtaacagacatgcacatacctagttgtttcttttcattctttcctcctctcttcaaatattttttctcctaaattacttatccaatttacgaactgatcacactgttgtattcgttgcaattaaatctttacaacaagatatcacatgattatattatgtcaaaacaaaaacatacgtttcaaaccgttaaaacaaaatgtttcatacgtaatagtgatatgtttcaatatgtgtcttaagtgtgtttcacaaaattcctgaaactatctactactactctctctccacctcatgcatgcatacatgcatgtattttagcaagcttcaaaatgatttttctcttaaattacctattcaatctatgatccgatcacaccattgtattcgttgtaattaaatttttataataagatatcgcttgattatattttgataaaagaaaaacatgtgtttcaatccgttaatacttgttgtttcatgtgtgacagcgacatgtttcaacgtgcattttcatcatgtttcataaaatatttaaatgttccagttgctaatttttttttcaccatatatataatataatgtttcacttgttggtcaactgcaacatttgaccgtccgatttttttttaatttaaaaatgtttcacctaatgtactcatgatgtttcactacgtatagatcaaatgttgtagtgaattgaaacatcctttcgctattcgctgaaacattatttttatataaggtaaaacaacgttcgataaaacattttcgatctacttagtgaaacaattacaatatactcagcgcaacagcgtgcaacatttaaaaataattcaataataagctaattattttcatcggattatattcatgtgttgtcttgttttaaagatttaattgcaacggatttaatggtgcaattggattatgatttggataaatattttaagagaaaaaatagtataaaattcgtttgatacatgcatgatggatggcttgatacatgcatgatggatggctagcacacttgtgcatcgatcggacggtcgcgcgagacgtccgatttttcgtctcgcgccatacgtccgacacgtagcgctctccgaattaagccttagactagtaactagtaaggccggcccacgcgtatgcaggttgctccacgtaaagtaggcctgcccttatgtgggtcagatggagaggcggagtttaagggttggtttggtttgaggcctatattggccttaccaatatttggcaatttcaatattatttattgtctatttggtttggagccaaattttggcatgactaagaaaataggccatttcaacggttaatttagactattttggctttaatccaaacacaattttacctttgccaaaattagctatgccaaaagttatcaaaatttgacattgacaaaaattggtaagactaatttaggccacaaaccaaaccagcactaattctctccgaccccccgagacatcctgaatccgatcgttgttcgcccgttctcggccgggtcccgggcgtcgagtccgtcgagcgtatagaaacgaagggtgcatagctggtgcgagcggggttagattttggcttttggtccgttgcatcggtaacttcctcacctcgcgtcgatccttcgagtgtacctgtgctatactttttggtttttggcctgggcattggtagtttttcagtagccattgcagcagtggcgagtggcgactatggcatgagctagaggagatcaggagaggggaactgtaccgggaagtagcctgcgatggtcgatggatagatatggagaagagaagtgacgcgtgcaagagagcggagcgaatgcatatgcctctacgactctatcgctggaggtctccttcgggggttgcagggtcctcttctttgagttacttctctgccataatcccattttccttttaaaaatgaggtcctttttctttttctttatataaaacgtcgacggcaggctaaccgctcgagaaaaataaaacatggccacaggaaagagatccagtgatatcttgtgtacgctgcggcacatccgcacatgcagtgattcaaccaaaagaaccgagtagacagtgcatgcactgatgcacatcgccagcaagatctcccctctggcctgaactcatgaactcgtaaaatgaaggtacagaagaatccacaggaacatgccagaccagtacaagccaattcagtgtgaagggctgtatgcatcagctgccaagataagaagttgtattgcagcctggaggcatcttgcacctcgtgaaccatccccatcgaaatgaaccattgctctgcagcaactggaaaaattgcaaacacttatatatactgcaaacgactagctgctatttatgtataaaaatatgtatcatccagaagagctcgctatagctatactcactactgtaaacaagatgtaaagccccataaggcagtaaccccaaaacctgggaacccgaaacctagtccaggtgaccatcaacagggtgcccatcgggtaccgaaaaaaaatcgccctat

SEQ ID NO: 58968 - DNA, 2406 bp, Oryza sativa
acgagatttgagcataccggtaggggccaaatttcggaaatttcgaaccacgggcacacaggcacatgggcgtgacgtgacgtggcgggctctatcctggcttcatctagaatgtcgccttccacctcctgccaccttctccccctttccagactccttccactcctcctgcaccgcccccgccgcctatatacacacccgctcgccgccgcctcatcaccaagaacgagaaccacatcgagcgagcgatccgtcgcgcaccagcttaatctaccaaccagttcgccggagaattcaggtgaggatatatggcgtacatgcgggtgactcaccgggacgaggaggggaagaaggtgacggagaaggtgccgatcccggagacgcggcgtcccgacaccgcgaggcacttcgagcggaagctggaggagcaagggttccaccgcctggagcgccacccggcgaacgggcccgcgcgggccggcatcggcgcgccgccgcccaagtccggccgcggcggcaagttcacctgggaggggcccgacggccccgtcgacgcccaactccagcccgccccgcccgccgtcgatcccaacgaccccaactacgacgagggcgacggcgccggagtcgacgaggaggttgccaaggaggtcgtcatcggcgaggtggaggtcgccaaggtcgccgaggccagggacggcgtcgacgtcgtcgcgccggcgccgctgctccagcaagagcagcagtagtcgagtctcgcgccgcgccgcgcccgccattagccatttcggagctgatgtctaatggtcgttgtgcgttgtgtgtgactgcgtgtgttttgggttctaaactgctataattactagtctcctcagtcctcagtggtttgcatgcatgtaaaaaatcgtgtctcgtttaatcaataacggtaaacatggattaactgtggattagttttcaactccgtcacctgacggcggcgccggccgccggagcagattcgcgttcggccggcagccgggcacgggcccaacgaataagcagatgggccgtgtacaatattcggcacgcgagtaattgggcctttgagaaagtatgatattgcgggctcaattttataacggacgagtccagagacgtctctttatcttatcctaaactacaatagcagaaattttcatcaacttccaaaatcaaatcgggttaaattagatctcatagcatcgagtttaaattgtatcataaactgcaataccataaatcttcgtcatcttctaaaaccgggttaagaagaatagttaagaagaagacgtagtggcgttctagttaagaagaatagttaagaagaagacgtagtggcgttctagttctagttaagaagaagaaaataaagaaaaatgagacccacatgtaagttatcacctcactctacttccctcctcctctcctctctttcactttgtctcaacggcaaacactgggggtgagcttcgatcttagcctcatcggcgagctgggtaagcaggagcaccacgaccaggcaccggaggtcatgcgcaagtccgtcgtcctcaagaacagcttggcgacatgccgctatccaaagaagtctcactccatcctcattgccagcggcgccgacgacatcggtagccagtacggcggctagctagaccatcacctggcaagtggcaaggcctcgctaggaataacctcaccgccgacaccacaatcgagggtggtgatgcccgcggtgaggttgttccccgtgaggccctgtcaggtgatggtccagtcgccgcactggctgcagagcagctgccgaggtcgtcagcgtggtaggtagcgatgaggatggagcgagtctttttgggcaacggcagcagcgccacgtcgtcgggtttgccgttcttgaggaagatgagggacttgcgcacagcctcctgcgttgggtcacgatagtctttcttgcccagctctccaacgaggttgaggttggagcttaccaccggtgctcgacggcatggaggagatgagaggaagagaagagaggagagggtaacttggaagtattggttgaagtgaggtggccacttacaagtgggccccatgtatatttttaaaattttcttcattctgactaggatgccatgtcaataaagtcatctattcataatttcatattgctatgaggtctaatttaagccagttttgtaagttgaggggcgatttaagaatacggtttaaactccgatagaaagatgaggaatgtcaggtggacttattccatttacaacggaagtattcgtgtcagttgggcccactcaatacgggcacacattttgctaagctcgacgtagtttttgggccttcatgctaagtgggccttgacattagtaatggagg

SEQ ID NO: 58969 - DNA, 595 bp, Oryza sativa
aattcgagctcggtacccatcaaaattttgaaaatttcggtaatttctggcaaaaattatttgaaattttgattgattttgaataaaatttgatcaaattaaaaaaaccaaaaaaaatggacgagatttgagcataccggtaggggccaaatttcggaaatttcgaaccacgggcacacaggcacatgcacgtgacgtgacgtggcgggctctatcctggcttcatctagaatgtcgccttccacctcctgccaccttcttcccctttccagactcctttccactcctcctgcaccgaccccgccggctatatacacacccgctcgccgccgccttatcaccaagaacgagaaccacatcgagcgagcgatccgtcgcgcaccagcttaatctaccaaccagttcgccggagaattcaagtgaggatatatggcgtacatgcgggtgactcaccgggacgaggaggggaagaaggtgacggagaaggtgccgatcccggagacgcggcgtcccgacaccgcgaggcacttctagcggaagctggaggagcaagggttccaccgcctggagcgccacccggcgaacgggcccgcgc

SEQ ID NO: 58970 - DNA, 26063 bp, Oryza sativa
cacgttttgtaccacagtcgtcgctgccacgtgtctctgtggtgtcggaacctacgaaacggaatcggctcgctgccacggttctatttttgtagtttccgaaagtttctgtcggtaagtttggaagttcttgagttgcatctagagtttgcggatccttgtgtgtgtttgttttggccgtgcctgtgtcgtgcacgagaggaggaaggtgaattaccatatctgattttgaaagtagtcaagtttgttttggaaagatatagtagattggattggttaaaaatcagtttcctttttatcccatacaccaaattcggttgccatccactccacctcctggccgagtcccactcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattttaattttgggtttagacttttacatttgagtccctataaattttatatttatgtttgagtccctgtaatcttacattaaggtccttgagtcagtttttgttaaaaaaataagaaaaaaagtgagaaaaaaaaaggcagaaaggtgcaaaaaaaaaaagaaaaaaaaagccgcaccaaaaaaaatcagaaaagaaaaggaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaattttgcgttctctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgtgagatttgagctgccagtacctagtagttgataggagcgtgtatattcttgtgtatgtttcttgtttgctgctaaccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtgccggttctgcatctttttggtggcatactgtggggaataagcttgaaacttgggatgaatgcaaaatactgatgagaaaaagatttatgttttcatactatagacgtgctctccttgagaaatgggaacatctaaaacaatgtgacaaaactgttagggagtactttcatgattttaaaatttgtatcacttatagtggtttacaagaatcaaatgagaacacaatgactagatttttcagagggcttaatttcaatattcaggctgggcttgttaatgtgacatataatcatataggccaattgttcatgcttgcttgcattgttgagcgcaaaattttggagaatccaatggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagcttgataatttgaaggagaaattatttgctaaatctgatatgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaataggttgttttcagtggactgcgcgaagagcaccatatggaaaaaccgaggacggttttctgtgaagaaggggaggatgatgtgaccatggctactatggatacgaccattactcacatcatgaatcaacaagaagacatcaagatcaagtcctccatgtgctgcaatctgattcagccacgtgttacattgctgacttcaaacggccgccaaatctacatacgtgctccgttttgggcccgtgagtacttgacggaaagttctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggttttttgggttttgttagattaaagtttagccattgctacttgcttgcagcacgcgtgtcggctagaccgtccgtctgcttgttcttcagaaccccacttatcatttgtattaaattcctatttgcaatattagattgcttttatcttgttcttgcttgtttcttcgatttgcttgcaggaatagggttgatctgcactggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcattacaggccgagggagagagagggaggactttgggctgggctcggcccaaaggaggaaggagggtttatttttagtttttctttttagtaaactttgataattgttattgttgcttaataaatattttcggtgctctgaaaattcaagtaaaatttgagggctctttttagaccaagaagaatttgacaaaatttctccgggccacattcgaatttttcttgtacatattttagtgtttgccaatttcatttcgaattttaattaattctattattccttttagagaatgatttttaattcgggatgaatttatcaggacgtgacacaaggagacacttggagaaggacttagagccatggaggatcatcgaggacgtccaagtcaaggtagtggcccaaaccaattcgacctcgggtgcaattcggataccaggaccagtctgcactaaaacgggagcctaggtcgcatacgtgctcggattggggcattctttatatggatggaaagctaagaagataacctttccaatggttttggtcccacatccaaattatttccgagtcaatgggaatcgaccaaacaagttgacattcagaatttgttccggtgctgcgtcaccgtatttgggcctttgggccgtgtatcgtgctggaacccagtagggttgcgtcgagagtgggttgcacgaccctaaactctatatatcagtaccaccaccatctttaggtttttggggtttgcttagattaatctgtcgaggacagtttcatcgctagatcggtttgtaagaccccaactcgtgagcttaatcattcatctgcaattttggttgttttctatttctctcttgtttttgttcttcgattggcaaactgccgggtcccaaaactaatgatttggtaaccgacatgttaaaactgtatcaagccctggatcagtagattgatacaagttcaatattttggatcgtctttgcttacgtttagacatagctttgaaggagatattattacataaagtaatagggtatttacaagattgtggttaactattacagcagaagctttagaatggcctaactctgttgttttgctatagacttaaaccatctatctaatctagacttgagaattaggttgaaatgaaactaacttatatgattgaactcccagcttcggcacaaactccaaatgaactctgaaaaagggggttgaagcaagggtgagtacaacgtactcagcaagctattatatttaatcaacaatgaatgtatgaaataataatatctgtgtaaagctaggtttacttgcaaaaagcagagaatgtagaagtagaaaacctgtaatgttttaaatgcagcagtatttaataaaatttcaaattaggtttctatccaagatgccatagtgagtcccaatgctcgataaccgcgagcacggctatttgaatagttttgaggatattcatactacagtagatgtacgctttacccgcaatccatgacgtgccaaacacattagccttgtcatggcaaagcttttcagttactaacatcagtggtacctgttccatgaactctagtccccatgcactctgaacgtaacgttatcagcagcgagaggagttctggcgttcccgagggctttagagagaactgattgtatgacaccatgtcatcgcaatcagggttcacaaacaatttgtgcacaattcatttcatatatttacctgcgcctcggtaaatatcacaattgcccttcgcggcataaatttgcctcctgcacgaggacttaagaagaaccactatacagaggtaccacttttgctagataacttaatcagctaggtctatgcccatacgagaattgcggtcgtactcatatgttcttcacatgtacttggcagtcttatatcggttggaacagtactagccacccggaaatcaaccatttctaccgtactgtcccaatctaagttcattatattttatgcattctaactaggcagggctaagcaaaagctagcatatatctggtttgctatatattcaggttatgcattcaaaatcatgtatggccaatgcacaagatactggagatatagaatataggattattatgctcaaatgggaggaataataacttgccttgctccaacgcaaacaaatctgagataggcaacctgattatccgatcctcgaaacaccacaggttgccatccaaaagataatagactctactaagaaagacgaagaaccaaattcaataaaaatcatgaaatagcaagaaagtgataaacagcaagaagggctaggcttggggtataaatatctctgttaaaggcgtataggattctaaagggttggaggctaaggtggagaggggatccggcaactaaggttgcttatattttatgtgaatgcttggttgttgaaagcataggatgtatattggataattgaactggttcagttgatgtatggctagtattggctggtggtaggttcaggtagtataatacctagggtttgattatatttaagccgactgcggagtagagaagcatatcagctaggctctgtatagattctaggagagtaggtggctgagtatagtggataggcaatattggtaggtgggatatttggatgacggttgggttctaactagcaaggtgttagctagggtttggttgcgtgctagtcgatgctagagcataatgactaggtttggtattttctctagccggtatcgacagatagcatatcggcaagagggattggaggtttatacaggtttagtggggcggaagtgttactccgacaaccgtgagtggcgacggagcgactagaatcgcacagagcttgagagcgaactgtgtagcgtgctgtggaggtcgagggaatagtgaagctccgaccgttgtacgcagcgaggcgtacggtgccaggagcagcacttcgaccttgggtttggtttatgccgagctttacaaccaacggttcgacgttggggtccatagaccgtgcgaacgtccccatggaaggcgtaaagttccaactgatggctttttagtggctaaagggtattttgaaataaaaggagatatttgaaaagcaaatgacatttaaataacttaaggaaatccaaataaaatattaaaatagcaaatttggtatcaaaatgtagattttgaatttagatgaatttaagtccaaatttgactgtaatcggatctacggtttaggagatatgggcttctaaataataggttttgaattaaatagagaaaataagaagagacactatgcaggggacccacctgtcagtcttttctttttctttttctttctcttcttcttcttcccgcttcttccttcttcttctcttcagtcgaacagagaggaggaggagaggggcgtcgaggctccggtagtggagaggcagcgacgccggcggccagtggtgttcccgggtacagaacacctagggaaggaagtggtcggcaaagggggttaagggaatggctggaacggcgagcacaagaccgtgaaccgacaggagagagagagcttcggtggggcttgatatgggacgaaagagaaggggaaaagtggaaaaatgggtttgccggagtaaggcaaggttggtggtgagaggatttggttagtggtgctccggtgagagagatcggctgacggtggcggcagccggtcttgaggaagagagagagaaagacagagctcgaagagctcggatggtgtggaggggaaaaggggcgacctcatcatctatttataggccgcggaggtcggttgccgaaggcggttgtagaggcggtcgtcgactcggccacggcgacgctgtcgtgaaggaagaaaagacagtgccagcttccttctctgattggatggcgacggcggcgcgtgcacgtggtggctgccgtatggctgggcggcggcattagagaggcacggcacagcgacgccttggcgtggtcggcaagttgactgcggcggcggcgtggagagaacggcgggcggccggtttcttagcggcgaaggaaggcgttggcggcgtcgtgcgcgtgtgcaacaggcgcacctggaggcggctcggctatgggccgatttgggccggcttgggctgatgggagatgaaaaaggatttcggcccaaagtgaatagaaactgtttctgaattttgaagggggtttgggtaatggaattgaataggatttatatttgaaaagaatttgaataggaaagtttggaaggaaattatatatggatataatttccaaaagagatattttctaatttgagtgcaatatttttggaagtggaatatagtggaatttatatagatgcactcaaatgggggagagagatatatatttgagaatgtgggaggaaaatggagggaatggaataaataaaattttagcccaaaatatgtggtaggaaatctagaattaattatgggctaaaagaggttttggatttgggatggaaggatgaaatatatcttcttagcacaagagcaatatttgcaatatttgtaataatattattcttgtgccgaggaggaaatcaagccacgggaattaaattggcggctagattgaaaggaggaatttggatacttgagatttgtaaagggaactaaggataggtttggaatcaaaggatgggtcgacaattaattccaattaaaattggaatttcaaagagttggtttggagggttttcttggaccataattcatacaaatgaaaagggttttcaactaaatttgaataagaggaattttgtcgaaagaaggttttaatttaaaaccaaatcaagaaacaccttaatttaaccaaatatatctttaaatgaaaaacacaaaagaagttaaataccagagagggattttatgcaaattagttttaggaggtcctactaattatattttcctaggtttaggaagttattaaaaacataagaagcggcatgatgcataattagaaaatagctaattttcagtatgttacacaaacagggattagccttctcagcgaggtcacccacgtttcgacacgggtgataaccagaggagacgtggtgctgcgattgcggggctcaagtgtgtgcgcattcaagaagccggatcgatttgtgtcgcggctccgcccaaatcgttgtttatcagaacctttcggaagatcgggaaccctagtgcacatcactgtcattggctatcgtggccctaggacttcaactcttcttcaagggctcagcagagaaccagccgataccggtaaaaagagaaaaaccaggtcatcggctgcagatccatcggctcaagctccaaagatgaaagtcaagtcaaagaaaacgaagccaactgatgatctgcctgccctagatccatccattgaacaagctctggatgaagaagaaatcggcgaggatgttgaccaagccgcagatgaagtaagcgatactgaaagaactccatcggcttcacctaagtaaactcctcgaactccttctgccctagcccatttttcaagggtaagcaacttcccttgattccttttgtaatcacttcattttatggccgattactcacagattttatagttgcagaagaagaaaactgttgtgaagaagaaatcggcaatagcaattctcaaatcagctccaccagtaagatattcttaactcttccactagttgatctcagcctgattttatctaacacttgtctctttcgtagcctcctcctcctccttctcctgtacaacaatcatagagtgatcaaactccatcggctgtagaaagccaccatattgaagaagaagaacaaccagctgttcctgctatcccagtaagtcttgtctataaaaatcttgaatcggccaaatagctcatgttgatactcaactgttttcaaattccttcttgcaggccttagccgatctgttctctttcgatattaaagactatcttgatgaagaaacagaagaagacaccaccagcaagtctttagttcccttgtccgatgatgtgaagaaaacccttgaagacatctctcatcggctagaggcatcatcactagacaacttggtggtaaactgtgggccgattaggactcggttacacaagatccaacctctaatcccagatgagctagccgatgtcttcacttcagctgtctatcttgagcagcatcaattcaagctggaaaaagccaaattaagactagccgaacgtcgggagcgcaaggacattcaagtcaatcggctgcttgtgcacgaagagaagtccaagcttgatcagctatctgagggcccgatcaagtccaatattgatcggctcgaagcccgtaagattgagctcttggcacaacttgaagaatgcaacgccgagctggatatggaacataaaaagctagccgatctcccaaaatctatcgaagaacagaaggcaagactaaaattggccatcaagaatgttgctgatctcaccaagtctttaaaagtcatccctggaactgacactcaagatgcccaagtaattgaagaagtagaacaaatcaggcaaagggctatttcggctatccagcaatatttgtctcaatgatatcttgtgtaataggtcttagaaatttttgtaatcggctaagaaactttggctctttatcgaacttatcctcataattttatgccgattcaatagaactccatattttgctcaaaaatttgcaattttcatatatgtgcccccctaattttacaatctcaaaagcattgataaaattataacttgaactaagggcgatatgaaaaaatcggccattgtcccatcggcaaaccacaaccggttacgataagaaaaaacaactaagggcgatataacaatatcggccattgtacatcggcaaaccacaaccgagtacaatatgaaaaacaactaagggcgatataacaatatcggtcatctgaaggcgatgtaaacacatcggctatcatgtatcggcaacattagccgatcatgcgttaacccaaacacttgggtaatatttcttcaagtacttgccatttagtgctcgtccataaacttctccatcgagtccttgcaacatgtaagctcccttagacataactctatagatttggaacggtccttcccaattcggtgaccacttgccgaatttgctatcccgactcccaatcggcaaaatcaacttccatacaagttcaccttccgaaatagttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatcattacatatatggcctataaagccttatttctataaacagataaactactagactccatcacaggaactgcctgagcgtaggatgacgtagaaaccatagttgtcccactctaatagattgttgtcgaaacgacaactgcatacgtcgaaagacgtggttactcaacagtggttggaaaaatgaagtgtactaaattttgaattttacatgggatccccccattacatggccctaggggactatttatagccccattacaggtccttactaccagggtttaggttgtacaggggaatttacatgattacccttaaagaaggggcatttacaggggtacataatgttataggggctcatgggcccctgatgggccgtttggcgatcgccggcctgatgggccggaaaggcttcctcggccctcgcgggggcgaacttgtcaaggcgaagtcatcctccttcggcagacagtcttcgccttgcacccttcgtctgagacgcctctggcctagcgctactcttcgccttgcgctgctctcgctccatagccttcgccatgggtttcggcaggtttcgtcgaagggcctgatgccatccgccaacaagcccctcacgggcaagggtgagactggagcttcggccaagaccgtgcaaaccatgtggtatggtatgcggcgccccctttcgaccgatgctcctaccgaaaccaacattatacctgcgaatgaagattattatttgtgcggctggtattattttgccgcgcttcgcctcgtgcgattgatggttatatatattcttttttcctgggccgaacgaaacagtattgggccttcctttcttgggctttttactgtgctgctcggtcgacaggaatttaccgtttcgcctacccttgcgacacgtggcgctttattactggtgggtaggcgaacggtcgcttgagcgggctatatattcctgttgctctatccttttcaccgccacacttgccattttaccgtgcgcgctctctttctccatctcttcctttcacagcgtctttcgacccctcaggcgtttcgccgaatctcttttttcgccaccgcaaacgcaccgttcgccatggctccacgtaagccaaaccctacttcggtgaaagggccggatcccggccgagtcgatgacgacagcaccgcctttctgggggtctctcttgtggacgacgtcgagctagcgaagctggtcagctccggagggttggttgaggggcaggctttcgccctagggaaaaccgtggtgccgaaacctgtcgacaaccggacggtggtgttcgccgtattttttgaggcagggctacggtttccctgcaacgtgttgttgccggagatccttcgcctctttgaggtggaacttccacagctgagcccgttagcgcttgttcagatcgctatcttcgactgggcgtgccggacttccgagtttgagcccaacgccgagctctttggcgccatatttttcgccaccgtgaactcgaagaaggtaatcaccctggctggaacgaaaaaaaccgtgttcgggagcgtgaacttcaacgttcgccccgagcggtccgatctctggccggtgaacgctgctatgtcgaagtgggaccgccattggatggcgaggtggttctaccacaccatccctttcgaggctggttctgaatcagcgaaagccctccggtgccggcgtagggtgattgcgccgaaccggagacccaagatcgctgtggacggcgccatggaggcgcggttcgttctactgcggaaggtttgctcccgccttagctgccgtgacttggtggaggaattttgtatgcttcgcatttttcccctctcccagtcatggcaagtcgcggttgaacaaggcgaagaagtcaacggtttgccgaacctgatactccctgaggggcgaacagtaagactgttctattgctatatactgctgtgctttgttatttcgccttatttgacttttgacgtagcttcacgctctacttttacagtgttgaccctcgaccaggccgaagtcgaagcccgcaggatgatcggcgatgtttcggtcatcgagtatagtcagctgttaacgcgtcaagcggctgggcgggcgaaccgggtttacaatggcgaactgcctccccgggcgaatccccaaaaggccgacgacgaggcagggccttcgtgaaagcggatgcgtggacaagtgaagcttgcccccaagaagcgaagggttcctgcttcgtctgactccgacaccgacaacgaggatgatgccgaagaacgtgacggcgaggaggaaggagaggaagaggaggaggtggaggctgtggctgataaggccgcgggtgaggcggtcgaagaccgcgccgacacccccgggtacactcctaccccaagtcctagtcacaacgaaaccggggtggagtcgaacagctccccccttcgtcagaaggatttggaaggggcgaaggccctagttgcgttctcttcgggcgcgtcggcgaagggaggtcctgtcaagaaggtggctaaaaagaaagggctcgtcaatgtcgctcgcgtttttagcaacgacgagtcctccgacgggactccgacttcacccgctggtcgcagcctggatctttcggccgcccccattcctccacttggcgccgctagagtggacggtagtaccgccgctggggcttcggcttctgcggaaaggattgtgatggccgcggcgaaagtattcggcagtcctccgcatcagccggttgcctcgccgctgatggaggcgaagggaaagagagcggttgctgagatgtccgcttcggaatattcgctctcggtaccccgcttcgcccctggcgacttcgagacgcgagcggacctccttccttttgtggaaggggtaagcaatcttgtactgcctgccagcgccccgagcttgttcaccgaactgaatgagttcgacgaggggtgctctgctataaaaagcctggctgttcgggtacgtttcccccccccctttttatctttactcttcctctatcttgtttttacaattgacacttgttctcttcgccgctcgtattctgcgcccagatcctcgcggctcagtgctcaacagagcgaaccgtgcgagctcgacttgatgggttcaaaagccgtcttcgggccaaggacgacgaactaggccgcaaaaatttggacatggaggcccttggcaacacccttagggaggcgaaggccgaaagcaagcggcttcaatcggaactagagaaagggaaggaagctagggccgaagtcgatcgcttaaaggccgaactggagaaagagaaggcccacaccgccatgctcatagattattataacctcaccgagccgaagatggaggctctttggcaggaggttcggaaggccgaagcaagcgccgcagaggagtcgcggcggttttcgcgggagatggtgaaaaccaccgagtccgcgcggacagcgtgccaaacgcttcgccttgcccttactgatatgggcgcgaaggtgcgggatgtcccctccgaagatgccttagcctttgacttctccgaatggacccaacaggctggtggttcggtttcggactgcgccaccgcatacggcgattgctgtgcacgcgtgtcagcggcctttaccatgggcctcctgcagcagttcttagattttcatagggggtggaggcgatgcccaggatcacccagaggtgtgaggccctccgcccttctcttagattttcatagttttcttttggtgttcgctagatgtggcgaaccattgtatattcggcaaactgccgctaaaccttaaaaaaaaaaaagcttttttgcatacttggactgtatgataattttaaccactttttaacgattaaagtctttggcatattattatttcactcattttgcattatgccataccttccccttctttcgcctattcttaccatgcaagatgtgttttgccttttctgcactgtctaccagggggtctgccgaaaatcatgcattcgggccccttctgggagctggcgaattcaaaacgagaaatttgtggcattgaagggtttgccgaaggtgcgatgtccatttcgacctgtttatcgcgaaatggaaataaacggtcgtagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcgtcgttacagtttagtctgtgtttcgcccccttctcctcttaaggttgtgtatgacattagtagtgatgacgaacctagttcatccgaccattccttagggagggataatgattactggggcgaaaatgtaatttacttgtaaaatgaattgtatcgggttgtaaaccttgtactcttcgattatttttttgaagctaataaagagcgtgctttatttccttttcgctatttttcgcatcgtcacactttgtgcttttgttaggtcggaacatgctggcccctttgcatatagtagcgaaataggtgtagtgacttttcagcttttcgttgttcgtttttgatctgtagcgttctgtgtcgagagaaacgcttttgcttttatgctgatcggtcgtaacgtcgtttggctatttattttccaagacaagctgttgcggtttcaacgttcggcgagcaatgcttcggcagattcgtttcgcccccctggcctttttcgctgatcaggcgtttgccttggggtttttcaacaaattatcaatcacacgaaaagaaataaaaagaaggcggaggagacagagattttatactggttcgggcctccatggtggataatagccctacatccagttttttttctcttttttccttttttttcttgccgaaaggcttacatagtgccaaaaggcttacatgataatatgtacatttttacaagttggcgatttgggtgccacccattctagacatagaagcgcttgagggaggcggcgttccaggaatggtcgaactcctcgcctttgagtgtcgctaggcgaaaagatcccgtcctggacttgtgtttgatgatgtatggtccttcccactttggttcaagcttgccaaccgctactgggttcgcctttttccttaagacgagatgaccaggcatcagctccgtgggtcggacttttttgttgtaagttgccgaagtgcttgtggcttacttctgcatgtgctcgagcgcttcgacccttacaccttccaagagttcgagcgatacctcgcgcccctcttcgcccccggagaacataacccttggtgagttagcccctagctccgctggggtcattgcctcatcgccataaagaagcataaatgggctaaacttggttggtcttgtgggggtcgtccgaagggcccaaagaaccgaaacaattcttctggccatttgcctttcgccgctccctcaagtcttttctttagtgcttctaggatcttgccatttgtatgttcggccgccccatttgactgtgggtgcgcgaccgacgcgaacctgatttctaggttaagcccttcgcacatttctctgaacttatcagagtcaaactgcttgccgttctcagtaatgaactctttcggcaccccgaaatggcaaacaatgtttttccatacaaacttctgtactgctgccgaagtgattaacccaaggggttcggcttcgatctatcgagagaaatattccatagctacaattgcaaatttatacccgtttcgcgccaccgggaatggcccaataatgtccagtccccatctggcgaagggccatattggtgcaatgggctgcagatcatactggggcacggcttggctttggccatgacgctggcaacttttgcacttcttgatttgctcaacacagactttcaacacagtgggccaataaactccttgtctaaacactttggaggccactgttcttgcagcctggtgcgcgccacatagcccctggtgtatttcctttgccatttcttcgccttcgacaaaagagatgaaacgatgtaagggttgaagtaccccggagcggtaaagctgacccgagaccatcttatacttcgtggctctgagttgcaaacacttcacttctgcttcgtctaccggaagccagccagtttcaaggtgtttcacaaatggggttcgccagtcatatgggtcttcgcccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcattttggtctctaggcaagtgttcgaccgttatgccggtgaagcattttttatggaccgaacagcctccagatacctcttcattccctcttcttttgcctcgaaggatttgtcaacatggcctgctaccaacttggagtcagttcgaattagtaggcgccggactcccagtgctttcgcctttcttaggccaaggagaacggcttcgtattccgctgcattgttggttgtgtcgaactgcaatctcgctgcgtaccgaatcggcacaccattcggcgaaaagaggactgccgcaacgcctgcccccttgtgcgaccacgaactgtcagagcacatcacccagaactggtcgtcgggctcggggtcgggggcaagtaccggtgtccattcagctacaaagtcagctagcacttgagacttgatagcagagcgtgcaacaaaatgcatgtcgaacgggcatagctctgccgcccacttgctgagccggccagtgacttccttgcatcggagtatttcgcccaaggggtactgtgatgggactatgactttgtgggcctggaagtagttcttgagcttgcgcgaagccattactagagcgtaagcaagcttttccatttcaatgtaccttgtcttcgctccttgcagtgcttcggagacgaagtagaccggtttctgtccagactctgtttcttggacgagtgcagcactgactgccactggcgaagctgccaagtataatagcagttcgcttcctaggggtgggcttttcagagctggtgggctttgcaagtattgctttagctcctgcaagcttttgtacttcatgtacgcttgacggaggcttcattttgacgaaggcttcaaaatgtgccgaatagagtgatgaaggacattttggggatgtcgagcgagttcatgtggatctggtggtaaccggaatatgcatccaggaaactcatgagctcacatccagctgttgaatccacgagctggtcgattcgcggcaaggggaaatcgtctttcggacacgccttgttcagatctgtgaaatcgacacacatgcgccatttgccgtttgacttccgcaccagcactggattcgccaaccactccggatcatcaatctcttggataacccccgcccggagtaatttttgtacttcggccttcaccgcttcttggcgatcggcagacatcttgcgcaacttttattttcttggcttaatatccggcttgactgctaggtgatgcatgatgagatccgccgggacgccccccacctcgtcagggctccaggcgaagatatcgatgttctttttgagcacctctagtatgctctcaacttcttcttcgcccatgtcgccccccagtgatacgagttttgtggggtcggcatcatcaatctgcactttcgttaccttgccgtgaggggtgggcttcggcgtgtgcttcggccgctcatgcggttcggtctcaacattgtgcactgctctgttgattatggctagattgagttttgaagcggccgaatgctgaagccccttgactactatcaccccttttgggccaggcatcttgagcttgagataattgtggtgggaaatggcttcgaacttgttcagggttgcacggccgaagatggcattgtagttgtatgggatgttgacgacgtcgaacagtatttgctcttcgcgcctgttttctcccgagccgaaagctatcagcaaaagtgcttggccaagaacttgcactgcctctccgctgaacccccggagcgacgtttgtgccggtgtaagagcttgggttggcaagcccatcttagcatatgcttcggggaagatcacgtcgaccgaactccctccatcgaccaggattcatcgaacttcaaaaccggctatctcagctgagatcaccagtggatcttgatgcgggaacaggactccttcggcgtcttctggcccgaaagagatcagctggttcacgtactgtggcgccccctcacccgccgaagtgatgctgtggaccatgcggatctgcatctttctctaccatttcgacaactggcttggcgggtcggctcttttaatcacttggattacccttcgttgtgtatcttggcgttgttcggctgggggtgtttgctcctggactgcttcacggggtgcttcgacagttgctccctgctgcggccttgggtcttacgcgttgccatgttgcctaatgtttcggcattgctctgtggtgtgcgaagagcgtccgtgaaaggcgcagtagaggtcttttcggaccttcttgcgggctagctgctgatggttgcttgtttgctgggcgtcgaactccttgcggagggcttgcacttcttcgacagccatcacagccttgcccgctcgatctgttctgaactttctccaagtcatgggggcttggccttgccttggtggctgtccctggatcgccggctgagactggcgaacagagaggggaggtggttcggcaatttgaacttgcgcttgagcttgagcagcggcgacggagcctttatcatactcagcttgtatagcttgtcgtcgcctagaatcctcctcaccccttgcgaacccgtcaataatgcgaagtaggtgttcgagcgtctgcggctccttgttggcgatttttctcgttagttcgccctcaagcagaccagccgatgcggcgtttatgaccgacgcctcggttatgtcttgaacttggcaccgggcttgcgagaagcgactcatgtactcccttatcgacttccccggcctttggcgaatgccgagtaggtgttgttgcgccttcggctcctcgtaggtgcctcgaaagttaaggacaaaaacatcgcgcaattgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgggtcagtttcgcctgaatagcgcgggacgggtgggaacttgaactggggtgggattggatgagtcttgattcccccactcagcggtagccccttttcgcctcccgccctgtttaccgcaccttgctgcgggtacggtctggtgaagggcgaaatcgcagcttgtgcgtgaggttgggccatggcgttcggctgcccggctccaactggaggcacttgctgagccgccatggatgggtcaaaaattggctgcgaccacgtcatagcagcttggattggtgcttggtttgttccgaagcctggggtcggagcttgctgccgaacggttggcgcctgagcaacgttggcgcagtcgaactacagtccctgattccacggcgaagctcccgagcctgactgaatcgatggcaaccaagtaggcgcaccttgacttgtattccccaccgggtgaaccgatggggttgtacttgaaatgtagtggggttggttgagttgctgaaggaaagcttggagttgcgcctgcagagccgaagtcccttccgccactgtttgtggcacttggccagttggttgatgctgcccggcgaactacaccggcgcctgtgcggcttgtggcggaaagggctgggtcgtcacttgcggatggacttgatgtgggacatagcctgccgaatactgaaggattggagccgacgtggccttgacccgccttgccgcctcgtatgcttgttgttgttcttgcatttggcgaagcatgtcttggagccgtgtcatgttctgccgcatggcttccatgtcggcttcggcttgtgcttcggggtcaaggctggtttgggactgtacaacggtgagcgcggttgtggtagctgccggctgtgatggagctgcctggggcaccaccggttggcttgtcgaaaggatctccgccctggtctggagtgcccttgccgccgcagccgcctttgccacgtcggcctcgttcggcacgtgcaccgaggttgcaggggccgaaggcggttgtgatggcgcttgtgctcctccagcttcggccacgggcgccgaaggctctgctccttcctcggcggccatgtctggtccggcgtcgctctccttccgcctggcaaccttctccttcacgaccctcttcggtggcattcgctctcagtggtttcgctcggagtccccacggtcggcgccagctgttgtcgaaacgaaaactgcatacgtcgaaagacgtggttactcaacagtggttggaaaaatgaagtgtactaaattttgaattttacttgggatccccccattacatggccctaggagactatttatagccccattacaggtccttactaccagggtttaggttgtacaggggaatttacatgattacccttacagaaggggcatttacaggggtacataatgttataggggctcatgggcccctgatgggccgtctggcgatcgccggcctgatgggccggaaaggtttcctcggccctcgcgggggcgaacttgtcaaggcgaagtcatcctccttcggcagacagtcttcgccttgcacccttcgcctgagacgcctctggcctggcgctactcttcgccttgcgccgctctcgctccatagccttcgccatgggtttcggcaggtttggtcgcagggcctcatgccatccgccaacacagatcaacaggttctccacatgcatcttcctcttcatgatctgaacccatttatgagtacaaatggtactcagcaagacatgcttatgataaacatgcagtattgagagctggaaggtttaaaccctaaccttaacagttatttcttagaggctaacttaataaacatttaatataaacaacactattgaacatttaatttaaacaataataacgagcataaaaaaaatacaaatcttacttatagataacttaaatagaacatcaaataataaataagttaaccatattaattagtagccatttagtttaacttgtgcccataatctggaatcacccatagacacatctccattaaccgagagcacggcgtatacgaatactcaacgactctgcagcgtctgcctagctttacccacacgatacccacagctggccgggctgaaaagtaacaaggtgtaatattgctccatatatctctcccttctgcctagtaagttaaaggatgctcgggatgttgctcggagtgatccggtccgaggtgtgtgccaacctacctccgcatccacttaccattgtttgttactcgatgggcagcccagaacttcatggacccatagggtagttctgaattctcggggcccatcaagcccacatatataaatcatataaacatgaaccatgtcactttgcttcatacacttgaaagctaatggccagtacaccgaaaggcctacagaagttcaatcaattggagcaatatacggccaggttcgacaaatcgatcgtgtggccaactatgtcattcttattgacacaaggtggttgattattatatcaattttaaataagaaataaccataaatatatacatatatccatcacgaccataaacaggtccataaaaccaaacacatgaactctatcatgtgtaccacctgctcacatgcggtgtcaacagctcttagcatatagccataaatagttccataagtatgttttcatatgcaataataatatccatattaaatcaatagcatgttaaataattaaccatttgtttaagtgtttatcaaaatttatcctaagtttgttagactctaaggctcattaaggtatttataaaaacaacagaaaaatataatgcaataattgcaatataattaatttaaaagaattcgtgcagtctatcgtactccaaaggacaagtacgctaccaaaataactctctaactactgggattaaattgttcaaaggagggtgcatgtctttcaaccttcgggctcgatgtagtcgtacaaaccgtctcctcctaccgtggagatttcactcgcttcgactaccggaccaacgtcagcgttttctattgacgcaacaatcatcaccacaataaataacagaaaaaaaagataaacaaaagaaaatagtatcacaaagtgcaacaatgggtgaaaaggatttaaagaaataattttagggatttttttggaatttcggtgaacggcgaaccctatggctaaaattagggtcgcgacaacgggtgctcggattacaacgaaactgacacggatggattcggaataattctaggagtttggaataggtgtcggatttcgatttcgaggacaaacggatggtcaacttgatagaataagaaaaaggatttttctgatttatttttcaataggaaaatcggatttttcttcttcttctcgttctgcacaggaacggccgaccactccatggcgtcagtggtggagatggccggttttgggcaaaggggcgccagttttgcgatctacagggtgcagcgactccgttcccatggttggtggcggcgcaggcagcggcggcgaggctggcgacggcggccaggagctggaggcggcggcggccatggtggcggtggttccggcgaactccggtgagggcaacgggcctggtaagcatcagggaaggaaggggagcgcggtggtggcggcaactcggcctggggcggtcgggagcggcggcgcgccgtacggctggcggcggccgaacagagggcgacgccgggaggcggcaccggtggcattccggcgacggattggatggggaaagagaggggaaagggagtactcggcatggagaatccgtttttaccttcaatttcagaggatttgcaatgtatgtgacgaatttgggagctctatcaatggtgcaaatttagggtttcggggatttttcctccggtgatgacgatttgattcagcggaagtaggggcggacttgatgaggtgaaagaggttgaaaatgcgcttcttttgcctccagtcttgagccttctagttgagagacgaaggagttacagaagcgggaagatggaggtgtcgcggcggcattcattcgtcgttcgtcctcgtgcgagcgtgtgcgggcgtgtggcgcgcgcggggcggcatgagctcagcgcgagcgcggcgcgaggcggcacagggttggcgtgaggcagctcgagcgcggcttgcatcgggctggcttcgcctggctcggcctagccgagtagaggaagaagaaagaaaagaaaaacaaagaaagggaaggagagggaacaaaaatagaaaaaggaaaaaaaatatggaaaaataaaattaaggtggaaatagagaaaaggaaaatttggggaagattaaaatagataggatttgaattggtgtggaatttagatggtccgatattcgggatagaattaaatcagatcaaaggaattatttgagggatgatatgcactttgcgacaaaatcaaatgagaaaagaaacgtcgaatacaaacatggaaaataatattttaaatgaactactaactcgacggttattttttttagaagattaaagcaaactaaatcggttttaaaaagttgtcaaattttagggctgttacgtttgaggaataccaaatcgatagattatatgttcttaaacaaattgtatagcatccccagaatcaacctttcttcaaaggaatcgcctccacccacttggtaaaataatcggttgccaccaatataaacttatgtcctttactcgatggtggattaatcatgccgatcatatcaattccccaacctctaaatggccatggcttaatgataggattcatagctgacgccggtgccctctgaattgctccaaatttctgacaatcttgacaccctttgtaatatttgaaacaatcctctagcattgttggccaaaaataccctgcacgtcgaagcaaccacttcatcttatgagccgattgatgagtgccgcaaatcccttcatgaacttcgccgattgcaaccttagcctgatcggcactcaaacacttaagcaacaccccatcaatcgtccgataatagagttcgtcaaccaaaaaagtatactttaacgccttatatctcaatttccgagaagccgactgagatcgattctgtaaatattgatgcacatcatatctccaatcataggctgttattacagcaactacaaccttaacatctttgatcatcggcttataccctgatgccccttgggccaaatcattagcttcaatattttgctctcgagagatatatgcctcaaagtaaccagccgaaattccctcattagttcttggcacttctcattataaaccattaatgtatcattcttgcattcatatt

SEQ ID NO: 58971 - DNA, 16705 bp, Oryza sativa
tcacagaccggataaacgagcgcgctgcactggttacatgcggcgtgacgcgctcgtccaaaccgcaataaatgcggttaggtgagccccgttgtgctcacctaacccatacacgcggcgcaaaacccacaaggggtcggggcgcctcagccctcggggccgaaacgagagcggtccgactcctcggggagacaaagaggggggcggccacatcaccctcgggcccgacccccccgagggggtcaggccacgtgggtgattgctcctgccccaagcctctagtcatgatactcccggtcccatgtcaccgacagtagcccccggcgttatgccagggcgatcgccctcctcgagggaagcggtcgggcgtgacgccacttacttaggcctggtgacaagtggggctggtctctacagttgggcagaaacccaacggtcgcaaatcacacacatcggcaatggtaactcggctgtcaataatgggcggtctcttcaagactgccacattactcgagtagcacgcgaatcgggacgagccagttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacagcgttggcaagggtataaagacaccgaggaaaagatttgcttccttcctctcgccattattccccttgtctacgccgcttgcgccctaactccttgtttcctgtgccctaccctcgccacacgcgctcgctctcaaacatctcttcttccggcgtcatggcacggggctccgttccgctcgatggtagcgtgctgctgccttcccgcatcgtgagcgagaggcaggctgggctgccgcgccgcttcatggcggaatctgccaccggccgggagatagtcacgctgggcgagggacgcccggcgccacgctacccggggcggttcgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcctatcccttcggctgttccggtggttcttcaccgtacagccggtgtcgccgccgtcggtggttggtggctgctacttccagccgcgggggccggtgctgaaccgctacattccctgcgtcctccgcaagaagtgggatgactggaagagcgactggttctacacccccctcgccgacgaagcgcgcctccgacttccgagccagccccctgcgcaggcctccaactggcgggcgccggtagatctgggggatggctacgacgccgtcctcgaccgcctggcgggcctgcgatcccaggggctcacaggggccatggtgtacggcgactaccttcgtcgccggatcgcgccactccagcggcgcgcccggggcgcctgggagtacaccgggtccgaggactgtatgaggacccaccggggggtcaaatgggactgggtccctgaagacttcaaggtaatgatccaacgggtgctgaatctcagctccgtggaggcatccctcatcccccaaggagtcctccccctctgcagcgatccagatcgcgccaacatcctgaccatcatgatggcggtcggggcctcagaggagcgagctcctaagggccatgacggtgcgagcgggagccgcaagggagatcaatctatctcaggagggggtcgtgcttccgggccccgtgatgggggctcggggggtagccgccctgccgacgcccgagggaagaggaagcaagagggtacctcctccccatctcctccccgagggggcggggcggcgcgggtcagcagcaggcgcccggagggggccgcgccgacgccgcagcccgagggggagcgaaagaagaaacggctccacaagatgggggggacagaaccatcccggggaaaccttatttcccctccaaggtggtcgtttaaccgaccccctcgcaggttcgtcccacgcccattgtggctgtattcattctcccaacacgagttttcattcacccatcttgtttgtcttatggcttttcttctgcttcagcgagatcccgtcgcgtccttcttgccaatccaagtccggccaatctgaggccgagaatgcggcgtccacggaggcccggaggcgggaatctgaccggcgagaagccgcggatcgcctatgggaagccgaggaggccgcccgggaggccgcccgggctcgccaggctgaggaagccgctcgggaggaggccagactccgccaggctgaggcgacgacatcctccgaggcaacccgcgaaactgaccggcaagaagccgcggatcgccttcaggaagccgaggaagctgcccaggtggccgtccgagctcgccaagctgaagaagccgctcgggaggaggccagacttcgccaggccgaggcgacgacgacttccgaggcagctcacgacaaggccgcgggcgcatcgcttgggcccactccctcgggcgacgctcaggacaagtcaggtccgggggatgtccccgagtccggcacgtccatcggcgggccgagccgcgcggcatcctcaccgaggcggctctcccccacgccttccgccgccccactgagcgcagagccccttctgcaggccttggccgtcgcaaacaccacggtgttggacgggttaagtgcccagatggaggccctgcaagcagagcgggcggagctcgacgccgcatgggcgcgtgtcgaagaggggcgacgctcagtggaggctatggtggaggtgggccgcaaggcacaccgccggcacaactcagagctcgaagcccgtcggaaggtgctgggggagatcgccagggaggtggaggaggagcggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaagccctcgaggcccgtgccatggcgctggaagagcgtgcctgcgtcgtggagagggacctggcggaccgcgaggccgctgttgccattcgggaggtcacactggcggcgcacgaagccgcctgtgccgaagaagagtccgcactccgccttcgcgaggatgcgctcaccgagcgggagcgagccctcgaggaggccgaggccgcagcgcaaaggctggtggagagcgcgtccttccgcgaggctgcgcaagaggaacaagcgcgtcgtaatctggaaagtgcccgcgccgagagggccacactgaaccagcgggccgctgaactcgaggcgcaggcaagggagctggatgcaagggcgcgtagcggcggggcggccacgggcgacagcgacctagccgcccgcctcgcagctgccgaacacaccatcgcggatctgcagggcgcgctggattcgtccaccggggaggtcgaggcccttcgtctggcaggcgagatagggcccaacatgcttcgcgacgccgtgtcccgtttagaccgcgccgggcggtaggcgggtctctggggcgggcggactgtgaagtacgccgccaaccagggaggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccctggacagcgctggacgagttccctcccgggaccgaggacggcgcgcgcgcgcaggtctaggatgccgccgaccatatcgtccacagcttcgagggttcggcccctcggctcgcgttcaccctcaactccgacgaggagggcgatgacggcggtgtgggcgacagtggcgacgaggctggcgacccgggtgcatctgagtgagcccccaggcccccgccaatcttcagttttttcttcttttctttcttccaaggccttcgggcctcctttttgtatagattaacttaatctgcaatcaaaataaagaaatttctgtgtcaatttcattttgctatgtgtatgagatgaggatgatctgtgccgtggtccttttgtgtcttagcttgactaagggctcgtgcccaggtcccagtcctcaaaaggcgcgggtcggggctagtgcctggggagatccacgtgtcgagactggccaggccgggagcatggtgaccgagggttatgggtgacccgattgtgggtttttgccgattcccccccggagttcaccacgccccggggcacggctcggttctgggccccttttggcgattttagccggcccgagcccccgagggcaggatcgagcacgagtgacctatttcaagtcaagattcttcaaaagaaaacaacagcacagacacagccttttaggaaatcgaaaatgcttttattgaaatatagatagaagaaaaaatatgcatatgtggtagcccccggccaaccctacacgcccgaggggggtgcggggttggcccgagcccaaaacctgacacccgaactccattaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgtaggctctgctggtagcgcgcggctcggagggccgcgcgtcgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggtttgcccagagcaccgctggcaactcctcgatccacgaatcgccgtgcttcttgaggatgttgaaggtcttggttttaaggcctttgaggatttccgcattggcgcgctccacttggctattgcttctggggtgggcgggtgaggcgaagcagagcttgatgcccatgtcttcgcagtagtcatcgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaatggccatgaaagtggtatgatctgcagggcctgggccggctgatggatttgcttggcgtggaattgacacgctctgcaccgccggaccaggtcaaccgcatcattgagagccgtcggccaatagaaaccctggcgaaaggccttgccaaccaaggtgcgcgaggcggagtgggctccgcattcgccttcatggatatcggcgagaagctcgacgccttgttcccgaggaatgcactttaggaggattccgttagccgcgcgccgatagagggtcccttctatcagcacgtagcgtttggagatgcgctggacgcgttcactcccttcgcggtcctcgggtagagtcttatctatgaggtatgcttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcagcaatcgtgttatcccgtctgggcacgtgccgaagctctatcccgtcgaaatggcgctccatacgccgcacttggcgtacataagcatccatctgcgggtcagagcaccggtactccttacagacctggttaacgaccagctgggagtcgcctaacaccaggaggcggcggatccccagtccagctgccaacctgagtcccgcaaggagtccctcgtactctgccatattattggtcgcccgaaagtcaaggcgaaccaggtatctgaggacgtctccgctcggcgaggtcaacgtgacccccgcaccggcgccctgaagagacagggagccgtcgaactgcatcacccagtgggcggtgtgaggcagctgcgaggggcccgagctggcctcggggactgagacgggctcggaagccggggtccactctgccacaaaatcggcgagggcctagctcttgatagcgtaacgtggttcaaagtgcaaatcgaactcagaaagttcaattgcccatttcaccacctgtcctgtaccctctcgattatgcaagatttgggcgagggggtaagacgtaaccaccgtgacccgatacgcctagaaataatgtcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgccaagggccgcatctctggggcgctcttcgtccaagcggcctcgcggggcgcacttgtcttctgtgccgacgacctcggggtcggaggacgacaggtgcggccttcccacagtggcctcaaggccgtcctaggggtcgggggctcctggcgtcgtcggacaagcgggcaaagggccaactccggtcgtcgggagccttaggccaccgttcggctcgggggcctcttctccctgctctctcctgggtcgagtcggcacaggattaacctcggggtcagagggcgataggtgcggccttcccgcagtggcccccgggccatcctgggggtcgggggcacctggcaccgtctgacaagcgggcagagggccaactccggtcgtcgggagccttgggccaccgttcggctcgggggcctctcctccctgctctctcccgggccaagccaacacagggtggggatgcgcggaatgagggttatcctcatcgcgctccacaaccaacgccgcactcactacctgcggggtcaccgctaagtagagtagcaagggttcacctggctccggggcgaccagaaccgggggagagctgagatacgccttcaactgagtgagggcacgttcagcttcctccgtccaggtaaacggctcggagcgtttgaggagcttaaataagggtagcgccttctctcccagtctcgatatgaaccgacttagggcggccatgcaaccggtgacgcattgcacatccctaagtttgctgggggggcgcatccgctctatagctcgtatcttctcggggttggcctcaatgcctcgggcagagaccaagaacccgagaagcttgcccgcaggtacaccaaacacgcacttatcggggttcagctttatgcgggcggagcggagactctcgaaagtttccgccagatctgaaagtaaagtttctcggtcgcgcgtcttcacaaccaagtcatcgacataagcctcaacattacgtcctatttggctacccaaagaaattcgagtagtacgttgaaaagtaggacctgtattctttaacccgaagggcattgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgtcgttcgccttgggaacgaccaccgggttcgctagccactccggatggatgacctcacggatgaatccggcctccagaagtcgcgcaacctcctcgcggatgaaagcttgacgttccggggcctgccgccgcactttctgccggaccggctttgcgcccggccgcacggcgagacggtgctcaatcacctccctggggaccccgggcatatccgccggtctccatgcgaagacatcagcgtttgcccgcaggaaggagacgagcgcgtcttcctatttgccatccagaagaccaccgattcgtgtggtcttggacgggccgtcgcccagggcaacctccttgaccgggacctcgtcgcatgtgactatccgctgcctcggggcggcggagacggaggtgccaagcctctcgtcgccaccctcaggcttggacgcagcggcgaggtggtccacgcgctgctccatacaagcaagcgcgactttgaggtcgccatggacagagatggggccaccggggcccggcatcttcatctggaggtaggcgtaatggaccgccgccatgaacttcaccaacgcgggcctccctaggaccgcgttgtagggcagactgaggtccgccacatcaaagttcaatcgttccgtgcggaagttggcggatccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcgaccagaagctctcgcttcatggccttgaggctccggcgagaaacgtgagcacatgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacggtgcaccacttgccggttgggcgctccctgctgggagcgctggcctccttctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccacggtagtctggggctccttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcacaaatcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtggggagcacgtcggccattacgccggcgctcgatactgatgcgggcatccggccccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatctaggcgctgccgcgccgtcatgaccaagttggccacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatctttcgaccctctcgagcacctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaaaaagctccaaagagctggagagccagagagctcttactctagaaaccctcttctccctttttttcctctcctgggatctactctccaaatcctctctcctttccttccctttctttttttctcctcagtgggcaaggtcctccttttatatctcaaggggataccacatgcaccacctctacctatctctctttttggtggggactttatcctatctttactcaaacttggcttgccttctctagaaagctaaaaacactgcttgtttttgagtgtggccacgcgtcctcactcgtctaacctcggggatcaccctgtcatctcttcataaatgggcggagacttgcaatggctgctgtccgaatgaccttctgatgggatggcccatacctacctccactccgccagaagcaggtgcaacgtgggtacatggttgtctgccgacgacatgaccagtgtcagaccggtcacaaatcggtcattcttgtccaccacgtgtcagtctagcaatctgcatgttcgcccttcttcatacaatatcttgcttgtaatggttgggatgaagcctggcatatatctgaccgggaccaacgtgccatctccaggagctaacacgccggctccggctagggacgagtgctcggaggctctcatcctgacgggatggggcgaggcgtgcgtcagaccgcctgtcgccacctaacccacgatctgatcggtctgtgaccagtcacagaccggataaacgagcacgctgcactgcgttacatgcggcgtgacgcgctcgtccaaaccgcaataaatgcggttaggtgagccccgttgtgctcacctaacccatacacgcggcgcaaaacccacaaggggtcggggcgcctcagccctcggggccgaaacgagagcggtccgactcctcggggagacaaagaggggggcggccacatcaccctcgggcccgacccccccgagggggtcaggccacgtgggtgattgctcctgccccaagcctctagtcatgatactcccggtcccatgtcaccgacaaggagtatttataggaataacacgtggtggtttaggagtgtttgtagaaagtttaatagacttttagtagataatagatagatagatagatagatagattatccatgtaaggattagataaaaaaatataccatatactgctctgtatttgttatcagttggcatgaattttacaagtggcttgagacatctgtacatttatagagatcaaacaaagcagaatactgaaaatattaaccatatacttattgtataccagggcaccaccccatagaaaagctcacattttagatctagctaactaaccttctattatttaacataaaaatgaacgtatatgttcacacgtatattctgggtacagccgtatagggagcatcagtgtcctgctaatcctaataaggatatggactcatcctaagtaattgatgagtaactcaggccacgccctaagttccccaagaagcaaggcttccattcttgttaaagccactgctgcattttataaacaactttgtggctaattcaattgcataaggctacacatatgaaaggactgctggctagatgtgctagaagcataatctcaagctgtgaaggagtagtagatcagttcattcagtatttcagttgcatagttgcatgccataggttctttcaagctcacacatgtgagccacaaagtggtgctcttctccattggtatctccagttttagaggtaactaatctatcttctctccacttttaacataggcatttatcacaataaatatatcaacacctcaaattttaagaataatatcgacaataatgatatggcctatttttgtaactccttgttacacatttgccatgaaaatagtgcaacgttagagaaaaattgcttgacggacacttgaaaagctgaaagcaagagatttgtctttcagtgggattgaaggtgggattgaagataactccactgtctaaaaaaagaactatgatatctgttgataagcagatgaactccactatctatacaatggttttcctacagccactgagccacagggacttcatatgtgttcttctcacattgaaatcgaaataacatttacatgatcacaagaggaaaaataatcctgggaatgaaacttcagagagttctcgtcgacgaacaaaagaccgtgcagatcgattactttactttagatctttgaataatcacgcacctttttgtcccactggacatattatatacataaaaaaccttatttatgagaaaccagttcaagtatgaactaaattaatttttttcaacttcagtagacagtgagttacctcatgaacatatgcttgtcttgtgagctattatagcagaataagtaccataagtatgaactaaattaatttttcaactttagtagacaatgagttacctcagaatatatgcttgtcttgagggctattatagctaaataagtaccatgaactgcaaaaaatactaaaactttcttcaaaaccaacaactgcaaccattgcaccatggagcccattctccaacgaaaggagagatagcagcgaataactaacctacagtgggcataaaagatcatcaacagtacaacctttgcagctaccaatttgaccccttttatcaactttgcttatttgacccttcttttcaaaattgaagatacggtatgaccctattctgttaagggtatctaacggtgttaactgaagcacaaaatatcccttctgcccttactcatttgaccctataacatgtgggacccacccgtcagttctctcttctcctctcctcctctcttctctcttctctctccacagcgagtggcaagagggcgagcccgtgccagccggcagctgtggagcaccgccgccactcctcgtcgctgccgacccatccacttctcatcgtcaccgagccgtccactcctcatcgccggaaagccgtcgtcgtacactcgggatccaaccgtcactgctccatcgccgggctcgccgccttccttcatccccgtatgtcggcggcgcctcctctaccctccgcgtaccggccaccaccgccgcccctccctcgctagatccaagaactcgagctccaccaccgggcccgcctgcttccttcctccgcgcgccagcagcgccacctcttccctccgcgcgccggccaccgccgccccagacggcgcgcaccctcccaccgtgcacaggcgctgccgccgcagccgctagggatccgccgtcacgaccgggcgccagtgcggatcccctccacgagtgggcactggcgtgggtccgcttcacccgacgccgccccctcagagcgtcaccaccttgcactcccatgccatcgccgcgccgccgctgcaccctcagatgtcatcgccgccgcaactcgcacgagagacagaagcgtggatagggttgagtgaataggggtttctaagggtattctaggcattatgaatattaattacatttttttttgaaaaaaaaacaaacctgaacggagtagtggaaacagggtcaaacgggagcttcgttttttaaaaggagggttaaataaacaaactgcaaaaagtagagtcaatttggcagttagagttcaaaatagggtcaaataaacaattgtccctttattttatagaaaaagaaacccaacatgtcttcctaggcactctgacattttgtctaaactatgcatatttcttcatagctagctgagggaggtccatatcttctctcagaattcatgaaagtgcatacctgaaaacatttgtttctttaatgctcaaacacatgtatttattggaagaactcacagttgcccaaattgagacacaaagaagtacctacaatacacaacattagctcaggaggcccttggcttcctcttaattcctgaagcccgtttgtagatgtcatggtatacataggattgtaaagggtctttcccacctcaaaagcaagccaatgaggtgaggggcttccccacttatattttagttcctttgcccttctacaactaatgtgagactattcaacaatctccccccttcacaagttggtgtccctcagccctccatcgccccttcaccgtttccccacggtcccttaggtatacgggccctgcaggcaccacgattcatcaggccttcacacactatgtctctcgagctagagatattgaactagccagggtttgataccaattgtaggattctaaagggcctttcccaccctaaaagctagccaatgtggtgaggggctcccccacttatatcttagatcatttgcccttccacaaccaatgcgggactattcaacagtatattcaattttcctgcacccatggaacttgctgcatatttcacccaagaatccacgtggtcacatcaagcccaaaatgcattttcagatacaaaatatatgtcagtccataggggcagaactatagaggaaaaataatttgtaaatttgcaaagtagaacgtgatgccatgaagattccatcaaccatgtaattaacctacttataggaaatcaacctacaacatgtatacagaaaatgaaacatgtatccagcagcatcgcctttagtccaaaggcattgcgagggatggtacgatgttgccactgcaccctgctatgagatcaccttctcctgcctacaacctgagaccaccgaccagtggagcaagagaggatggatctaaaaaaactaaatattgtttccattagcagactaatgaacgaaagcttatatcttcggcggaagcggggaaccaccttggcttcggcggctggagatgacctcggctcaggcaggggaagcggcggctggggacgaccttggctccggcaggggcagcagcggctggggacggcctcgactccggcgggggcagcagtacgtagcactacaacaaaaaccttatgtagaggctcttttatagagacaattctcaaaatgcctctaagttttgaagctctgtagtctagagacactttctagaggcactttcaaaatcgcctaaaatatgtttactctagagacactttagagacatttttagcatactttgttaaatttatcttatagagacatcttttcggcacttaaaatttgccatatatctaaaggcattttcttaagacatttaaaacgatgtaaagacatttttccaaatattaatatatatcaagtaattagatataagtaacacaaatcacatatttgcatgtaattatatgaggttgagatggttagtgcattgaatataaaaatggtcaactcaagagatcatgagttcaaggattggtaagagataatatttttcttttttttcatattgatttgctatagttgccgcaacatattaatgcctctacaaagtgcctctatttgcatagagatatcttataaaatatctcttagttcgtagagac

SEQ ID NO: 58972 - DNA, 36791 bp, Oryza sativa
gtgcattcgttggacaatagataatcccttaaccttgtacatgaaaaatataagcacaagcacaacttctccacaggagaatatctagtctctgcatccaagagccgatgactcaagtagaatacactctttctttcccttcgagctcatgaatccagaccgagccgattgacttctcaccggccgacagatataacctaaaaggtgtccccttctgtggaggaatcaaaaatggaggagagctaagatatttcttaatattatccaaagctttctattgctctgccctccaagtaaacttttgatcggctttcaatattaataatggtgtaaaaggctctaaccgtccagataaattagaaataaacctcctaacaaaatttatcttgccgatcatctcctgtaactctgtcttgttctccggaggctgaatcttcttgattgcattaacactcctttgagttacctcgatccccctctcatgaacaagaaacctcaagaactggccagctgatacgccaaaagcacattttgtcgggttcatcttcaggccatatttcctggttctctcaaaaaccttcctcaaatcagctatgtggtcttctatctctttagatttaacaaccacatcatcaatgtagacctcgaccaaccagccgatcagatcatgatatatataattcatggctctttgatatgtagccccccagcacttgtcaagccaaaactcattacaacccactcaaacaagccgattgcactaggacacctaaaaactgtcttatggatatcttcttcggccataaagatttgattgtatcctatattaccatcgataaaacttaaaatcttgtgtcctgaggcagcatcaaccagctgatcagctactggcattggatactcgtcctttggggtagctttatgtaaatctctgaagtcaatgcacaccctcaccttgctgttcttcttgataacaggaactatactagaaacccactaggcatatcggcaaggacgaataaaaccagcatcatataaccgtttaatctcagccttgacaggttcaagcatatcggctttgcatcttctaggaggttgttggtgtggcctaacccctggtttgataggttgtcacgaccggaattaacccaacgggcattccatacgtgcgtgtattgttccttgtcccaggaggcaaggtacatcaaaagttgatacaattcagagtttaacaagcggaagcataaatagttaatttattacatgggcgatgaaggcccagcacacacgaagataaacggaaaacagcggaagactagggtgacgaccataggcacttgacgacaggcacgagctagacaccaaagccttcatcctccaggaactcctcttctgggttggggaaaaattgagcaagattgagtacaaccatcgtactcaacaagacacacccacgaatgcagaataaatgcaaaggagtacaagggagttataataaaggggttagggtttgcagtaaacagcatttaaaagtcacttagatgcccgaagctattttgtaaagacgattctagagctacacaatgttattaatcaaggccgtgaacccgcacgaacctgccttaacccaaggcctacgatgattcagaccgaactggcaaccagacccaggtcccagctcgtcccaagccaacccaggccaaccattcaacattttagttgttaagcaggttttaagaattaaaacactaacttgggtacattgctaggcttgcccataaccgagggcgcggctattcgaatagattatactctgatcagaggtgtatatctttacccacaagacacatcttcctcacgtgtaaccatgtgccacataccaccacggcatacggacgcaagacgtgacatagttcccaacccatcctagccataaacaagagtaccgacccaaccctggctacggccgggattcccgagaaaggtaaccaaggttgagcccctagcagcaggacaccggccctgtggcatgacatctcgactaccgagccgcagctcgtgtagccctcatttgccctagagatgtccatctctatccgtgtacttttgcccatgaccagacagagccacaaactaagccttacccactagacatgtggaagtacggtagtgctttgtaacagaggcccgaagactggtccttgtagtggccgaggtgctactatcaaaaccatgcacctcgagcccaggctaaacccaggtgtgtgtgtctatttccaataatccaaccattccataatgtccaaatgatatgagcattcccaaagactaaggttataaaaccacctaatgttgcctaattaatcagcgaagcagctagctaaattcatactagtggaaccatgaatagggtacccactagttagggttttgtttatcctagggtgaacaaggtaataataacaatagcaataataataaggtcataacaaaggtaaataggcatggctaaataaaacagtgataacgcgggaatttaaataaagcgataatgcagtaatttaaaccaaactaattttataacctgggattcaatatgttcaaggatgatgtgacttgccttgctcgctttcccaaacatcagcttcaagctccacgtagagcggatcttccgaagctgcagcgtctacatgaccaatggaaagaaaaaggcttttactctaataaaatccatataacaagcagaaacaaagcacaaaaataggttcctgacttcttaaggaaaagttagagacttgaacgttccaattccgagttcaaacggcaaagatatggccatttgaagtttatatgctcttaatgtgaatatttgcgaatttcttcatttaaattttaattaaaaatagggtttattgcgtcaaccgaggggagggggtgcgtgcaccgggtccacgggagtggtgggtcccacgcagcagctcctcggtccacggtggaccgggtgcactcgctgctcaccagccggcgccgtgggccccacgcgtcagccgtacccgagggcacgggcggcagacggctgggccccacgcggcggccacacggcgcgcccggaggcggccacgtcagcgcggccggcgggaggcggcgcctgcgcccctatggtcgccggcggtggccataggcgcggcccagcggcggccgagagagagtaagggaagggggaaagaggcggcggtccacggggcgacgacggcgacggaggaggcgaccggagtggagggaggcggtggtgcggctcgggtcgacggggacggcagcgtttcggcggtcggcgagctcggcgaggcggtggatggggtcggcggtggtgcggcgaagccggaggagacgacgccgaggcgggggatggtcctggcgagcggctgggcccagccggaggtcgacggcaatggcagagagagaggacgatggcgcgggcgcgaatccaatggggaggaggggcggcaaacggcggaaactgacaaggaaggtgcggggagggtttatataggtttgggagtgaaagagggtggacggcggggaaggaaaccggcgcgggggtcccggtcggcatcaatggcgccggcgagatttgcgggagagaggggggaaaatggggggaaagggagagggaatcacggggaatatttccccccacttaatggcacgcgggaacggtcgggggcggcgggatttgcagcggcggcggcgctaggcgcggccagagggagtgacggagcggcggcaggagggggatgacgggtgggccccttcccgtcagcgagggtggcgggcgggcccgcccgtcagcggcgcgcacgcgggaagggaggggaagccgagtgggctgcggcgagaggagagagaaggggatggagttgggctgaattcggcccaagagagaggggagagggttttagggtttttcttttcataaagccttttcaactttgtttatttcttgataattgttatttgcgctcggaaaattccactgaaatttatttacacattttaggcttttaggaaatatacaaaaatcctccaagccttatttgacttttaactttgcacattttaatttttggaggcttccacaaggattttaattattctaggcataatttaaaggatatattttagagtcgttttgggacgtgacataagtagccgatgttcaacaatcgatcggctgagtccgggcatctcataatactcccaagataagcaatctctgaattccttcaacagctctatcaacttggttctgaattgtcactccctgaagttcttttcccaagcctaaattgaatttataaatggtctcaagaaaatatcggtgtaaaagcaagagagaaaccctaaaggaattaatgcaaataataatcggaactggcatgtgggatttttcttcagttctacatgtcgaaatacgttaagaagatttttagtggaattttcagagctctagaaataattttaaccaattaaaaatgagcacaagcaatatttaattccctggaaattcatttccttccttttctttctttttccctctttttctttccttttcgaatgggccgccggcccattctcttcctctccccctccccactaggccggccaaaggccgaggctcagctcagccggtcgcctccctccccctttgggtcgccgacaggtggggcccacctgtcgggcccgtctcccacctccagctggcgccgccgcatcccgcaaccgccgccccgctcgctcctgcatctcccgggccacatcgcccacgtcgccgcccgcgcccgccttccccgcgcccactccctctctctcctgcctgctctcgtgctcgagacggccgagattcaatttttgaatcccgcctctctctcctccccacctctccccactacgctggcgaaatcgcggtctccccggccacgatcaaccctcgtgagtctatataaagcacccccgttccctcctctctctttttcgttttgcaatcgcccgctcccgtgcactccaccaccctagcgccgtcgccctcctccccgccgccgctgccgccgctgctccggtcgccgctagccgctatgccgagtcgcgccgtcgacgccgtcgcgttcgccgtcgtgtggatcatcccgtccacccctcctccgtcggaatccaccgccggaacccactccgcaccgtgcgccggtgagcaccaccatggccgccgccttcggccggcgttctcgctctcttccatcttcctctctctctctaacccctttcatcgggttcgctaggtggttccggagctcgtcccgctgtcgtcatcgtcctccgtcgctcgccgtcgtcaatcgccgtcggtgaggcacctcctcccctttctccctctctcccgcgccggttagccgccgcgccgccgcctagcggcttaggccgcgctatcaccatccgcgtagccgagacgccgccgccctccgccgccagccggtcgccgctttgcaccgccgctatgtcgagtcgagccgccgtgcgccatggccaccaagccggcatgagccgcccgtgcgcgccggccacgcgctcccgtcgcgagggtagatcggggccatccaatcccgccgcccgcgtggctgccatgtggccgccacgtgtgcgccgcgtcggcgccacgtgtgcaccacatggtgcgccgtcccttacccggtccgtggacccagtccaccgcggaccgccccccgagtcactgccatgtggggcccgcatgtcggcgccgcgtctctctccccgggaatctgctaaaattcatagaaaattcatccgagctctgtttaagcccattcaagtctcagtaaatcaagaaaaatgcatagaatccagtaaaaatggttttgttctctgtttcagtagtcttatagtctgtttgtattgtttgctttgtatgacgcttagattccggctctcccgacgctccggtgtactttgaattagtcgccgaggttcctccagcagcagagcaaggcaagtcatgcttgtcacttgaacatgttgatcctatattgtaaatgttctattgttttccttcaaatattgcattgttttacaatgataccatgggatgtttaccttctcttatagccatgctatttttgtaccatgctcctttgttagcttgggatataacatgactagatattgaactagggattgcttagccatgcttagttcaactagcacacaatgggggggaatcacattaatgtatagacttcaggttctagtgttgatgttggattagagccaccgtcctggtgttggttaattaaaatatatcatatggtgggctgcgggtgcatggttttgctagtcgcacccatggcaattaaggaccggttcgcgggaaaccctggaagaatccctcatacttaccacaagccagcgtgggcaacggctaggcttgtagtgtagctttcctctagctgatgcatccaggcaagggtgggcgtgatggagtttggatgggccctgcgacggcctatgcggcttttggattcacctaggcacgagaggggactgcccactgccttgcgaggagtgggggtgaaacctgaggtgtggtgtgcttggttagagggggttatgcgaagggtactgtcacggcctctatctagtatgtcgtggtggcatgtcggcgcacggaaacgtgtcgtggggctgtgtcttgtgggtacagttgtacacctctgatcagagtaaaactattcgaatagccatgcccgcgattatgggctgtgatgaggacatcaacaccatcgatacatccacgtccccccatgtacaacatgatggtcctattacccgcgctcgtgcacgtcaactaaattatcaggtgagttctttcttgagttcatattcctcgtctttataccccggagacgcgtgcactcgtgttttactcaggaacgatggagaggacccaaagggaagaggattcgcgcggggtggattcggactgtagggcagcgccaacttctgatggccgccacgacttcatgcgaactccgatttgggtgtgcaagtacttcatggaaagcttatcaagtctactttcaaatggatccagccacatgtccatatctgttctggagcggccgcaattgtcattttactcccgactattttctgtccatggtgctgcgtcacctcttttggcccaatgggctgtgtatccaagttgggcccattaggggcgcgtcctagggtaggagcacgaccctatggtcgttcttcccctcttcttatacctctagtcgccacaaagaacaggcgggttttgatgatagagatagcttcttgctaccggctcgcagcgcgcgtgttggctaaatcgcccgtctgcctgtaatcggaaccccaccatattgtgtttgatagtgaaactttcatctttatctagcaatttcagtgcttgtcctacttgttcttgcttgttcttcgattgcttgcaggacgagtgccctcgtggccgggttgacgcgcacgacaagttcgcggcgaccattggagacggtgtatcggttgctaaggcccagcgtctttggacagttatagtcgggtcgtgaacgtcgacttcatctaattgagttatcccttacctctcatcgaaagatcgggccacaaaccctagcgggttcgcatcaggtggtatcagagcgtggttcatcggtgagagaatttacccttcccttcgtcattaatttttttttcctatagtccagaaaagaccacaaaaaaaaatagtagattagtttttccatgatcctatagaccattgtgccttttcactagtactgcttagctaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccgtcgcagtcacccaccaaatcactttctatttgtgtttgatctgttgccgatagcttttgttagttgccttgtatcctgccaccactagaaaggaaatagaaccctgattcgagtgaccttccttaaaacagtcatatctttttcatacggactcgaaattaggcttataatatatccacggacatttacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaatatcaaaaaaaaagttgtgcctctctcctcagcactagagagagcaagcaaagaaaaaaaagaggatccagcgagcacaccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctctttagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcacagacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgatatcacaagatagcactaggaacaactcatgcacaactctgatatatgaagttcagctcaaacataacagtattttctcttttctttctttcttctttcttcttttcttttttttttctttccttttcttttctgtttttttttggtgcggctttttttttcttttttttgcacctttctgcctttttttcacttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatctgttagaaagagggctccgagagctttccatcaagtattcacgggccgaaaacggaggtcgtatgcagattcggtggccgtttgaagtcagcagtgtagtaggtggccgaatcggattccagcacttggagtacttgatctcgatatcttcttgttcatccataatgtgagcaatggttgcatccgtggtagccatggtcacatcaacaaacttgggatgctttgaaacgggtcatgcgggctagatttgttccttcttactatgcacgtgacttgctgaatagattgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctccatctagtgacaagtcagcggcaaaggccgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgctgcatttgcagatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggcgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagagcaatctgatggcaagaaacctgagacaatcaatttgaaacccaaatgcttacttgctactaaatctgatattactgagttgattgcatcaccttcagttgcctatgctttggtatgcaaagatgctttgatttcacttcacgatatgcagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttacggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcatgggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaatcctgttgcatattttagtgaaaagttgagtgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatgaaacaaattcgtcatcaatgatgggtttgttttcagagctaacaagctatgcattccagctagctccgttcgcttgttgttgttccaggaagcgcatggaggcggtttgatgggacattttggtgccaagaagacacatgacatccttgctagtcatttattttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctatgaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattgggtactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagacttcggggttagtcccacatttaacgttgcagatttgaagccgtatttgggagaagaagatgagcttgagtcgaggactactctaatgcaagaaggggacgatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctattctggagcggccgcaattgtcattttactcccgactattttttgtccatggtgctgcgtcacctcttttggcccaatgggctgtgtatacatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttctttgattgcttgcaggacgagtgccctcgtggccgggttgatgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggaaacatctaattagcataatacttattttccttccctatttctatgaatgcacgcttgattttagcgcacaaaccgcgactaagggtatcgaaattattcctaatttcagcaagctctacccctagctccgcattgcgatccctaagctctatgttctccttgcagagtttcttcacttgtgcagcgagcttatggatcgagggctccggtgatttcacctcgtcttcttggaattggctgggagccctcacaattggagggggcgtcacgtgacgcttcaccttcataggtggagggcttcgggattccgctgccccctccttctccgatgccgtcaaaggccggagtcgacccttaccatacccaccgccgggagttcgcactccctgaatgcggaattgctcctccttcggagtggatggagtagcggtgggtgtggtgtacatctggagcacctcatcccctgtcttagtgaacagggtgcccacatagcgctcggtgggaggcggcgcggccttcccgtcatcttggaaaaggcgacgtgccttcaaaagactgagctctcctgtagtcggccgtcgtgcaggcgaatcccctcgaatttttgtcgttgtgacatagcgagggtagagggatcgcgctgccgaacgggggggccgaacggggccgacaggggttcagccgaactagggagctcgccgacgggctccagattcgcaggggagcgcggcactattgcgaggagctacgccgacagtgcgttcaccccttccatcgtgtattctttgaccggaatgatgaaccctgagttcctctcaacactcaaggctgttgttggcccgatctttcggtgagttgtgataactacgatttaggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagtggggttccaaagaacaagcagacggacggtctagccgacacgtgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcacctttctttttatgattgcggccaaacgagatagatttccgagatgaggctggatccgttggaaggaggacttcgagagctttccgtcaagtactcacgggcccaaaacggagcacgtatgtagatttggcggccgtttgaattgctctatagtagagcaatatatttggtgcatagagttttcatttgtttggatttagagaaacatgttattgctaatcacactatttcgagtttctctagttttgattggatgaaacaggttattttgaatggactatatgaagaacaccatatggaaaaaccgaggacggttttccgtgaagaaggggaggatgatgtgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagctaccccttcagggtttcttgggttttgttagattaaagtttagccattgctacttgcttgcagcgcgcgtgtcggctagaccgtccgtctacttgttcttaggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtttgccggtgttggctctccggtgagattttatgtggaattggatgaagagccgatgaatggaatcaaggatttgccagccattggtgagttagagatgatggagcaagggaattgggttgagatagtgagaagggttgcaaaatgttggagagaggagaaagaataggggctctagttctggtacgactgatctacctccgaactcgcatctaaaacagattcaggacaagcaggggagactaccgttcaaaaatggggctgaacgggcgccgccctggttcggccgaaccctagtgggtccggtaggccaacaaaattttcctgggcccactaaaacctattctaagtacaaaaacgacaactatacagggttttaagcatgcattagatgagatcaccatggttcataatcgattaattcaatgacatccacttcttcatctagaatttcatttggctcaaggaaaatctttaggcgttgatcgtttaccttaaatatgttacctgattcgtcgctgagtgtgattgccccgtgcgaagaggtgtcgatgacgtcaaacggtccttcccatttgctgcgcagttttccgtggccgaaaacttaaccctagagttgaacatcagtactttgtctcttggcttgcatttcttgatttttatccttttgtcatgccaacgcttcatcctttctttatatgagtatgctctatgctcaagttctacgggtagtcgacatgacttctcgtagactatctgatatggggacattccaatgggtgtcttgtatgctgtccggtatgcccacagtgcgtccggcaatctatccttccatcctgttcccattttgttgaccatcttttgcagaatattcttgatttgtttgttcgatgtttctgcttgaccactggtctatggatggtaaggagtggccacattgtgtttggctcccatctcttgtaggaggtctcagaaggttttgtcaatgaagtgagagcctccgtcacttacgaccatcctgggggtaccaaatcttgggaagatgatttatgtgaacatcttcttagcatgcctcgcatctgcggcgctgcacggcatagcctcaacccacttggagacatagtcgactgccaccagaatgtactcgcagttgcgagacttagggaaaggtcccatgaagtctataccccaaacatcgattatctcgacttgcaaattgtatgtaaggggcattgcatcgtgagcagtgattcctccttccctctggcagcttgtgcatcttctgacgaattcttttcaatcttcgtacattgttggcaagaagaaaccactttgccaaatcttggcctgggtgcggaatgcaccgtaatggccaccatagggtgaggcatggcatcgttctatgatcttaagtccttcttcagttggcacacatcttcgtagtaagccatcggagtagacccgatataggtatggctcatcccatatatgatggtgactttcatacttcagttttcgttgattttcccctagtggtatgtacttggataccatgtagtttactatgttagcataccacgggttggagtcgcgaaccgtcatcagcatgtcgtctctcaagaaatcatttatcggctgttagtgcatgttagtgatctgcagtctggacaaatgatctgctatggaattttctactccctttttatctttaatttctaagtcaaattcttggagcagcaaaatccatcttaagagacgtggtttagcatctttcttagtgagcaggtatttcaaagcagcatgatcagtataaattatcaccttggctcctactaagtaagatctaaacttatagatagcaaaaacaaccgtgagcggctctttttcagtagttgtataattcaactgagctcccgttagagttttgctagcataacagattgcatgatgattattatccttggtttggcccaagaccgcaccaacagcaaagtcacttgcatcacacatgatctcgaagggcagagtccaatcaggaggttggatgattggagcagagacgagtgcctttttgagaatttcaaaagattttaggcatgcgtcatcgaactcaatgggcgcatccttggctagcaaattggtcagaggcctggctattgtagaaaagtccttgatgaaccttctataaaagccagcatgtcccaagaaactgcggattcctttgatgttcacaggaggaggaagctgatctataacatcaattttagcacgatcaacttcaattccttgctcggacactcgatgcccaagaactatcccttcacggaccatgaaatggcacttttcccaattaagcaccaggtccttttcttggcatcgttgtaagactttgtctagattctgcagacaatggccaaaagtctttccataaactgagaagtcatccatgaagacttccatgatgtcttcgatcatgtctgagaaaacagacatcatacatctttggaaagatgcaggagcgttgcacagtctgaaggacatcctacggtatgcataggtgctgtagggacatgtgaacgtagtcttactctggtcctccggatggataggaatatgatgatatccggaatacccatcaaggaaatagaaaaaggaatgatttgtcagccgttccaacatttcatcaatgaagggaagcgggtaatgatccttttttgtagccttgttaagtttcttgtagtcgatgcacatcctccatccggttacggttcgttgcggaattagttcattttgagcatttgcaacgaccgtcattcctcccttgttcagcacaacctggactgggctaacccactcactgtatggtacgggataaataatcctggcatgcaggagtttcaagacctctttctttacaacctctcgcattgcattattgagccattgttgaggttccctggagggagtactctcggggggtcaataggaatacgatgggtgcaaagcacaggattaatccccctaaggtcttggagcgagtagccaagaacagaacgatgcttctctaatacggtgagcagacgttgagtctcgtcttcggagagtttatcactgaatataacaaggggcctctctgtcattgtgtaacaagtcgaaaatcttatcagccttggtgatatcaaagtcaaatctttcctctttcccaaaactcctcacccatgggcatagcacaacctttttgcttctaacccactcggctgctgctacttcagtattatcctcttcatccgaaccatacatgtaaggatacacatgattaattttcttgaaattcttcttggcctctgcaaacctatgctcgtgcagagttaccttctgtgcaaggtgagatatgctttcaaactcctggaatgaaaatttctctttaatcggagctatcaaaccctgaaaagccaaatcggctagctgagaatctgttagcagattgatgttttgtccaccatgctgtggttgttctcttgtcaacaaccgaggattggtcatttgcctatgtgccgatgatggtgcagcttgtgcagccggagcagaagttgtaaccggtgccatcggttgagttgatggtgtgttagaagaaccctgttgattgcctgtaatcaaaggcctataatttggaaaagcaccacctggcaaatacactggtcctgtaacttgatgctcagctattgtgccatcaaccactattttcaccatgttgaaagtattgactaagactcctgactgattgatcaaagcatgttgcacagcgtagtcaatccaatcttggaagttgttaaactgtggttgtaatccactaacatttggaccaagatcttcaaccatgccctcctgaaaaccaccacctttgtcgcctggttcaccagcagtacctttatagccttgagatgagcttgaaccaacttcatcggcagcaaccactttcagcttgtatttttggacaattgtcccttggcgggtttctttgaatgaattaatgaacttgtccttcacgctgctcatcatctgttcaagctccttcctgtgttcagccgacaatttgtctagtgtgactggaataatatttctttcatgaacttcagacccgactggatttggaggcttgttttgaggatctgttgacttcgtagcttgcttgtcccctgacatgtttatcgggtcccactgggcatgccaaaagcgtgttgatgtaaaaaacacgaggcctggaagatctgcttaacttcagtgcaggtccaaaaatcttgcttttatgttcgtgagcgtaccagctgatttgatcctggaatcaacaagagataaagacaaagaaaccgtggttaaatccataaatgatagccaatcggctagttgccgatgacatatcatttatctctgagccgatgtcatatttgaatcgatcgacagatataaacaagcaagaaagaactaaatctactcaatcggctgtagatattaacaatatataatccttatgtcgatatatacttaaatgaagtgattgggatagatcgatcgccatgccgagacagtataaaccacttagattgaaatatatattaacaatattatatatgttcatagcatagccgatcagatagatctagcatgtatcggctaatactccgataccacttgatactaagatattaaagcaagtaaaatatatcaaacagaagtgtaatatacctagatgcaacaagatcttaacataaagggcaaatctagcatgtcgattaagcacatgaaatataaggctaaattaggtaagatcggctgaaaccccgataatactctaatcagcaaccaagaagcaggctagagactgagattctaatcacgacttataaggtcaaactcaattgatgcagctataagtatgaaaagaagaacaatatctagacaatcaagccgttggatgtttcatagagtggtggatgtcctgtacaatctaagtcaacatagatatttgacttaatcggctgccttcaataatagacatttagccgattgaaggttagataacgatattgtcgaagattatacagaatatatgacaactcgatgaattacataaacaagattagagtatcataaagatggaagcactaatcccgagaacgcaagccactataataagttttacctcttgttgaagatagaaaccgatgtagctcaacccgaaagtaagaactcgtcgaaacaaaacgaaagtaaagggtggcgatgcgccgagattatattgaacgtgtattagattcattacatggggctcggggtctatttatacccgagattacaaaatatatccatgtcggacacgactcttacctctaacaaactctaagataccataagtctttgcggcagacttttgcccaaacatatctctaaggaaattacatgaaatatcctaattaatagatacaattgccttctcaagactcaatccgtgcatggcaatcctcatgaagcacattaactcaacccgacaacgtgtactgcgtcacattgtcggactcggctcaatcggctaaccttgtccaactcggactctgccgatcccagttgcagccgattcggactttagccgtgccttttcttatcctaccatctaataaggcttatgtggagctcagggtatggaaaagagtagagcattacttgcttcacatatattgcgaagtcaaataatgcatccacggaaatacaagacatactttctagtcaagaatgtgcatgtgtatgtgtatggtgaatttgtgggtggaaaatggaaaataaaaataacttcttttgtatacctcctccatttattctcttttgaattttgggagagtgcatggctatctccttattttcttttcctctttttttttctcatcatcatgctccatacttgtatgagcaccttttttttctttctttttcatagccatgcttctctctcttttttcttttttttgaaagaacattggaggaagaggcataaatgacatggagtatttatttttgtggaagatggacaaaatgaatgacaaatgaggaatgctaacttccggtgtagaagttaagcattggtgggtgtatgtggagtgtatgtgatattgaccatgaaagtatgaaaagcatttcactagggtcacaaaacttgacaacgctcaatataatgacaggcagcgtatgtagcaagctaatcatgaatgatcaacctatggctctagtgggaataaaaatattaatgaggagtttagcatcgttatatatttttttcttttttataaaattcccaagtgcacaacatgaagagcaggatttccatcatcagactatatctcattcatcaattacctagatagcatggggtccctattggataagtcaccacaagcaacaagtaatgagcaaagaataataggcatgcatgctattttcagggaaccaagaactctaattgtaccatccatagcttgggttcaattatcttagatattttagaattgatgatcaaattgaactcaagatagaatggatgtccaaaggaaaaattgtgcaaacctgcgctctgtataaaacagaggacgattcatggtagaggtggttcagccgaactggagatttggctgacccctcattggttctgatcgcaacaatttcccttgtgtggttcgtcatgactcatcactcctggggtgatcttgctttggttacggtgttgatgtgcaagataaccccacacttgtctttttacctgggactctttattgaacacaaaaagaaaaacaaagacacgagtgaagcaaaaatgactcacttggttcgaagaccaaggagccaactttattttattttattatcatttttttatttttttattttatggcaacaatggatatggtgggtatcttggcaggatggagacatgagatgaggatgcacatggtgtatgagattcctaccagataggtcttaccatgatttgaaccgaatgcaagaatgcaacaagttttgcatttgttctacttggctccctgtgcatatcttttctcatggacaaggagtgtgatataagtgtttgaagtttttgtacattgctctttgattgcctttttatttcctgcaaaaggttagtggacaacaaatactagagggactacaaagatttgaaaatattttatcatagcctcaagattaattgttcacatccacgctaaaatgaaattggattcaaaacttaagaagcgtggatccgacaagtttgccaacattttattttatttttcgagagacagtccttttttttatcctaaaaacatttttttccaatttttactattcaccaaattttcgtttaagcacaactcatacaaggctttagttaaaattgcacgaacataacaaaggaacattcaacagtatacttaccgtgcactttgaatggtgatgtgttcatcctttgcatgtctgcaatttactgatttgtttctcgagccctgacttacctccagtgtgaattgaacttgaggactcacccgtcagtttgaaaactttcctgcaggggttatgatgagcacccggcaacgagcgccccgatttcccctctctttcacggtacaaattagctgttgtaaataaataaccaatatagccttgctcagataaaacgatgcagcaatccaatcacgtgaaactctaccaaaatcaacaggtaagctcctcgacccgtgcaacaacaatacaggaacagagagaagatggaactcacaggaaccgaaggaactcagccagaaaaacagatctctagccatgttcttccttctagatccaccagcggcggcaaagaaaatcaatagcagggagatgatgtgagcgccatcaccacagtacgatagggaaaaacaaaccctgaacgactcaaccaaaataaaatcctcccctgttacagggcagatcagcccttaataaaaggagcacgcaggcccagatgaagtctgttcggactcaatatcgcgaccgagaaaatttgcattttcccgaacgctagtgtattaatccccgtcccaggaaaagccggggtacaccatacaaacatgataaaaaaggcacgtctttattatattgataatatttacattattacaaaggcacttcaggcctgacaatcgaaaataaacagcagcggactagcgggcctacggctccatcttcacgggcgctcaactaggatataagcgaggactccacctaggacttcttctccaaagcttctcttactgaaggggggagagatagagcaagaatgagtacaaccacagtactcagcaagtcaatccgggagatgcatgataatgcaagggggtacaaggagtaataataatagggttgggttttgcagtaaagagcatttaaaagacacttagttgctcaaagctattttgtaaagacgatcctagagctacacagtattattaatcaaggccgtggacccacacgaacctgccttaacccaaggcctatgatgattcagaccgaactggcaacccgacctgggtcccagctcgtcccaagccaacccaggccaaccattccatattttagttttgaagaaaattttaagaattaaaccactaacttgggtacattgctaggcttgcccatatccgagggcacggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacggccagtatcccgggacaggcaggccaggattgagcccctagcaacaggatctagaccgggtgcgccacacgcataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgttgcaatgacttcatccatctctatccatgtccttttgttcaggactagactgagcaccgagttaagccttacccattagacatgtggttagtacggtagtgctttgcaacagaggcccgaagaccggtccttatagtggccgaggtgctactagcaaaaccctgcacctcgagcccagcctaaaaccattttgggagttttgaatagaggggggaggggtgtgttcaattccatcacaagccaaccattccacagtgtccaaatgatatgagaattcccaaagtctaaagttataaaaccacctattgttgcctaattaatcagcgaagcatctacctaaattcatactagtggaaccataaatagagtacccactagttggggttttgtttatcctagggtgaacaaggtaataataacaatagcaataataataaggtcataacaaaggtaaataggcatggctaagtaaaacagtgataacgcgggaatttaagtaaagcggtaatgcaataatttaaatcaaaataattttataaactgggattcaatgtgctcaagggtgatgcgacttgccttgctcagagagaacggccttccgaaccttcggcgacgaccgcgaaccacgcttcgagaaccttcggaacaacagaagctacgtgaagcacacaagcaaagctacaagcctataaagaagcaataacaatacataaaaagaaagcacacagttctttaggttataacaaacattaggagacttgaacgggtcgattcagggttcgtatgaccaagatatgatcatccgaagtttaatgctgttacatggagatttacggattaatatgattaggtttgcaattataaaacatgtgtaagcgctagcctggaaaagataggaaggctgcgccgttgacatgcggaccccacatgtcaacctaaaggaccgcggtagaccgagtacacagagacggtccacgggtcgacggaagcgaaccccgtgtatcaaccgaggcgagtggccgacaaacggactccactagacaccacgcgggctgcacacgtggaaacaacgcggctatcgagcgggcacactaacacggtcaccacacgcacacacgaacgactaccgacaccggtacaagggtaccggggtcgacacccgcacaacgggcacggggcgacaccgaaaggacgaggacggggcagcgagaggaggcacccttaccaccacgcgacgaggcgtgggaacgacaacgacgaacgggcgcggcggagacagctcggggacgacggaggcgaacggcgagggaacgacttcggcggctatccttggacgaaggcgagacacggccggcacgaggtttgacgacgcggagccgaggatgaagacgacgacggggctgcagtggctcactggacggacgcggacgacggacgagaacggcttgacggagggacgaacgccacgacgatcgggaacgacaagaggacgacgacaaagacgaccgaggtcggcgaggaggcgacaagggcagccagcagcactgcacggatgtgaggacggcgcggaacatgccgttgcgaatccgacgacggaggcggcgcagcgagacaacgagccggcgaggaggaacgatgacgatgacgacgaacaccggcggggttcagccgaaggggaggcgatgccaaggacgacgtcgtggctgcgatgccgaaggtggtggaggtgccgccgatcggtgcacgggcgaggagggacgggcggccgaacaactccggcgaggtggatggagaggttcgcgccgatgtgcggcagcttccgggcgaaaccaaggggtggacgaggtggagggctacgtcaccgtgccaagggaggggacggcagcgccggctgacgcatgggcacggcgtaaggggctgccggaggagacgtcgacgaggaggaaggagaggccggcgcgggcgacggcgtttcggcgaaattcgggcgacgccgtggcctggccgggaaagaggacggtgctctggtgccgggagaggtggtggcgacgtcagccggcgcacagggggcgtggcagaggcggccggaggcggaacagtggcggcaacaccactgttgccggcggggatgcacttccggaggtctccgcgggaaacagagggcaggccggcgaagaggaggcggctgcgatgctggaggaggcgatggcacggccggccggcgtgctgacgcggcggcaggggcggctgaagatggccggcggcacgggagagagaggaggacggcggagaggggtggtgaggccacgggagaacgcgggagggggctaaaactggagaacgaatcaagggggtttcattttataggggaggagaggagccggccacgggagaggcggggaacggcggctgaattcgtggccggcggccatggaaggtggccggggttggtgcgggcgttcccgacgattgggggcacgaatcaagggggaaattggggggaattgaagaggaaggaaaggggattaattccccctaatcaattttggaattcccggtttgaatcgcgtggattttggggaggaatggcgctaggtttccgggagacagagagaggaggccgggcgggaggaggaagacgaccagcgcgtgggccccacgcgggcgcgcggtcagcgcgcgtgcggcgcgcgtcgggggggggcggctcaggaggctgggtcggctgggtggggcggggagggaaaagggagctaggccgagggggaaggggaggcccaagagaaggagggagagaaggagagggagagaaagagaggactttggccgcgggccgagagagagagagagagaggactttgggccagacttagcccaaaggaggaaggaggattatttttaggtttttctttttaataaactttggtaattgttgttgttgcttaataaataattccgttgctctgaaaattcaagttaaatttgagggctcattttagaccaaggagaatttaacaaaaattctccgggccacattcgaatttttcttgtacgtattttagtgttaaccaatttcttttcgaattttaattaattctattattccttttagagaatgatttttatttcgggatgaatttatcaggacgtgacactcaactaataaaaatagtaaaatgtactaattactttggtaatccagccgctaatgaccatattaatgatagttggttaattagcctatcggtacaggaaccgaacctatatatatatatattctttgaattgctactgcacggccacttgtatttctccaaccaaaaatgcccgggtcgtggacacatcatcctttccctcttgaaacaaagccatccatggctttggattaattggagacaattctttctttttctttacaaccggaaataccactgacttgatagcactatcttgtattggtttcagcacatgtttacaccaagatgcataaaagaatagtgattactccggccctcatgcgttgcattaagatcaaactaccacggtcttcccaaaagcaagttacaagtattcatcggcactacatcacaatctactttatcaacatagtttccaatagaaaatgcaaccctcaccttgtgagtaattttcagtgtacctgcttgattcatccactgaatataacatggtgcacgaagccttcatgtagataaagataaagcatgcaccaaatctgaactgatagcattagtgaaactaccaccatcaattattaatttgcataccttttcttgtattttgcactctgactgaaaaatattataacgctgcccctttacatcaacactagagccatctcgttgtactgcacgtgcaagcatagataaaccattcttcttttcagcaccatcatccatagatgaatcatcaatatctcgatagcctgcagtaagagtatgatcaagttgtacaccttctgaattttctgataaactctcagaaacatagccttctttagtcatcaacaccttcttctgattaggacaatctctcatataatgtcctctccctccacaagtataacactctacactgcgtgatttataaccagatgcaggagtagattcaactttagattgggatttactcaccgaactagcagcaggtttagactctagaaggagtagtcggcttgaaagacaccgatttactagcggcacttccatcaccatctcgctgaaagaacgtgaacggctagtgtggcgacttgttagttgctgttccaccctttgagcaatgtgcaccatactttgtatatcataataatatgatatctcaacacgttctttcacatcatcattgagaccattaagaaatctaaccatagtagcttcatcattctctgatacccctatacggctcattaacaattccatctccttatagtaagcatccacactaagatcaccttgtttgagttgctgcaagcgtgtatacaaagatctattataatgttcaagaacaaaacggcgagccataacctctttcatatattgccaagtatgtggacgaccaaaacgtaccaattgattccaccaagataaagcataacaggtgaattcaatagatgcaagacgtaccttcttatcctatgaatagttgtgactattaaagatctgatcacaacgcatctcccacgccagataatcctccgaatctccagaacccgaaaaagcaggcatggaagtttttatcttgccaagcccttcatccaacggaacacgagcagatcgacgattccgattgtcacggtgaatatcatcaacaaccctatccataaaagcaggacctcggcagtgaggttgtcgaggacggcgatgatgatcacctccatcagaacgcaagcctagactctcatcccccgcatcatactcatgatgttcaggtggtggacatcgaccctgtctagcatgttcctaacgtggcggtggcaaacgatcgactaacatagcaatactcctctcaagcttcgtgaatttctgatttatacatttatcaaaataatcacaagcactttccaatccatccttaactccggcaggcaagttagcatcaaaaacaggcatagtaacctcttcctcatcagaaccatggtgagaaccaccactacttttagaacctccaaatttaaccatgatgcaaaatctgaaatttagcaaaataactcaattgtaccgtgatgaaccatgctctgataccacttgatgagcacccggcagcgagcgccctgatttcccctctcttttacggtacaaattagctggtgtaaatatataaccaatatagccttgctcagataaaacgatgcagcaatccaatcacgtgaaactctaccaaaatcaacaggtaagctcctccacccgtgcaacaacaatacacgaacagagagaagttggaactcacaagaaccgaaggaactcagccaaaaaaacagatctccagccacgttcttccttctagatccaccagcggtggcaaagaaaatcaatagtagggagatgaagggagcgccatcaccacagtacgatagggaaaaacaaaccctaaacgactcaaccaaaataaaatcctcccctgttacagggcagatcagcccttaataaaaggagcacgcaggcccacatgaagtctgttcggactcaactaataaaaatagtaaaatgtactaattactttggtaatccagccgctaatgaccatattaatgatagttggttaattagcctatcggtacaggaactgaacctatatttatatattctttgaattgctcctgcacggccacttgtatttctccaaccaaaaatgcccgggtcttggacacatcaggttagtccacagcaaatatatgtccaatgtccatgaacatatttactctgagagttcattaatcaaactcgactccatgtctaatttgattaaagtagtctagtttaacctaagcaccatgcttaatttaaaaagcctatggatgtctcgcgaaaacacccaagccagagcatatgcaaatagacataagaaacaaaaccatgtatactcaagtctcattcaaatagagataagtatgagtaaaagatgcggtgaatctttttctgcctttcgtatacctgagtgtacttaccgccagcatgatgtgtatgttgaaacctctggagcggtggtatggtcacatatgattgtcgatttctcctccatcgcaatgtagattgtagcggaggaaggcacttttaccatactaaggcgagctgtttggttatgcacacatctcaggtgcaatatccttgtgccttgaaggcgtgatccgttggcacaatgctgtagagacgtaggatacctctctttttggcaaaatgtgcaactgccaactggagtagagcagcaaacgcctagaaaagaagagggcaactcctcttgcttgtatgcgcgtaggtgctgcgggagcgagaagttgtgcatagctaggagcagacgaaggctgagccaaggcggcacatgagctcgagagagggactagttgtagccaggtagcatgattcctactagcgaggtgtatagttacatttcaaagacacgcacgtaatgcgccttttgatccaaatgtagctcttcagctctcttgctcttttcttcttctcctatttttttcttttcttttatctctcttttctcctcttttttttatcttctttttttttctttttttagcaagctaggactaacaccaacttcaaaccaagatggccttggttgatggaactcatcatgaaaagctcgtcgaccttcccccccacacttggtcttttgtgttgcaagacatcaaaaaccaagtgtgtgatgtcggattctcctatggagcgtgttccaatacctaggatcaccaaagtatacagttgatgtagctaccgagttcttaggcatcgcatgaccctcgttcttaatctcaacctgaaatggttagcgaccaagaatacctgaagctgcatataatcctagaaactggttcttgcttttattagaaagaaagcttaccatgataatccggggtatctcccggcagtgctttgtttatggtcacaagctcgacctttgggacattgctctgcaggattagtgccacaaacaaatacgagatttgcagtatttatgataaacataagcatccacaaccacacttctaaacatgttagaaatgaggaccgagaggtggttgtggtcctcacacaggaaagtggtaataatcgaacaggactctggggattccttctgtgagcatgaatcctacgggattttgaaagagaaactttcaagctcatatgtggaatgttttctctcgtcctccagagtcgatgtcgtaagcttgtccgtggcctgaaggttctccttctcaagagatgcatcgtgcaagaactgggttgtttcttgatgataaataagaacaacgttctgaaggccagagggacaaggcataggtttcatcgagggtgatgaggatcgttcagtttcatgaagatgggcaataggttctgaagaaacgaacgaagataaaaacatcacctcctcgaacggctcatgcttgggatgagccttgattttgctggaataattcagggtgttctcacaatcttcataaagatcatcgctgaattggaatggaatttccggaggatgaattttttcttcttccggctccagcaactggaatgaggattcggcagttgagtcgggttccgactccacgtgaagaggatcctcataggtaatctcgacctccgggatggcttcgctttggctgaaagaatcgttctctaagatcaaatctaagagttatcttccttcggcggttgtcttgtgtgcgaacaatcctccagcggaaatatcgagatttgcggcagactccttgtctaacccatatcgaaaatgttgaaacaacacatggtcgggtaaggacaagtctgggccagattgagttaacagtgagaacctggcccaagctgcaccgagagattccttctcattctgtcggaaagagaggatgtctaatcaaaaattaattagacgggttaatggaaggaaagcaaggcagaatttgtagttaagctccccccattcaccgtggaatttcttgacagacagagtgtaccattgcttcgcttcatctctaagagaaaaaggaaacaatttccactttagagtttcatgtgtcatgcctacgatggataaacatgaacacactagctcaaagtcccgaagatggaggtatg

SEQ ID NO: 58973 - DNA, 596 bp, Oryza sativa
tggctggccaatacggattggcagattattgcagatcagagagatgggtgggtgtgtagacttggcggcttccttccttccatcaaacgtgctgctgctagcttgggcgtgggtcccacttcgccagctgttactgtgtgggccccgttcctgccctagctctgcaagctcaagctgccgagctggctgccacgtccactccacagatgcagatgcagcagctctgatgatctcatgaatctgctacctgctgctcatcatcagttctgtgcaactgtgttgaaaaacgaaacacaaacagtttttgggacaaggaaatgttggaagttgcgtcgggggagggtctgatgatcaattcaatctctcctccgccgaagaacaaaacaaacaaatccaatattagatgcaaggagaacgacctgcgagttcacttaaaggctaaatagatgataacccatgaattttcgcgtcgtggcctaacttatcagatctagatatacaaatgggtcaatttataaacttatttatagatcaaattaataggtaacctgccagtcaaaaccggtgattcgcggataagcccgctcgccccccta

SEQ ID NO: 58974 - DNA, 1078 bp, Oryza sativa
ctactatagggcgaattcttttctcggtacccgatccccccccccccaacacgggaaccgtccgatcgagaacgtgcggttgaacaatcaagcggacagaggcgagcacagtatatggtgcaagctgcggatgccagcgacgaatatatgaagcagaaattttgatttttgagaaagagcaggtggtctatcgatcgatcacatccaaggcaatttcttcatacggatatcatgtcccaagacgtgcatccagctccagcttgctagctcccgattccagtcatccagtgtctcaaactgaatcagaccttgtttaccgatttactgaaccaaatataagcagaaggaaagaacaggtggttcagattccacaatcagaataactctctctgaacattgcttgtttctgcacttttgttcttgctactagctgagcaaagttgatgaaatgcggtgatctacaacatcaagacatcaaacacacaatcaaagtaacaactgataaggagaggttatatacaaaaggaagcaaatagaggagcaaggaaggaacagaaggttcagacttcacaatcagaatttagaactctactctgaactataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgagctgcactggccgccaggccgccaggccgccagccgccaggccgccagtgcacagtgtttttttttaaaaaaaaagcaaaggaaatgtataaggaaaaaaaattaaaaatggaaataaaatgtttaaaaaaaagtaatgatttactaatgttaaaaaatggtatttaaaaaatggaaataaaagttttttaaaaaagtaatgatttgctaatgttaaaaaaaagagaaaatggtat

SEQ ID NO: 58975 - DNA, 717 bp, Oryza sativa
gcgaattcgagctcggtacccagctcgcgcttggtgacgacgtggcccttgttgatgccgacgaagagccccgacttgggctgcggcggcgccatggcggatctcctcctcgctcctcggacctgcggcgaaggcgacggaacaaaccaaaatcgatcaacaaacagagaatcgaagcggagaggggcgcgagagatctcgagtaaggaagcgctcgtgtgtgtgagagagaggcggcgctcggaggctgcgtaccttggatcggcgacagctacaaaaccctaagccgccggctgcgtccgaggagaaaccctaagcgatggagaggatgttgttatatacacgtcgggtactagggtcacagcccagatcgattcgtaggaggaattaatgggccggcctagtttgccttcctgggcaatgactatgggcttgcttcacttatccatttcgctttttagctcgcgtttcgttgttatctcgagaggctgtaagccttgaaatgtaaaattcttgtacatgaaatctttcgtctgctcgcttttcacttaatgccatcatgtagcagcaaagaagattagtactccccttgttttttgtcgaaatattctttttcctataaccttcaccaatcgctataggcttttgtaccaaattttgatagcgttggtttagtttgatgtttttccaaaatttagtagcatttttatgagggaa

SEQ ID NO: 58976 - DNA, 674 bp, Oryza sativa
attcctgcagccccgccggcgagggggtgtagagggtggggggaagggcggctacggcgctccctcccgcgtgcggagcggcccgccgccaagcttacgcaccgatccctcgccgcggcggtggtcgccgtcggctgcttcggtcggcggcggcggcggtggcctggctggaagtgggcgcgaacaaagggaggcggctgcgcgtgcgcggattgctggtcggtacaagggggagagagagagagagaggattttagggtttagtgcaacccgtagcttcactttgttttggcccacttgacggattgcttgatgggccaacattttgaggaagaaagcccaacccactctacgtataacccagaaagaaaacgtatactttgactccctcaactatctcccgagtatgattcatgtcctccgaccacaaaaccggtatatcgactcctctaactattaaaaccggtgcaaactatgtccctcggtgattttgaagatggttttagctgatgtggcgcctatgtggtggtcttaactgggtctttgtcctatgtggcgtttatatagctttagaatgtatctatctatatctatataccaattataaaaattcaagaaattcaaggtgtttttgtctagaaatttgttacgacacatccgtgttaaaatcgatt

SEQ ID NO: 58977 - DNA, 938 bp, Oryza sativa
tttgagctacgcacattatatctttaagacatagttggcttagagctacgcgcattatggtttaagtagtcggtatactatctaagttcagccactcgcaaattcacaccgtatatgctatatatttatggtcaagtcactaggcttactgactttgtagttcttgactatatatttagttgttttctctctaactaagcacataattggaggctatgactaattaggtgtatctattcgatgcacttatttatttaatttttcttcataatccctccatagcttcttgcaatattttgacgaggactcttgaaggaagaactcccgaagccttttcaaggaagataaaatcactctgcaatgataaaaaaaaacctagatgaggattgcggactatgaagaactcagacgctatggagaacataggtatggtatacccacacgacatgttgttaatgaaaaatccgacacatttttatccaactacgaatagaaggttggtcagatccatataatatgtgatagcgtaagactcggtcactagaacgggatagctcatctgtaacgagtgggaagcctcatctgtgtcggcaagaggtaccgtcacgaaccaaaggtcactcatgtgaaaagtcatatgtgtcgggtcggccaccgtcacgaatgatagtcatctttatcgggcctaaatataagaccatcacggatgacactcttctgtgatgggtggtagttaagacctatcacggatgagattcatccgtgactgttcataagtacaaaccttcacggatgagaattatgatttttgaatttcaaatgcataaaaaaccctaaaaatattttaaatattaataggatattctaacaatggtcacacatcactacgtagaaattcttgttttttttcaagtgatatatgcatacatatcatacat

SEQ ID NO: 58978 - DNA, 7032 bp, Oryza sativa
accgatcattcatcattcttgcgttttttctatcatctcctttacaatggcatttctattaaaattctgtacttttccaatagggatacgcaaaatggacagactatatatgtataaactgtagaaacaaatatgctagtttatttgctataaaagcagaatcaatatatagaaagaaacagaggaggagaacaatatacaatgctgcaacagtagaagtgaaagcagaaccgttgccgtggccattcctgccaatagaaccgtcgccgttacttttcttgccaccaaccatattatcgccaccagccatgacgtagaggaagtagtcaatgtggttgttagggtgaggggccccgatagcggggatccgtatggaccctcttttatgagttcgactagtgagtaagtcgcacctgagagtatgccctgggccctgcttattcccctaataggatgaacacaaggaaatatatagaccgggttttggccacccgaaggaataccctactcccactcctatgagatggatttctctcctccgcgttaaaggatcttacaagttcatcgatccacggtatatagttcctctttccttccgttgtgtgtacgctaacaacttggctaaatgtgctgaagtatattctttcacacttcaccgaattctcccctcccccctcattcagggacacaacaagatcaaagttcaagagagttttttattcacatcatcattagattgcgcatgtgtccttagaagaggccgcctttagtttgttctaccttcctctaggtgtgccatatctggatccaccatggacttgggaggtgcaattgcttgccacacagccattcctgctctaccgaggcctcgggggcacttagtatggggccatgctaagttgcagtacgccgatagcctggcatgcctccgcacctaatccgcacatgcacgcgacaaacaaggattaccatgcctagctaaatatgggggaaccctgtcattgcctagcaaatggtagaaaaagaggtgctggtcccctctgttaagtggcagtcaaccacacgccctctgttaaatttctctgtcccgtgtcagaaccgacacatcatggatgcgaaaagggaatcaacatcacttgtcatcctgttttccacgcttcctatctgttaacgaccaaatttggtaagccatgaactagatttggcattgggattgaagcggatatgatagggaattgtctcctgggaacacagttcgcatcagctacgggggcatcggctgaagactgcatcggctagcatagattggacgaaagacagccgatgtagccgatctcgctaaggtggttatatgatcatctccgggattgattagcgtgctgcacaggtattgcaacgattgagataagctcacgagtaggcaattgtatctattaattaggatattttgaatagtttctttagagatatatctcggcaagggtctgccgtgaagattcgtttgtatcttagagtttgttagagataagagtcgtgtccggcaaggacctgtgatgtatctcgggtataaatatgacccgatctcatgtaaacatttaacaacagttcaataacacttttgatgcatcgccacctttttctacttttcttgtttcgacgagttcttgctttcgggttgagctgcatcgattttgatcttcaacaagaggtaaagcttatcatggcagcttgtgttatcgggattagtacttacatctttatgacactctaatcttggttatgtaaatcgtcgagttaacatatatgcttcataagctttattagtatcataatctaaccctacaccggccaatatctattattggaaggcagccgatagagttagatattgttggtaatctagattatatagcatatctaccatctcttagtgattttcatcaatatgtttggatcttgtatttattcttatgcttaatgctgcatcggttgagttcgatctattaagtaacattcataactgcaatatctagtttgtcttacatgggtcataggagatggctccccctacggcacgcctttaaaagaaagaagaaaattttcaatggtaagaaagaacttgggtctgcccctgagaatttgtccggagatcaagtacacaacatggtgaaagacattactaatgagtttgggtagaaaagaaaacgtagcaaggaggacaagaagaggatgtggaagaaaaaatccatattgcggctaccttactagaaagatctggaggtccgtcattgcattgatctgatgcacgtagagaagaatgcgtgcgatagcttgctagggctgttgctgaatatgcctagcaagacaaaggacgggttgaatgcgcgtcttgatctataggagatgaacatttgcagtgaacttcaacctgttacggatgagaagacaggaagagtgtacctcccaccagcttgccacacattgtcgaaggatgagaagatcgcaatgctctcatgcctggtagatattaaagttccttcgggctattgcgcgagaataagtaagtatgttaaattggaggatctaaaactggttgcaatggagtctcacgattgccacgtgataatcacacagatcttgccagttgctatcagaggcattctaccaccacaagtccgtcgcactatccaacagctttgtgccttcttcaatgcaatcggtcagaagattatagatccagaagacctagatgggttgcaggccgatattgtcaataccctgtgtcacttggagatgtattttccactggctttcttcgatatcatggttcatctcactgttcacctagtgaagcaaacaaaaatatgtcggccaactcttattagagaaatgtggccattcgagaggtacatgggaattctgaagtcctacgttcggaacagagcaaaaccagaggggagcaacattgaaggttacacgaccgaggaggccattgagttctgtatcgattacatggccgagactaatcctatcggagttcctgcgtctcgccacgaaggaaggttcgcaggtgttggcacaactgtcagaaaaagaattgttcccgatcaagcttactatgcgcaggctcatttcgcagtgctgcaacatatggctgaagtaaccccatactttaaggagcatttagcgaaggtccgatgggacaatattggtcaatcagatatttggatcaacagagaacatggtgctcgcttcaacgaatggttcaaggatcgtgtagcacggtcgaccgatggcctaagtgagatattacaaaggttggcaaggggtccatcttgggatgttgacacatggcaagggtacgatatcaatggatacacattttacaccgtcacacaagatgagaaaagcacagtgcaaaacagtggagtccgtatagatgcatatcagcatcaggttggatcaagcacatactatggccgcatagagcagatatggaagctgaactacctgaacttcaaagtccctttgtttcgttgcagttgggtgaatatccgcactggtgtcaaagtcgacaaggaaggattcacattagtggaccaggccaaggttggatacgtagacgaaccattcgtactagcgaagcaggtcgaacatattttctacataaaagaccccgcaaacaagaagatgcacgtcgttagggatggcaagcgaagaattgtgggggtggacaacgtcgtcgataaagaagaatacaacaagaatcttcatgtgagacctcagatcgaccttgacgatgatcccgaagatgaagtggcgtacgttcgttcagaccattcggaaggcatatcactgtaaatgatgtatttaatttgtattgaagccttaatgaatgaattgcatatgtttcatgccattccagttaattacgatttaaaactctttgaagaaatggatttgttaattatgtggttttaaaaagttatacttgttattttaaactatatgtgagaaaggcaattgtcaattatatgattttaaaaaattaataggaattttaaactatatgtgagaaaggcaattgccaattatatgatttttaaaaaataataggaattttaaactatatgtgggaaaggcaattgttaattatatgaattttaaaaattaataggaattttaaactatgtaaataagacatttgttaattatatgagataaatcaaatgtaatagcaattttaattcgcgtagaagttaattataaatgatttttataacttaaaaatattttaataagtcatctgtgacgggctttagtactatgcccgatagagattattccatctctatcgggcttagtgctaatgcccatcacggataggtatcatccgtatcgggcaaagtactaacgcccgtcacggatgagtgccatccgcatcgggcttagtagtctgcctgatagagatgaggattgactagggtttacttagtcaatcctcatccacgggtccttactctctcttactctctcactctctagatccaccgccgccagcgcctcctcctcctcctccaccgccgacaccgcctccttctcctccaagccatcgcctcccgaccgccaccgcctccctccacgccccccggttcatgatccaccgccgcctcctcctccaagccctcgcctcccgaccgccgccgtctccctccatgcctaccggttcaagatccaccgccgcctcctccgcgacgctgccgctgcttcctgcttcaagatccaccactgcctcctccatcgtcgtccggcctccccgaccgctagcgcctcctccacgcgcaagaccgccaccgccggcttcctctccgccaagtctgcacgccgccgcctacaagttccggaggccacgttgaccccgagcccggccacgtcaaccccgaggccgccgccgcatcaacggccccgctccctgccgcgtcgaccctgagcctggccatgtcaaccccgaggccgccgccgcatcaacgaccctgctcccggccgcgtcgaccccgagcccggccgccatcgtcaacaccgacgtcacctcttcttctccctggtgcgcatgtcctccctcttctttcaaatgccatgtgtgtagatgttgggatgaagtgggctatgttgccatgttgggatgaagtgggctgtgatggatgtaatttgtgatttttgggggaagtgccatgttgggatgcagtgggctgtgatggaattaatttgtgatttttggggagaaatgccatgttgggatgcagtgggttgtgatggaattaatttttgatttttgggggaaatgccatgttgggatgcagtgggctgtgatggaattaatttgtgatttttgggggaaatgccatcttgggatgctgtgggcagtgatggatgtatttgtgatgattggccaatgatgattgctcaagaacagaccatatacacttgtgatatttgggttttgtcaataagaacagaccatctacacttgtttgtttttttgggaggagtggcagtatgggttgtttttgcaagaatggatacatttttgggccggcctcactcttgttcttgttttggtttaaatgtgggtttttaatgcataagaacagaccctatacacttgtgatttttgggttttgtcaataagaacagaccatctacacgtgctcattgtttttttgggaggagtggcagtatgggatgttttgcaaaaatttatgcatttttggaccggcctcactcttgttcttgtttaggtttaaatatgggtttttaatgcatcagaacagaccctatacacttgtgatttttgggttttgtcaataagaacagaccatctacacttgttcattttttttgggtggagtggcagtatgggatgttttgcaaaatggatgtatttttgggccggcctcactcttgttcttgtttaggtttaaatatgggtttttaatgcataacaagagaccatctacacttgttctttttgggttttttcaataagaatagaccatctacacttgttgtttttttcaggaaagaaaatgagcaaaactgaggccaaacttattatatgtcatgacttgtgtactatgggctattttgggcaattttgagggaaatgggatggatatggatagggctgttattaaatgaagttagtgaaattatgacatttaggagaatacgaagtgttccggttgccaaatctggtttggtcgggttactgcctgcacggtaccgaccaagacaatttggtaaataggacatttcattcaaataagacatttctagaaatttgttatcgttaccaatatcctagattgctttcaaggtcatttctttagggaaccccattcccataaattcagtatccaaagctggttgctgtatctatgggaataagggttcctaacgaaatgatcttggatgcaatcttggattttgcggacgataacgttaggagtctagtgcaattgttttgtgacaagaataggaagggttttggttgcctgtgtgttctatctaagtccacctcgtcagcagatatgtaccatccatgttcctcaaggacgaagcagacggtaccacgacctcgacatcagtatcccattggaacttgctatcgttgtcactatcatatggtagtgacattgatagcaagttcgagtgggatactaatgtcgagatcgagttcccggctgctccggccttgttgagcatagatgctcctgttccgtcgacgaggcgaatgcaggtaagagatagaggtataacaaaccatcagagaatgtgtgtagatgtaattttctttttaaaaagtactttcttcccgtacaaaagtcacataggacaagccacagcaaggcgaaccaatgtcgacgactactactgggactacttcaagccggaatcctaggacccagaataagattcctaaggaagtctacaccataacacagatggacgaggttggatatccgacggctc

SEQ ID NO: 58979 - DNA, 11683 bp, Oryza sativa
ggcctggaggcagttcaagcaaagcttccaataccctacagaggccaaggcaggactcaggcggcagactctccgcaagatggggaattgttggaaaaacttcaagataatgctggtcacggagtacgtcctcaaccccgcccagctagaaccatttgggaaatacccattcatcacccgaaccatgtgggatgagttccatgccgccaaatcaacgaaagagtctcaagcaaaaagccaggcctaccgggatctacaggcaaggaaccttcacccgcaccggcttggcaccggaggctacacggggaaacaggaagaatgggacaaggaggatgaagctgcagcggaatctaacaccccgcaagtgcttgctgatatccttgtccagcgggcaaggaactgggcaagggcaagggtgaagaagaatagtgacggaactctttcgttcccaaatcccgaagatcaagcggtgtaccagaaaatcgtaagttgaacacatagaataagtttcattatgttgtatcgtattcttcatctaacgtgtcctaactgtaccccatgtcgaactgaatgctgagagacaggcctcccaagaggtctgctcacaaagacaggaggatgacatcctcacgaaagtgttgggaaacgaagaacaccatggatgaacaaggggcattggctccaatgttccatggaagtttgggtttccccaatacgtgtggcagtacaagaagcacaagctttcaaaggcgtagaaaactgcacgccttaaggaccaacttagagtggagcttaaagaagagcttagagaagagctaactgccgagctgttaggtatggaggctcgggtggaggcacgcatcagggataggtcgaccgatgccactcccggtcccatagtacaagtgagccccacgcagaggcgtagcagctgcgcatcaactgaggctccgccagaacagcctgaaggccccgccgcggtggatcacataacggtaaaaatagcttaataaggcatttattgtattagcaccacaaatacgttgcaacatattctaagaacactaatgaatctatcgcaggaacccacatcgtgtaccctagtcgttagggtgacaccaggatttgcaattcctgccgcagagggtcaagcgttcaagcataccacggagacccgagtgcatgtggcgcagctgctagctggcaatgccaaagttcaggtggacttagtgaagcccgattgggttggctactctatcccgcacccacctaatgacgagattctgacccttggggttgcacgtgggacctttattcaatggcccaagcatagcattgagatcaatataactccaaggccacgctaagttctcgtccgtcgccgacgcgtccccatccaactgttgtatctctccctcctaccgttgatgaaagagataaagatctccaattacagtatgatatagatttagaggacgacggtatgaaggtcgacagcaggccgcacctcccccctcctgccaaaaggagcaagagggcgaaatcttctccacctaaacttgacacacgcagaaaagctgctggaacagggagaggagtaggaaaggtgccattagccccaaagaagcttgatcttgtcaaggcgctagtagctcctccaaagcctccggccgaattcacattaggcatgccattggtcggagacgatgcattattcaagatgggccctgcatgcaaggagttgcatgggtactacatggagaagtccaacacaagaacgaaaaatagagagacctccatgttgggccatcacaatagtcagccgttcctcgggccttctaccttcatcgctgtagacttcaaagatctatgggacctctatagggtgcgagcgatcgacaccaacctccttaagtgctactcctcgtaagtatttctgggtacgtgatatggtagtaactacccataaattacgcttacccggactcttttcttgcttgtaggttaacctggaagcatgtccatcgtaaagtaccccatgttgccttactcgatccagctgtcgtcaacgagacaacgctgaaaaacgatcaagccaacatggtggactatatcaaggactgcttgtttgcttgtcaagacaaggacttcattatgtgtgcctacaatcaacagtaagcgtgtaccctacttatactaaaatgcgcgtcgcgtacaactgtagtatgtaacttgcaatttattaattttgcaggcgtcattggattgttctagtaataacgccgaagtggagtttggtatactaccttaactccaatatcaatccaaaaatatacgattggtcggccatcgaatctgccttgaacgaggcacgggaccaatacgtggcaaaaggcgagaggcataacgatgggcattccaaactcggctacaagaaagacttcccaatacgtcaacaagttggcgaccagtgcgggttccatgtctgccataacatgaggagcttcgcagataatgtgacattgctcgaccctaaggtgtgtccttcaattgtttatacacacataggatgaaaaatttacaagtatgtagactaacatggcgcctcacatgtagggaaaaatttcaaggattttggaaatcaacttcgatatcattagagaggagatagcaaaattcatactagatgatctcttgtcaccgaaagggatgtttagagtgaagtcctaggtatagctcatcttggaatggcagaacatttgcaatgcatatgcgacaaacaattgatttttgtaaatattctttgtaatacaatttaattctttagagtaaagtcctaggtagctcgtctctgtatatacttgcatttctaattacatataaatttgttccaatttataacttagttttgcagctttggagagaaaaatggatgtgaatgacatatacttcctccgtttcacaatgtaagactttctatcattgcccatatttatttagatgttaataaatgtagacatatgtatgtgtctagattcattaacatctatatgtatgtggctaatgctagaaagcctgacattgtgaaacggagggagtacatgtgatgtgaatgcatgtgttctgatggaatataaatgtgaatgagttgtgaattggctgtgaatgcatgtgttgtgatggaatgtaaatgttgtgatgctgggaatataaatgttgtgatgctgtgaatgctgtgatgctgggaatgggactatatatatgtgcttctgtcaattttttcagcgggcatggctagcaaaggtctgagtctagccaaattataaaattttattttttttccaaactcatccctgacgggcattttagtaatgcccgaaagagatatgtcatccgtgacgggctattagagtaagcccgatagagataagttatccgaaccgggactagtttgactcaacacgtggggtcaaaccaatcggtgacgggctctatctaaatgcccgattgagatgactaatcatccgtgacgggcttagtggtgtgcccgattgagattagtcatccgtgacaggtttctaactatgctggtttgattggtcatactcatctatgacgggctttgttttcggcccaattgagataacatccatccgtgacaggtttttgcccgattgagattttttctcatatcagtaacctttacctagtgacggaggctttactcgatagtgatgaggctttcagcccgtcatagataagcaatcccattgtagtgttcccgtgagaaggagttcctcagaattaaagtcagaggaacatgagttcctgaaaggtaagatctatcctcatgggcccacatgtcagatacacatgttcctctgactcaaattagaggagtctgactcaaattagaggagtctagtcatgtacgcactcagtcttatatacatattattatatgtgtgcatcttctgtccccgtccatgaattcctgtgttaacttatttaaacacttggacaactgggccaccacacacatgcacatcacgcttccttaatgtattattaatggtgttccatgcatgtactgcttatatatacaataatctggctgaccatacatctgcgtacgttgacctactaattaaccgtgtgtacgtgtacatgtcgcgtttcaagtttgtttttgtatgcaattggtgcaaccatgttcatccgtgtgctagttttattaaattaaaaccctacatgcttgttctcgagtgcacgtatgcctattccaaagcaaagaatataatggatgctagttgctagtagcactgtttattaggtgaattctgtgcaactcgtgcatgttcatgtgtatgctaattaaatacactaggtaggtagtattgcgcaggtaccgctatttttctagatgttaaattctttttggtgactaaaatttattactcgtaactacacatttttatataaagttcacatatgatgttcatatatctagtcagtgccacatcatttagtttgatagggaagagtttgatagggaagaactggaggtcttacttacacctatcaagtttgagatataatatactagaactgagattttggttaatacaaaactacctaagtaggatcgaattataacaactaagccaaccagagggggtgaatggttggtatgcccaaaaaccaaaacttttagcggaaataaaagttaccttcaaattcgacggatcgcggtctgaccgaagtagtagcaccgatctgaccaccctgaatacgttggtctgaccgatgtagatcgatcgtttgaaccgccgaaatcgactgctctctcctatcgcagcagccggtctaaccgtcgtgtgctcgccggtctgaccgctgcgataccgtcggtcggaccgccggtgtccagccggttggaccaccgtacccgagaaaacataaatcgaagaattcttaaagtagatgacgactttattgattctctctttgtttacaaagtgcaccaacagcactcctacaaaaatttcgactaaattcgaaaccctaactcaactatcaactcaattgctctcaaaagcgataccgggaagcctgacgctccctctctatttatacatgaggtaggcaacccaaagccacaaaccaaactcatactagaagtcctagtccccctaggaaaccttctcgtacaagacatgaactttacataaccaatcataccaaatttggactctttccaaattcgactccacatcccatacgcacacaatacctccatcgtatgccatatggaatcttcaccttccaggtgcattgaactctagccttagtatcccgcatgatctctgaccaccttggacatcgtcttatccccaagttgactcccggtccatcaccgcaaatactctcccggcatctcgagtcacctacagaagaaacaaacaaagaaaccatatttcgagaccaagctatccccatcttgactcattagtagcaaacaacagtattacatacacatagaatccatcaagaaatcatattcatgaaacaatcacggatatccaaacaaccaacccgaaatcgaaaccgacacagtgtcggccggtcagaccgtgggctgtgccggactgaccacgcaatacacgccggtctgaccggcagcacatgcccggtctaaccggaccacaaatccagtagtacctgtagatcacctgtaaaattcaaatcatctccaaaaccacttcgcaaataaatttcaaatatcaaaaccaataatctccaatatcaactgttcatcacaaaataataataataataaaacacttttgattttacaacctatttaatttttatgttttccttagggactctcgcgccttttctcatggttgatagtggttgcgaattgatttcataacgttaatatcaaattccgataatttcaactaaatatggagggtactgagtgatagaagttcagaagttccctatgacgacatctatacctcggttgatccactagtgaagaaacgatctttaacaccttatggaaactcctgtagcaactgtgacaagcaaattaggactaaagatggtaccgattgaaataaccggtactaaatattcataccaagtcaaaaaattatgtacaatacaggattctaactcaaaatctctctcttcagccctcacactcattatcatcccacctactacacatctaacttgaatagaaattctttatttttaaactaaccctggagacatctttagtccaattggtaacactaaccggtattaaaaatatctttagtctaggtagatactcgggttaccaaccggtattagaaatgaatttttagtccggattggtgttgctaaacgagactaaagatcatcaagtattagtctcggttggtgttaccaaccggtactaaagatgtatttttagtactggttggtaacactaaacgggattaaaaatgttccaagagacttggacttttagaactggtactaaagcatcttttagtagtgacatcagatatttgtgattttggagaccacaacaaaagataagttctatagtagtgacctcctatctatgactactcttgccgcttcaagtaaagatggcacaaataataatacgtagatatacaaagttaaaaagaggttcagtcatcgtaaattagttggcaagtcccttggaggtttgtcttggtggttcgttgtgacttttgccgggctcatttagtgcagtggttggttgcctagcaactagtgcaacttgatgctagtcagcacctctataaccctattcactttgcaatggctaaatacaacgttctaattaaaacactcactttttttttctggtaacacgtttgtatgaatattgttcctttagtatgtgatgacctagctataacatgggtacacgtataaattaagctataaaaattatctaacatctaaaatttaatagaggattaagtgtttgttgttttgcattttttttaaatgtgatctcaaatttgtcagaggctttaagaaatctagtaggagggttcgataacacgtttaatgcacttacaaattgactttttataaccatatgttctaaatattagtcattatatatttttgtttaattactgttacggcatatattactgagatttttcctaacatttaaaattatctttttggtggtattgtggacatatatgttttcttagatttgaagaaaatctcacgtgcgcatttagctatgtatgttaataaagctatatataggatgatatattcagtattgtcaatcatcacataatactttgtatacatgcacaactgagtgaaaattgaaccttactagtgaaattccagaaaattactaccgccattctaaaattgaaaattactatccccattttaaaacagtaataatcgaaaatatcaaaactactttcatgtatttgtattttattattatggatatattgtaataaaacatcaatcactaaatatcttacagtccaatatatccgttcatatggggttcagtaagtgatatacaattatatactatacatattatttgtttatttggaacttttatggttgattcgattgcatatgcatatagctaaaagagaactcgacataacacatttttacaacttaacgaatagttatatgggtcttcaatttttaatttggtctttcatctcatcaaaccaagaaggaaaaaaaatggaaaaagagggttcatacctattgttggaatagggctaggcccaatttattctcaattaattccattggtccacaattaatcctatgtaaaataatacaaccttgtacatttaagtgggactggttaaggtggtgtgggatagcaacacgctggcgcgcacgtgctgagccggcgggctgagggtgtgggcatgggcgtggcgagactggcggatgctgctgctgctgctctctctctctctcacacacacacacatgtttgatctcgcggattaactccaggcgttatcctcgcactacaattcctcccaccaacagacatctatctatgtttcctggagcactgcattcttcctcctcggttccccttcatgttgttcagctgcttctggcttccccgcgctacaattcctcccaccaacggacatctatcaccgtttcctgacgcactgtcttcttcttcctcggttccccttcatgttcctgagctgctcctggcttccccgattctattcacttgcgcgcacgggtgatcagtacgttccccttcctgttcctgagctgcttctggcttccccgtttctgttcacttgcgtgcatgggtgatcagtacgagaaggcctccagaactccgtccacttgcatacctgtatgggtaggcgagcgataaagtttctggggagcgctctcgggcgcgactgctcctgttcgacaatggttctgcaccgctacgtcttcctcctccacaccggcttctgcactgctgcgtcttcgccgacatgtcaatagacaacacccgtactggcactggagaaggcgagcacgacaaccgcaacagaggcaacaacaccaccaatgcctcaactagtacaagagcgttctcggggtatacttccatttccttactgttaatcatgctgctagatgtctctctgttaatacttatcacaatgttcgaattgtgttactatgtgaaatatgatgcttattctataaaaaagcatgctcatgttgctcatgtttagcaccttcttattgcagtgtcatgtttattatcttaatattctagattaaaatatgttgaattatgaccatatttccaacacctatgtacatgcacgtcaacaggaagatgtcagggatacggataaggcataccctccatcctacgacttatgaaatataccgataagatataccttcacgtacacggatcgtttccgttacgccgttaggaattcttctcgaattatcgaaaatctctacgagttaagaaactaccagagtcctactcggaggggatagaacctctaccatatcgtgccagtttacatatccctaagtcttactgggggtcaaggtattccacagtataaaagggacccctagggggaggcaaaggacatcacatctcatcgccagcacacccaccaaagtttacggagccggagtatgcggagccaactcgccgggagatcttgtcaaatccctcgattacgatcttgtcggtatcgcctgtttcagttactctctttgtaatctgttttcatcgtcatcaatctcatataaactagagtagagctattacctgataaggggcccgaatcagtataatccttgtcttctgtttgcttgatgtcgtactacgtagaccctcattccaatgtaccctaatacttaactcatccggtccgcgagtatccctcgtcgacagaagagatgtgggatttttattttgacaagtggggcttatagagataaatctaactgtgaaatctttaagatagatccattggtatatagggtataattcaacggttagatgtttcgtttgttttcaagattgttttagagagcgctacgtgacaatataggcgcgtttatagaaacatcacgtggtggtttaagatcgtttataggatgtttaatactctctccatgcaaacttggtcatcatatttgcctttttattaaattttcttttgttgtgattgcacggtcatgtaaactcttattgtgattccttcattctactacagttattcaaatatcccacaggcggggtaccatttagtagtctaatatacatagcaaacagatcaaatgtggacatttttcttgaaaactctttcgagacttttcaaataacaacaaaaatacactgattatttctggtccttgaatttttggaagtaattaacagaattcgaacagtgcaaatgtacactgctggccaaaattaatacacagtacaatacagtacgtacaggaagcagatgctaattgtgtcgccattactgcggctgggtggtctcgatctgtcgcaagaaagacgaccgagacaaaagatgcttgtcgcacgtacagcgccgcgcaggtggcaaattaaccggtcgatcgatcaacataaatgactagtattagattattaattaaagctgtacgttaaccatgttgtttggccggtggtcgtctcaagtgcagcagtgcagccgaaatgttggacatgtacgatccaatgttttacactggaagatcatgactaattaacaacgtcagataattttaagattttatgatcctagactcctagtacctaccggcttaattgtacggtggttgattctgtcgatgttcagctatgtacgaggtgtaaaagttaatggatgtacggagatacaaatatttagatatgttgagaccctttcgacaagaggtaataccaatataagaattgaatatgtcatgtgttgtattgatctgatgatctgattatagcttacgccttcaagaggatccctgtccaccttatataggttggaggatagagttacaatgagcaaaacttagccggaaacaacatcaatttcctaaactattatatggtagtatgcattggggctctatgctcttacctttgaacacaaggtaaaataatgacccactagtaaggatctaaacatcctcgacaagtcatctgtgtcgagctaatgtgacccgtttcggatgactcatctctaacagttcaaaaggtacgtcgtttaagacatgaatatcggggatgatccgtcaccgatagaagtcatctttgccaggttgtagtttgaacacgtcacggatgacatataatgagtcacaaccataccccgtcaccgatgttgggtcgtagctcgaaaacgtcacggatgacctataatgagtcacaaccatgccccatcaccaatttaaattcatctttgttgggacgcagttctaacacgtcacggaagacctataatgggtcacaaccatgcccatcaccgatttaaagtcatatttatcgggttatagttcaaacacgtcacggatgagctataatgggtcactaccatgccccgtcacagatttaaagtcatgtttgtccggtcgtagttctaacacgtcacggatgacttataacaggttacaacaattcccaatcacggataacatatcatccatgataggtgtaatgagatgacccttcaaacataacagcactcatccgtgacggatcttaattaacacccttcacggataacgttacgaacagtcatggatgaggaaaaattaaaatttttgaaattttcaaagaacctctgatagagacataccctatatggaagttatagatcttgatgagatctataactttaaaactgatagtatttgaatttgtgatagtttacatgcccaaatattcattataggtggtgagagctattttgaaatatgtaattttgaatttttcaaatgatctcggatggagacatggcctatatcaaagtgttacaagtgatgtgatctttttttttgaatttttcaaacgaccatggatggagatataccctacactaaagttgtagagctcgatgggctgcaggaa

SEQ ID NO: 58980 - DNA, 2396 bp, Oryza sativa
ggcgctcttcggctactaatgtcggttgtgggtggaaccgactgaaccactgacattagcaattggcattgagcactataaaagcatcttctcacttcactttcaacacaacacaactaaagtggagttccatcactttcatttttagtctactctctagtagagttagaatatggcgagagtgagggaaagcttgtcggaattgttggcatcctctccactcttgtaccttggtggatgcttcttttatataagcaagtattcatgattttttttgggtatttaattttcttatttaagtaaaatataatctcatcatcgaggtttcattgcttagtttttatattaaatgctctagtactaatactctggttaaatacggaagttttttgccaaggctagagtaataatcaatagcatagatgtggtctcttggttagaagttagcactgtttgttgtgtgctccacgggttctagatgtaggtggtaggtggtgatagccttgtccatcctttgtaatcctccacattcagttaatcatagagctacaagtcagacttgcttggcaaaccagggagagctggtgctggtagcaagttatatagttttaccttaacttaattcaagaatcttaacccttagaaatcttctctacatttcacctattatttagttgttgtccttggacgaacatgtttctaagattcgacacacgcgttccctgtgatttgatacccaaggaacactctaaggtgaagtgctataattgtatccatacgcctgcggatttatctgtgatcgtggcaaataccaataagcatttatggcatcgttgtcggggaacagttgttatgttatgtttgaacctagttcttcctctcatcctttattttatttcttcttttcttttcttttctaccatggagtaactatctagtcaaaactttttcactctgaatggcgagctctttgagccacccccttcttcaaaacctactctcacatctaactatgaactccgtcctggcgttatagccatggttcgggaacaatccttctcgcgccgttaggaagacacatggtgaggggtaactcaacaccaagttatgtcttccttttttttcccgttaacccatgttgtctctatacggatgaaaattgttaacttttggcagagtgagaaggattatgcattgtatcccgatgttttcaccgaaggtttgtttgcacagtagaaggtatggattgtatcctagagaacacctccttcatccacagtgaaactctccaggaaatcaagcatacccataaggagccctcaattgttgaatccaagcccatactttgtacatcacaagattcaccctttgaaccatcatctgaacctcatgaaccgaaggaagaagaaattcagccttcgaaaatccctttcgtgttcgaggaaggtctttttgaagactatagaaacacctcgaactattcctatcaaaagagatcacatgctcaaagggacagtaaaggagttaactaccatcatgagcgatgtgtggttaagggaagtggagccgtcttctgaagtaattcggatttcgcccccttacttagctattcaatgtcttgtgaaggagactgtggtgattgttctctataatcccactgtcggtgctaacatcctgtttgcaacttttgcgttaactttgttgacggtcgttaagtaccaatttctttcaccaaatagcacaattaataaaggaaaattagcatttcttacacgtatagcaataataaataatgtagttgtattatgattggagaatcaacctggtgttggtatttcttaacgacattactagaaatataattcccagcaatggcgcataaatacttctggtatattatggttacagagttcatccgcaagcgcacggatataccgttgtagcatttcacccgagagtattccaagggtatcgtatttattttatcccatgggaagatcatgtagagagaactcaactaatattttatatattacttgtgataatcatattctaagcatgggttaagataatccaagagtagagtgacacacaagcattaactactcatcctcataatatttcatctaagctaagtggaaagaaaagagaaaggaaatctattcctatacttataatatacatagtatacatacattctagttaactgttatactagctaataccctctatccgatgccctcctagtacttcgagaagccacccttgactgccgagttccttacgacagcccgtcatgaccatccaaccggggctaaatacggagaaataccctcccaggaaattaacttaggattatatataggcgcggaggaatacccgtactgagctgtcac

SEQ ID NO: 58981 - DNA, 1019 bp, Oryza sativa
attccggtgcatactacctactcagggaagaggttagcagaactttatctgacaagaatcatgtgtttacatggggtacctaagaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagattttaattgaattatgacgcaataatgaattatttttgaaaaggaaaaagggaattattgcgtcagcggctagggtttgcggtggaccgggcgcacggcagcggttcacgggaacggacggccgagattgatccatccaaaacggacggccgagatcgagcggatctacggcggctcacggcagacggccacgatgacgtcggcgatgacgtcatcaccggcggcgactcgggcggctcgggcgcgcatgctcgccggcgaacgacggcacgacgacgcgaacggagggcaccaggacgatgcgggcatcgcggcgaactcaccggtgaccaaagcaacggcggaggatgaacggacggcggcggcgttgaagaaaaaggcgggggagttcttcggtttgacgacgacagcgatgctccggcggtctaccgcgac

SEQ ID NO: 58982 - DNA, 5184 bp, Oryza sativa
cagcccttccgggttcccgactcctattctatttctattccaccagctagatactactaaactaaacttgagagaaatgagagagctattgcttgaggtgtgtgttgaagtgaagagagtgaagcctttatatagaggtggttatgacggttgtggaaggggaattgtccgaagtacgctccaaccgtcattgggatgcaatcctggatgtccacgccaaaacctggatccaacggcgccaggattggttcgactgaacctgggactggcccaatccagcccaatttcggctggtggcctcctctattgctccactccgcagacttgtaaattttggcccaattcattgtgtcagttctgagttcttggcccatttattcataagtctggttttcgacatcgtctgattgatttatcatctatgttgatgtcgattctcatctactttatgatcattctctgcaaaaaggttagtatacctaatactagtggaatattattattctaacatacttatgcattgcaaacatcactagttctctcctattttggtaatattgacggtcgaaactgatcgataacaaccgtcaacacctggatgcaggaattctacatctaagtgaaggagaaatcagggcggcatgcaaagaaacccatcaccggtgaatcatgtgtgagcacacggattaagcggcccacatattagaccaaaccgacctaaagtgtgaccaaacagccatgcaccgtcttaggggcccacatgtcaggccctggtgaaaggcggtggagagagaggtgggactaggggttcggccaaaccgccattgccacctctaatctccactccccacatgtcactccttcacccactcccgatgacaattgtgtgtggataacagcctccaaccgccatacaactgacttttggaggctacaaatagaagagagctgctcacttcacaacacaatcttaaggagcaattctttcttccactttgtattatctatagtttctattaggaataatgcttaggagtttcagtcctatagtcctctcggagttctgggtatgtctctagtaatttactcctctttgtattatcttctttatttatttatgctcatggcttatatttttgtttattgagttaatgttcaatgagtagtataaacttcgtatatctacttcatcttaggctaatcaatccatgctatggtaacagttcaatgacctttatagggtgagagtcccataggagttagtgatattatttactgacataagcgtaggctagataaatgccttggatgtaggtgtgccccacggaaagtgaggtaggcggcaggtgatgacagccctgtccgtcatttgtatttctccatgttcgggtatgacgtaagagtgcataaatgccataatcatgctggtagaccggcagggagtggtctctcggtagtacctggttgcctggaactaagtcctatgttgtaagcatctatatgccaagtgtatactagacctgattagtatatacaaaagtacacctgattagtatatacaaaagtacagatgaattgtagttacctaatgctaatttcctactagatatccttagataggtgaatctcctgtgtgtgtccaccaccttatcaattattattctaacccctgtttagactttggtgaaactaattataggtcaattaaggagatataaaaaaacacatctttatgccgccgccttcactgcgaaaatataaatacgatacccttgggaatactaatgggtgaaatgctacagcagtatccgtgcacttgcagatttatctcgaaacataagaaataccaacaaactttcttaggggacgagtcgttagcaccaaccgatgaaacgttccgaagtcccttaggtactcatagaaggttatgaggttctatgtggagtgcctctaaggcacgagatgttcctaatacatgttgtgcctaagaagtgaggcatgatgatcgttgaaaattccacaaacgacttgatcccacaacaaaccgtcataggatggaagatgtgtatagattacaaaaaactcaacaaggcaacttggaaggatcattttccgatgtccttcattgattgaatgttagagcggcttgcaaatcattccttcttctatttttttgatggttattctggtcatcatcaaattcccatccatcccgataaccaaggaaaagaccatgttctcatatccttatggaacatatgcttactgcggaatgtcatttgggttgtgtaatgcagctgcgtcattccaaaggtgcatgttgtctatttgctctgacatgatcaagaaaatcatggaagttttcatggacgacttctcaatctatagaaaaacttttgatcattacctcaagaatttagataaggtcttgcaacgatgtcaagaaaaagtacacaacatcctaggacatgtagagtttgactagcgtttcattaaagatttttctcaagtggatagacccttgtcttgcctgttagctaaagatgttccctttgattttattaatgaatgcttaaaatcatttaatactagtagataccccgcgctttgctgcgggatatatggattaatgcatgttatacattatagaaaaatgaaagatgtgtactttcaaataatattgagttctaaaaattcaacaaaattgaaaatgatatgtcatgttcgcttgatatttaaataatatagataataattcctagaaggtgatgatgtggcatactcgcatgttaacctttagtagtttgtgggcattaactttatagtaagatagggttctgaaagaatctctcatcttagcatcaagcattcaatccttaattggtcgctgtcgtttgaaatcatgtgtgatgctaatgattgtgttgttagggccgttcttggccaaactacccatgcaatcgcatatgctagtaaaaccttgactggagctcaaataaacttgttttgcatatccctgatagcttaggagaaattttaacataggactagaaccatttgaaattagactacataatctttccaacaagtactcatgagccccaagagtccttctagattaacagctaggtccaattgaagttgatgcttttagaaggcccgaatgtgaatccaaaacgtgcataaattattctcttgccttctgtgtaccaaaagtgatgtgatgatgtaggagtatatttggttaaggtcttagttataacacgcaaatctttcgcggaaaatatgcaccttggttcatcgataaataaggtagccatgatcatatctgaactagtaatgtcctcatcatcaaccataggcgccctgctccatttccctatctcgtcgaccacgaacgctccatgcctttccctcaattctcctgctaccttcctatgttatcgcttctctccctacgactacaggtgctagctctagctaccattcttcccttggtccatcagccagcagctaacgcttacaacgggggcgcacaaacccagcagagcaaggaccctggagggtttgggggtgaggattgattttgctccgttctgtgtaaaccgcataattgagcaaacggggtagttcctatccgttccaccttcgtgttacctcattgccatcccatagtcgatcaggaccaattgctcaccccaactcatagtcgcactcgctgcttgaagccctgttttgtgtcatcatcagctccacattattttttttcttatacccgtcactgagcttctattgttttgagcactgtatgaccatagtttcattgtatttcattgattatcatggcaaaaaaaatcatctaattaataaataattttgtagtataattgtataatatccactctttccgaccctttttgtcctcgcaacactctctccacattagcaaaattatatcaataagtttagtgaccagcaactaaatgtcttgtgtatatggcctagttttttccctaaagatatgaatggttgaatttgtgattattatttaagagtaaaaataataattagctatcctaaagttaaaaaaagatttaaaataattttaatttaataaatttatacttttttaaaaaagtaccattttaatactcagaaaatgtgtcacatcaattcagtgctctatttcttaaaaaggcacgatcgaaactactcctccatctctctgtcctgcggtttcctactagtggactgacacatatatggagatcgaatcctgcatttttcttttccttggctattgggccttgatctctaatcggctccaaagctttttcccgttatccgaaacgttcaagatactagcagtaggtttaaaatctcctagcacgtagcttgtaaaattgttggggtcaaggtagtctcaaggaataatcggaattaatatccgagaataatagagcactagctagttggggcctttcgtctgcttgctgggctgcaggctgtactagctagctagcctccaccgtatattctctcctcacacagaagactcgagtcgctccaccacaattgcatcttctttctacctttttgtgcaaatgcattcacagccgcatcatcggccactaccattaccactgagcccatgaccggaccaaaggaccaaaaggaaaaggcaataacacggtgcccagctatctaatccctccgtccaaagagatttggctgagttcgaaacgaggggttggaaaccaccactagcaagtaaaacggggcacggattaacacataatttcaattatatattagttttttaagaaaatgaaaatagattaatatgaatttttaaagcaaacttttttatatttttttagaaaacttatcgtttagtatttcggaaagtattcgcgcggaaaactaaggaatataaattgccaacatggagcaagaatacaaatattgttgtttaggagagctgatggttaagggtgaaattagtttgatatctctagaaatttacatggttgaaaaaaaaaggtcatgcccaaacaaacgtaaagtagtacttcaaaatcctctatgaaccaatagagaagcttctagggatcttatggctagctcgacaggagatgtgtagtgttagccggtctaggttcgaaatctcactcattttattta

SEQ ID NO: 58983 - DNA, 5515 bp, Oryza sativa
aagataccaatgcgagttcatactcctggaggtggcatgaccacaactcactactgcccatcaatgacagttgaaattcaagggttgatttttccagccaacctcattcttcttgagtccaaggaccttgatgtcattcttggaatggattggttgacacggtacagaggagtgattgattgtgctagccgcaccatcaagttaaccaatgcgaaaggagaagtggtaaccttccagtctccagtgccgcagaagccagggatcagtttaaaccaggctgctggtgaagaacaagaggtagcagtggagaaaaccactaagaagttggaggatattcctatagtcagagagtatccagaggtttttccggatgatctgacaacaatgccaccaaaaagggatatcgagttccggattgacttggtacctagaactgcaccgatccacaagaggccttacagaatgagagccaacgagttggcggaagtcaagaaccaagttgatgaacagttacagaagggatacattcgcccgagcacgtcgccttggggtgctctagttatctttgtggaaaagaaagataaaaccaaaaggatgtgcgtcgactaccgcgcactcaatgaggtcactattaagaacaagtatccgttgccaagaattgatgatctgtttgatcagttgaaaggagctactgtgttctctaagatagacctacgatcaggctatcaccagttgaggatccgcgaagaggatattccaaagacagcattcatcgctcggtaagggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagagcatgagcagcatctccgactagtacttgaaaagttaaaagagcaccagctatatgccaagttcagcaagtgtgacttttggcttaaggaagttcagtttctcggtcacatcgtgaatgctcaaggagtagctgtggatccagcaaatgtggagtcagttaccaaatggaccccaccaaggacagtcactcaggttcagagtttcttatgacttgcgggctattaccgccgtttcattgagaacttctctaaaattgctaagccaatgacacagctattgaagaaggaagaaaaatttatctggtctgctgaatgcaataggagttttgaagaactcaaacgacggttggtgtctgcaccagtcttaatcctgcctgatcagacgaaagttttacaggtctattgtgatgcatctcgtcaggggctaggatgtgtgttgatgcaggatggcaaagtggtttcttatgcttcatggcagttgcgtcctcatgaaggcaactacccgacgcatgatctggaattggccgcagttgttcatgctttaaagatttggtggcactatctcatcggtaaccgttgtgaggtatatacagatcacaaaagtctaaagtacatcttcactcaacctgatttgaatctcagacagcgaagatggttagagctaatcaacgattatgatatgggaatacattatcatcccggcaaggctaatgtggttgcagatgccttgagcaggaagagctactgcaatgttgcatgggtagagcaactatgttgtgaggttcaatgtgatttggaacatctgaaccttggtatagttgagcacggattcgtggctgccctagaggcacaacccacactggtggagcaggttcgcatagctcaagcaagtgaccctaaaatagcagagctcaaaaagaacatgagagttggaaaagcccgaggttttgttgaggatgaacaaggaacaatctggatgggggaaagattgtgtgtacctgaaaacaaggagttaaaggacttgataatgacagaagctcatcaaactcagtattccattcatcctggcagtaccaagatgtaccaagacctcaaagaaaaattctggtgggtcaacatgagaagggaaatagctgaattcgtcgcactctgtgacgtttgccagcgagtaaaggcagaacaccaaaggccagcaggtttgctacagccacttcagattccagaatggaagtgggaagaaatcggaatggatttcattacgggtttgcccaggacgtcatcggggcatgattctatttgggtagttgttgatcgactcactaaagtggctcactgcattccggtgcatactacctactcagggaagaggttagcagaactttatctgacaagaatcatgtgtttacatggggtacctaagaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagatttaaattgaattatgacgcaataatgaattatttttgaaaaggaaaaagggaattattgcgtcagcgggctagggtttggtggaccgggcgcacgggcgacggttcacgcgaacggacggccgagatcgatccaatccaaaacggacggccgagatcgatcggtccacgaccggctcacggcggacgaccccgatgacgtcagcggtgacgtcaccgacagcggcagcggctcggcggagcggacggctcgggcggcgcacactcaccggcaaacggcggcgctaggacgcaaacggagggcaccaagatgtagaggacaacacggcgaactcaccggtgacctaaacggcggcggaagaccaacggacggcgacggcgacaaggaggaagcggcgggaaccttcgggtcgacgacggcgaagctgctccggtgatctccggcgacggcgaaggggcgaacgaggacggcgacgacttggcgagcacgacggtggtcttcccgagcgacggcgacggctgaaacgacggcggcgcacggctggagcggcggcggcgacggcgaagctagggcacacggcgctagagctcttccgacgacgagaggcgaaagcgaaggtggcgacgggtagaggagacaccggggatccttttaaaggggctcggagagcggcggcgaaggcccacggctgccggcgaagagaaggaaaggtcggggttcggaggaaagagaccgatccgattcgacctcgaatccacgaatttccaaagcgatttagaggatgattccaaaagagaaaaggtagaggagatcccgaagatcatttcccttctatcgatttcaccggatcgggaaagacgcgaccgaatttggaaggagacgacggcggcgcggcgctagggtttcgggcggcggccgacgcgaggaagacgacgactccgacaggcgggccccacctgtcagcggcagcgaactcgcgcgggcggctgcggctgcgaactgggccgacttgggccggggagagagagagagggtttttgggctgactttcggcccaaagacaaaagagacttttaaaaacctttttcaatttaaattattcatgaaatacaattccatttattaaaaatacttccttagctcaaataaatcccagaaaaatctaggaattatagaattaagcaaagtatttaatgaaattttatctggccccattttatattggaatttattaattaaaattagatcttctcttctaggctttttttaaaatcatttctaaaaattctaattaaacaacaatttatatattttgaatttttagggtgtgacaatcaaatactagaggatatgttgagagcctgtacgcttgactttggtggagcatgggacaaaagcttgccgtatgctgaattctcttacaataacagttaccaagctagtctgcagatggcaccgtttgaagcactgtatggatggaggtgtcgtactctgctcttctgggatcagacaggggaacgccagttgtttggtacataagttttaaatgaggcagaagagaaagtcagagctgtcagggaaagattgagaatcgcacaatgtcgacaaaaaagctatgtagacaaccgccgaagagagctcattttcgaaacagaggattatgtgtatctccgtgtcactccgctcaggggagtacatcacttccaaaccaaaggaaagttggcaccacgctttgtgggaccatacaggatcttggaacgtagaggtgaagttgcttaccagcttgagcttccctccaacatgcttggcatccacaatgtgttccacgtctctcagttgaagaaatgtttgagagttcctgaggaacaggcaagtccggatcaaatcgaaatccaaaaagacttgacgtatgtggagaagccgactcgtatcctcgaaactagcgagagaaggaccagaaacaaagtaatcagattctgcaaggttcagtggagtcatcactcagaagaagaggccacctaggaaagagaaaatgagttaaagaccgcccatccgcacctcttcaccaattcttccgaatctcggggtcgagattccgtttaagggggggtaggtttgtcacaccctgaagtttcccccccttttcttgctttaaaaaaattggttaaataaattgcccgaagaaattatcttaattaacctagagctaaatccctaattaataaatgcatttaataatcgaattcggcgtggtggaatttttcttgagttccccatgctccaatacattaacatgatttttagtggaaattttcagagccttggaaataattttaaccaattaaaattgagcaagtgcaatatttttagtcccaggaaaatcctttttctcttttttcttttcttttccctcctttttctttattgggccgtcggcctatccctctcccgcagccccttctccttgtgggccggcccaagccgcccctccctcctctctcgggacgccgacaggtgggccccacctatcggtcgtctcctacctccggccgttggagccggagctccaaccgccgctgccgccgaaaccgccacgccgccgccgtttcccgccttctccgctccacgtcgcgcctccactccgcgcccacacctcgcgc

SEQ ID NO: 58984 - DNA, 43799 bp, Oryza sativa
atatatatatatatatatatatatatatatatatatatatatatatatatatatatatatatatatatatatatatatagtgaaatcatatagtactttgcaacttaactaaatttatagttggttagggaaatcaatactttgcaaattaacttattatgtcaaaaccttcttaaaagcttacctagactaatagaccatatacaaaagttcttaaacaggatcaaaagttgcgcaagcgcgactacgtggctagtgttgttctttagaaatcccaagtaacctttcgagttatttttgcgaggtgaattgacatatcaaattgcacatatctttgaggaaatgctccaatggccctttaatccaggattaaagaaagtactttttaatgcttgagtagaaaccttaattaattgcagtatgaataattcaggttcttcattatcctactccctccgtttcaggttataagacgttcaactgcttcaagtttgaccaagtttgtagaaaacaataataatattttcaactcaacacaaatttattatgaaaatatattctattattgatttaatgaaactaatttggtattataaatattactatatttgtgcataaacttagtcagatttaaagtagtttaactttgaccaaaatcaaaacgtcttataacgtaaaacaaagggagtatataatactctttcttcattttttggaagaatgttgtggcctattctgtttgttattaattattcagtggttcaacaattgttaaatactatacaggctataccgtctttagattaaagttgatgcatctatatgaattgcctaccaattgtttttcatacattttagaggaattgccagatatatgaaccttttgctagcttcctataagtggaatattcaataatcaaactcagataaaacctacagtgaacatgacatagcaacacaatatttattgcataaattatgccaagttactcttaacatcttgttaggtagcaattgggttaacatatctctgcactactggtatttgcatggctttccttggaagatgaggaaagtgatgatgcggtgtgtagaaccaagcgtggtgaaggatgtggaggacacagtcaagttccttgtttccaggtgaggtctaataggatattttcaactgaacattcatccagaattattggaggaacctcactgaaacgctgataattaagaacttcatgtaaaaaaaagaatttgagggaaataatcttccattttgctgtgcaaaaatgtaagctttttattctggtaagcatggtttgtgtgttagtgatatgccctagaggcaatcatagagataattgtatcacacactatgtttacatatttatccgacttcattccttgaaatagataaactcattattggttaatgaatatgtgattctttcatgagactctttatgttgtgtgttgctatttctaaaggatccctgatcaaatatcatatgtggaacaaatatgatgattagcatatgtattaattgatgatcatgtctcatggatcatggtatagagataccaaattaataatgtggacacatgttagtgaacatgttgttggatagacccaacatgagacactgcaaaagccgtatgtgttgtgtcatcagtgatcttatttagtgttggtgttgaatccttagacctgagattatgatggttcccaacatgtgtagtagcttacttaaggactgctaaacgctactccgtaattgggtagttataaaagtagttttcgggtatgctatgaaacatgtagtgggatatgaataattaagatgggatttgcccctcctatggagagatatctctaggcccctcggtgttgtagattatagaagtgcatggccatgctaaaggtgattgaggagacaattacaagttatataatctatcaacaggttcgagtgaatgattgagctattagaggatggcacatatctagccttgagcttaatcgatatcgtgaggcaaaggggttcatacaagtatacactagaggttcagccgatatgatctttgtgtatgcccagtgggtaaatacgttctgctaggggccgttgttgacacgtggacagaaaaggagttttcgggttacagccgagtgtacatgaacctacagggtcgcacgcttaatgggccggaataaggggattggatggagatccaatatgagcttaattcggatagggatccgaataggagtcctacgggccttggaggctcgagtgatggatcctatatattcgtgaggggtgtgaccgacgaaggtattacatcacatgagaaaccctagccgtcacttccctccccgagcaaaaccctagccacgcgcgggtgctagcacatctgtgcgtggcgttccgtccctgtacgtgtggataccagtagaggcgccgctggtttgcagtgctgatcgacgtgggagtacggcgagaagaacgcacggggaggagaaggtcgagccggtgcaatcaactacttcctctacatcgacacgtgctacttcgcgagagttccttcgacttctcagtgtcttcttccgcagcgcgtcgagtgataacgatctatgatctaatacttgcatggttcctggtttacgcgatagaaaattttgatttatgctatcgtagcctacgcgtaacccaacattgtgcactaaggaaagagttggaaaatatcgtgtgcagcattttgtgcgtatgcaagtagttgaagaattccaccaagttctgctattgtgctattgtacagtaactattgtgctattgtacagtaactatagaagaatggaacttagttcaaatttaggggatatatgctaataaaagtacaagggaatgatgtgcattcaatttgatatagttcatatgaatttcactttcttgaaaatattgagttttggttttacttgttaagccttcatcaaaatgcagaaaacacaggatcaaactaatctaaatcaacatctctccttcaagttttctaatgtcagggtggcctttccttttctgaatgctgtaaatacaactgtttccctctccgatgatctgtttgttttctacatgcttgcataaattgctctgcttgatcaagggaaaatcaccacaaccagcaggtgttgtttgaaaagtttagcctaggttttggtaaattgaaatttaccatgttactatgacatgtacgagaatttaggaatatgaaattatatttggggccaaatatattacaacgatatactatatatcattgtttggttttttgggttttgagacatttgaacttaatttgctaaaatatgtatcttttagcatttgattgtttaattcgcattactaaatatcgatgtagtgttagcatgggcatattagtcttttaagtattcattgggactgtataacaaaaatggttgttttgcctagcacactgtagttgcaagtgatgttttgttgtgcacaagtttcgacgagaaagatgtatcatatttttctcctgtacttttgcataatctctactattttaaaaattaaagatgtttttgccggtactttagtacgtcatccgtgcatttgtcggtttttaagtttgttcgtttttggaaatacatatccgtatttgagttagttttgaagttcattcgcttttggaaatacataatgaatcatctacaatatctcttaaaaaaacttacatgctaacttgaaacgattagactgctaattgcagctcatgattttcttaaaaaaaatccaaacgagttctgatttcaccttaactaaacgtataacaataataaagctaaaattgccttcacccgttgtaatgcacaaattgctttcacccgttgtaacgcacgtgcattttttctagtttaattataaagtcaaaagtcattgtgttcacaaactgttagttatgcatatattattgtttgctattatggtatttacatatacggtcctattttttagagggcttttacagtacctcccactggtactagtagtgtagtaaaaatcaaatccaacccttgattgtaaaatgtgtttttcagttttactctaataaggtggaaggatattttgataatttattactagcctcccacgcgaggcaagacgactgatctcgttctgctcaactccccgttctcaggaccgccgccgcctgatgactgacgtccaccttcgcctctctcctcaactcctcctcgcggctcaagtaaccacgggcacggcggcgccgcccctccacctccctacgcgctcaacagccagcgcccctccttgtgcgaaccgatctacggcggcaatgcccatcctcctctacgcgcgtgcgacgaccgccgcttctccttgcatgaatcctcgctcgtggtctgtggaggcagcgctcctcttctgtgcactgtgctctcaatctcctgcactgcattcgagacgtcaactcagctgccatgccgccagcacctaagtactgaaggaggaactttggccttccatgattcctgcagagaaattcagtcttgcctactccagagaaatgatcgatgtttcaccaagctattttcttatcgtactcgtttctaccatattaactcccatataggacttggaagaactgatacaaggctgttaatttgctttactggaacaattcactgttaagccattggggagaatgttgaacagagaagggagctttgtacttgtagtacagaaactctaatgcccttctctaatatttgtacatcattatagttttttttaaaatacaaacgcagacgttcacaaacaacataacatatagttttcccttcatatgtctacctgctccttttgaatcatttttgttttcgcctcccattctctttctcttctagttatttttattcgggtcacaaaccgatcgagattgcaagtgtctaaagcagcaaatctaatgtaacagaccacactacctacatgtggctcttccatgtggcacatgcatggcatctgaactgattaaattgtactactgaattaacatgttgagcctgaatctgaactacgtaccttcctactgaacgctagatcaaccctggcaactaaccaaaatcatatcatggggaaagaaacaagtcagtacatgtacagcaccggtggttatttgtctcatttttggctaagcacgcccatttctcgaggcagattcctgtggcagcaaagacactagctccaaagaaaggaagagagatctctcactatatttattattatcagaacaagatattatttaacatgttcagaaatatccacaatttacatgcacagctagctccttgcatgtgtcctggtctatcctgtaggtcagttggatcagatccaccagaaagaatgtaccaaacatggtccggcccctgatcttggtctcgttaaggataattatgcatcaatgtctgctgcgtacatgtaatatgtaccatgcgattgcatcattgcgatttgattcttttctacgctccagttgtacccacaagtggatctatatatgtatgatcgatacgtctctgtcaaggagcgctgatccattttatcatgtagcccatgcaactagctacaacctagtgatcgatgagattgttttgtgttccatggtcggctatgcgatactgttagattagattctttcccccgtgctctacagagcatgtaatttaaggatcaactacagctgcaaacttcatgggaactatggctgctatttgtgcaacaacatgatatctgcactgtattatacctaactgtgtttttctatgataagagctacgaaaaatcatactaaccattaatgtatacattttattaataaattacagcctaaaaaacaagtgattatatatacttttttttatccttctaattaaatttaatcaagaatgttaatcttgccaaaaggtgaaagaaacgcccattcagaaattgggggacctatttgtcaatttatattcaaatgttaacaaatttagtccaaattcaattctattcaaactaaatttgaaaaaaaaatgaacttgaaacaaggttgtattttcaagtctcaaattgttatatgtgaaagaaaaattaagagtaaatttcccattgaaactacatgaattttgaccaaattttgtaaaactacagatttaagacgttgtatcacaaaccatagatttaacacaagatttatcacaaaactacatatttaaggccaaatatcacaaaactatagatttagtactatagttatcacaacactatagattttacaatttcaatccttaccaccagtgttatgttagagttataaatgttgtaattttgcacttaacatgcatggtgtaaaacatgtagttttgtgataattttaaaactatatatgtagtttggtgatagttcatcttaaaattgtagttctttgataaaattggttctaaatctgtagttgatacaccttcttaaatatgtagttttgttataattttatcaaagtatatgtagttttatgaaatttactcaaaaattaaatataacttaaaatttcaaagttatttcaaaattttggtttgaaaatggaagtagaatagcatttcaattagtctatttattaaaatttcactcgaaatttgaactagcagatatttttttcttggtattaatagctatgtgtggactaattattgacaataatagactttaaatgataagaaatgaaatcttgtcactcaataggccgggaggtaagagaaatattaagccttggataacatctgtttcctattctagcctccgatatccgaatatgattgaaaaggtacgatgattgatgaatgttcaatggttccatagatgtttttcacccacccatggatacgcaataagccgtcctagcataatggagttcacaaggatttggtgtaactctagaaaattccaaattatgatatacatcaacactacgtgttggcggttttgtcggtttttggttggccaggttttctctagtgatgtagcaatggactaggctgagtggcggggcatcgtgccaatgagcagagggtgggcggctggcagcatgatgacgacggtagcggttgaggaggcaggatttcacagcgcaacaacgaagatggtggcggtggcagggatagtgcttccaatggtgatggccctagcggtggtgactactagttcgggtgcccctacacccaaatcaggctgtgtgacaacaagtgtaaccattgaggcaatagtgctttctagcgtggcatcgtggatggtggtggtgatggctctagggatagtgcctaccagatcgtgggcttccgtgtccagatccagccgtgtggattggaggcaagctcaaaggcagtgatttgacagtacaatgacgaattcaatggcggtgttacgacaatcgaggtgggtgaacccaacatccttttggtgagcaaggtgaggagtggaacgaagagattgacgtaggtgccagcgatagtagcggttagaccgcgacgctagatccagggcctaagtgcccctagatcggatgtgtttgtgccaggatccgttcatgcaacggtcaagggcaatggctcttctctgcctttcgtggatggcgttggcgagcgaaggcactagggggttgggagctatccggtttgtcaaatggatgtggtcgtcagtaggggcagttggacgaagcaggaatcagttgaaggtggatggatcgctaatctatctatctatctatctataataattatctacgagctctcacgttaatcagaaaaaatctgactgttaattagaaggatcgtattatacaaccgtatatctttaatccaacatgtgtttaatataaattattgtaggccaattctaaagcccaaatctgttgtgcgtcatgtacgtatatcttatcgtctccctacgttttttatccaatctccagtcacgctacctacactatacaagttgcttctttcacgataaaagtaggacgtgtctacaacgagaccgttctctgtatggtcataaccagctacctcaatctatctagttgctactagtatactcaaaagtgtatgtatttttttcttcttatagaattttttcttagattactcatccgatttacgatccgattacaccattgtgttcataacaattagatctttataacaagatctcacatgactatatttttatgaaaaaatacaaattacttttataatacatctaaattacttttagattttattaaattacttcttagtcataaaagtaatttaataaagcttaaaattaatttacctatattatagaagtaacttaaaacaaaagtaaagtaacttgttacggcattaaaagaaatctatacattcataatgttattcataatattgtgagttgtttattttataatcatttttagtcagtgacgtaatttgtgcttattaaatttaatttctatatagactcatgtttttacctctataacggatttagttttgatgtcgtgataaagttactttttctttttgttttaagttacttttataatttatgtaaattacttttagactttactaaatttacttttatatgtctaagaagtaatttagtgaaatctaaaagtaatttagatatattataaaaataatttataatttttcatcaaagtataatcatgtgagatcttgttataaagatttaattgttacgaacacaacggcgcaatcggaccacagatcggataagtagtttaagagaaaatttaatttgaagtataggtggttcctatttgcttgaaacacagggataaactactctctctctagcgtaacagagtgcgtcacgtggcttccgattcggtctgttctggccttctcggcaatatcggcatgtggaatagacgactacaccagcgtgtgggatcggacggccctagatgcgtcgcgtgataggaccagatcgagaggcctctcgagatagattttacgataaaagtaataacatatacctgataaatggtatcttagttagtttccaccgttatcatagctggtagaaaccatatgctgttgatggattggccatatttgcatttggagtactggaaagggattcacgtacattggctggtagtttatacgatctggatcgaggtcgtcaaccatgcatacgatgatccggccatctggagacttcacgcggccgatacacgtgtggtgtgggacttcgtcagagacgagagccgctgcagcgaaattcatcccgatttgcagacatgtgtgacttgaagaatgaagatcctacaattcaagtgctattcctttttctcaatcaaggcatcatctaaaacaaccttgatcgggggatttgcaattatgacactgtaaacattaacctttgctataatgacattggacctatatttcatagacacagatggacccatttatcattcactcagagtgtcaaaacaacgaagccctcatgtttgcagttccaattttgcaattttctcacctttgatcaggaatagctacgtacgtcttggtttctatttcgcaaacaagattggtttctaattaacgcggttattcctcatctaaaacgactacaccaagcagaagtacggcttatccgcttatgctatatcatttgacacaaaaacatccagtgtttggatgttcatccactaatccagttcttctgcacctaaactgacccagtaaatttcaggtgtttattagatgttcatccactaatcagaaagttcttttgcacagtaactcagaagattcgtacgtgatttcaagcacaaactaaaataagttcttagggacagccataaaatttatattaaataaaacacaactctatagactaattaatttttttaccttaatataaaagcaagaaatcaaactgaggtacagtagattctataatttttgaattattgaaactaataaatgagactctaaaccgaatatggcttcatgtttattaattatgaattttggaattattaaactgtaacaagctataatagacattctcgaagccaaatacatatagtttggtacttatcaattttaatttttactattttaaaccgtgaactataaatataatagaatttgtttaacatttgaacttcaaaaaaatttttacatgtactttcagcaatatttagtaacaacatatttaagatgtaattaaatttgtgctattcataatatatccacaatttaattctaaatttcgtaattattaaattatgaaacatactacattgaatctccaacacaacacaaatagataaaataattattaatttcacaactccaaaatataaaataaataggaaacaacataatatattaagtatggattcttaatttctgtcaaaatagcgatggattctaaatttcagtgaaaaagggattgattctgaatttcagtcataaaaaatgggatgggttcttcatatagtatttcatttaattgtcaattttaaaactaataattatcgagtagtaactgaagttgactgttattttgatctattacttcctttttatatgacatttaatagttcaaaaaggaactaaccaatataatttaaaaaaaggagtaatcaactataatttgaatgtaaccaacgtattcaacatttgtctcaaattttaataaacttttatattattgacactaataaccatccaaagcacgtgtattataatattattgttaacacaccatgaaacgcgtgggttggcgtctagtgaaaggctaaaaggtggttgggctgctccctggatcaccacggtttgttggagcggtgaagcaagaattggatgtagttttgaagcttaatcttctaactttatttctttgtttttcttttattgttcgttggttacgagacttggagtcatgctgtaacttttggctgcagtatatccacttatggatatacatgtcaaatttttatctattattgtaagaaaataatgattgttggcgaaacgacaaccgcatacgtcgaaagacgtggtcactcaacagtggttgggaaagaagtaaagtgtattaattagagaatttttcttcgggatcccccattacatggccctatgagactatttatagcccctattacaggttcttactactagggttttggttatacaggggaatttacatggttacccttatgaaaagggaaatttacatgggtacatagtgtaattgaggttcatgggctcctgatgggccgtcgggcgatcgtcggcccaatagcccctaggcttgatgggccgaaaaggcttcttcagccctcgcgggggcgagcttgctttggcaaagtcatctccctttggcatatactcttcgcgctgcatccttcgcccaagaggcctctggcttggcagagtacccgtgcgatccctcggctctcgctgtccttgttccatagtcttcgccatggggggacttcgccccgactaactttgacgtctcgggcttgaatccccactcttcgcatagctttcggcagattttggtcgaatggcctcatgccataccgccaacaagctcctcacgggcaagggtgagattggagcttcggccgagaccgtgcaaaccatgtggtatggtgtgtggcgccccctttcgatcgatgctcctgccgaaacctacattgttcctgcaaataaagtttgttgtctgtgtggctggtattgttttgccactcttcgcctcctgcggacggtggtatattatttttatctttcccgggccaaaaggaaacagtaatgggccttccctttgtgggctttttactttgcagctcggtcgatgggaatttaccgttttgcctaccctcgcgacacgtggcgctttattactggtgggtaggcgaaccgttgcttcggtgggctatatattctccccccgttctcttttcaccgccagacttgtcactttcaccgctcgtgctctcttcctccgttcttgctctcacggtaccccttggcccttcagacctttcgctcgctccctttgttcgccactgcacacaccattcaccactgcatatgtccttcgtcatggctccccgcaagcctaaccccttttcggtgaaagggcccgaccccggccggattgacgatgacaccaccgcctatttagggatttctctcatagatgacggcgagcaggagaagttggtcagctctgggacgttagtcgagggacagactttcgccctggggaaagccgttgtaccgaagcccgtcgacaaccggacggtggtgttcgccgtgttttttgaggcggggctccggttttcgtgcaacgcgttgttgccggagatccttcgccttttccaggtggagctcccacagttgagcccgtcggcgctggtccggatcgctatcttcgactaggcgtgttggacttccggttttgagcctagcgccgaactttttggcgccatatttttcgccatcgtgaattcgaagacagtggttacccctgctgggacgaagaaaacagtgttcgggagcgtgaactttaatgttcgccccgagcggtccgatctctggccagtgaatgccgccatgtcgaagtgggaccgccattggatggcgaggtggttttaccacaccatctccttcgaggctggttctaactcagcgaaggccctccggtgccagcgcagggcgattgcgccgaaccaaaaacccaatatcgccgtggacggcgctatggaggcgcggttcgctctgctgcgtaaggtttgctcctgccttagctgtcgcgacttggtggaggaattctgcatgcttcacatctttcccctctctcaatcatggcaagtcgcagttgatcaaggcaaagaggttgatggtttgccgaagttggttctccccgagggaacgaatggtaagagtgctctttcactacgcactcctgcgctttgctattttgatttgttcgacgcttgatgtggctacacccgttatttttgcagtgttgaccctcgaccaggctgacgccgaagcccgtaggatgatcggcgatgtgtcagtcgtcgagtatagccagctgctgatgtgacaagcagctggccgagcgaaccgggtttacaacggcgaattgcctccccgggcgaacccccacaaggcggacgacgatgcaggaccttcgcgaaagcgaacgcgcgggcaagtgaagcttgtccctaggaagcgaagggttcctgcttcctccgattccgacgccgacgatgaggaggacgtcgaagagcgtgacggcgaggaggaaggagaggaagaagaggagacggaggtcgtggctgacaaggccgcggacgagacggtcgaaaaccgcgtcgacacccctggctacactcctactccaagtccaggtcacaacgagaccggggtggagtcgaacagctccccccttcgtcgaaaggatttggatggggcgaaggcgctaattgcgttttcggcaggcagggcggcgaagggaggtccggtcaaaaagatctccaaaaagaaaggacttgtcgatgtcgctcgtgtcttcaacgatgacgagtcttctgacgagactccgacttcgcccgctagccgcagcctggacctttcaaccgtccccattcttttcctcggcgctggtggggcaggcgatagtgccgccgccggggcttcagcctctgcggaatggatcgtgacagctgcggcgagggtcttcggtagccctctgcgtcagccggttgtttcgccgctagtcaaagcgaaggggaagggtgcggccgtcgaaacatctgcctcggagtattcccttgtggcgccccattttgcccctggcgatttcgagacccgagcagagcttattctctttgttgagggagtaagcaatcttgtcttacctgctagcaccccgagcctattcaccgaattgaatgagttcgatgaagggtgttctgctattagaagcttggcggttcgggtatgctttttctctcttcttgattttcttcttattttttacatgtcacataattaacatttgttctctttacccgttcctaccttgcatccagattcttgcagctcactgttcgacagagcgaaccgtgcgggcccatcttgacggattcaagaaccatcttcgggccaaggatgacgaaataggccgcaagaacttggagatggaggccctcgccaacaccctgaaagaggcgaaagccgaaaacaagcggctccaatccgagttggagaaaggaaaagaagctagggccgaggtcgatcggctcaaggctgaactggagaaagggagagaggccatagctgaggttgatcgtctccaggccgaattgaagaaagaaaaagcccattccgccgtgctgacagattattttaatcttactgagccgaagattgaggctcttcgcctggaggtcagctgtggaggagtcgcagcggttttcgcgggagatggcgaaaactaccgaatccgcgagaatggcgtgccgaacgcttcgcctcgcccttactgacatgggtgcaaagatgcgaggggtccctgccgaagttgcctcggccttcgacttctccgagtggacccagcagaccggtggttcggtttcggactgcgccactgcgtacggcgattgctgtgcgtgcgtatcggcggcctttactacgggccatctacaacagttcggctatgaacacgtcgccgagttccctaactatgcgaagggggactgggagatcagtgcgcagaacatttcgcccgcgctttgtgcgtggctaaaacagatatggcagaaagacggccggtccaccgccaaggcacgccttttggagcaactggcgaaggcagaggcggcagaccggtgcgaagaagaggacgcggcagccgaagggggtggaggcgatgcccaggatcacccagaggtgtgaggccctccgccccttccttagatttttgtagtttcccttcttctttttgtgtttgccgggaatggcgaatgatgtatattcggcaggctgccgctaatcctccctattgtagccgaaaaaagggcccattggatattttgaatatatgactcactcttagccacttttttgtggtcgaagtctttggcgtatttatgattatgcacatttcacattatgcaatacttttttcgcctattctcactatgcaattcgtcttttgccctttttgcactgtctaccagggtgttcgccgaaagttgtgcattcggcccccttctgggagttggcgaaaccaaaacgagaaattctaaaatcaaaggtgtttttgattattattctatgatgaacaattgggcattggagattattggttttgttatttggaatttattcacggagtggttttggagatgattggattcataggtgatcgcaggattcattatttcatgtgaccggtcagactgggctctggtagctggtcggactggcggtatgcgcgcggtcagactggccagcccgtgctctgaccggccgacactgtgttggtttcggtttcgggttgtttgtttggacatccgtgattattttatgattatgacttctagatggatactatacgtatgtaatactgttgtttgctactaatgagtcaagttggagatagcttggtctcggaatatggtttctttgtttgttccatgtgtaggtgactcgatgtctcgggatagtatttgtggtgatggaccgggagtcggcttggggataagacgacgtccgtggtggtcagagatcatgcgggatacttaggctagagttgatgcacgtgattgatggatattccatatggcatacgatggagttattgtatgcgtatgggatgcggagtcaaatttggtatgattggttatgtaaagtttctttcttgtactagagggtttcctaaggtgtttaggactcttagtataagtttggttcgtggctttaggctgcctacctcatgtataaatagagagggagcgtgaggcttccctgtatcgctttggagagcaattgagttgagttttgagttagggtttcgagtttagtcagaatttttgtaaggagtgctgttggtgcactttgtaaacatagagagaatcaataaagtcatcatttactttaagatttcttcgatttgtgtttaccgggtttcggcggtcagaccggcgggagcacggcggtcagaccggcggcggcgacacagcgagcagcagctgatctcggcggtcggaccggagatataatcgcggtcagaccgacggcaaccaggctgtcagaccggcaggacaacttcggtctgaccgcgatccgtcgatttcgagggtaacttttattttcgcttaaagttttcggtttttgggtataccaaccattcaccccccctctagttggcttagttcttgtgattcgatcctacaagtggtttcaaagccttgttttcttctttggatttttatcgatccaaagtttttgccatggctactcctgctaggttttcaactaagcctcatgtttttgatggaacggatttttctcattggtgtagtaggatgtaatcttatattatggctgaagattatgatatttggagaaaagtttctcatccttatgtgattcttgaagctattaatactgctgctgaaaaaactgcttttgaacaaaattgcaaagctcgcaatattcttttgagtggtatttctcgttcagattatgatcgtgttgctcatcttcaaactgctcaggagatttggagtgctttgagtaattttcatcaaggaacaaataatattaaagaacttcgtcgtgatcttttcaaaaaggagtatattaaatttgagatgaaacctggagaagctttggatgactatctttctcggtttaataaaattttgagtgatcgtagatctgttgattcttcttatgatgctaattatccacaatctgagatttctcgccactttttgaatggtcttgacatatctatttgggagatgaaagttacatctattcacgaatctattaacacgtctactttgactttggattcactttatacaaaattgaaaacacatgagatgaatgttctttctcgaaaagttgattctaagtcgagtgctttagtttcctctttggatgttgatgcttcttcatctaagtcttcttttcttgctgtttttaatgccacatccgatgatcaactcgaacaaatcgaggaggaggatttggctttggtttcttatttgaaaaattctttgctaagattttctgatggtaaaaagaacctcaacatgattttggatcaatcagagattagcacacataaccgtggtttaggttttaatccttatgctcacaattttagacatcctcctgttgtgttaggtgttggtgctagaagtggcaagattttggttaaacttgatactaacaaaactgtgcttaaatctgttggtgtcatatctaatatgaatgcatcttcttcaaaatccaatgttgtgcatgcaaaatctcatgttgttgctcatgttgataaatctactagtgctaccaatgtgtctaatcatcgtgaaaaatatacttgttctttttgtggcaaagatggacatattgttggtttttgtttcagattagttcataaacagaaaaaggagagagagagattgcctttgcaaaatcaaagtggcaaaaatctggttttcccttgaggaaaccggtctgaccgcagtgggtcccgcggtcggaccggcgaccggtcagaccggctgaacagcctcggtcagaccgaccaccggtcagaccggctacacaccctcggtcataccggcctcggaggaatttttctgtaaattctaaaattgattttgcacgtggatatatgcctattggatcttctggtcgtgtgcctcagtactgacgcttcgacttctgcttgtgtgtaggctttggtggcaaggaaggagaatgtgtggatcgtggattccggttgttcgcgacacatcaccggtgataaaaattggttctcctccctaaagaaggcagctaagattgaatcgattatctttggtgatgctgctacaagtgccgttctcgctacaggtttggttaaggtaaatgaaaaatttgaattgaagaatgtagctttggttcaggacttaaagtacaatttgctttcagtttcacaaattattgatgaaaatttttgaggttcactttaagaaaactggaagtaaagtttttgattcttgtggtgattctgtgttgattatttctcgctatggaagagtgtttaaagctgattttgaaaatcctatttcacctatgataacatgtttggttgctaagtttgataaagatgtgatgttttggcatcgtagacttggacttgttggttttgatcatcttactaggttaagtggtttggatcttgttcgtggtttgcctaaacttaagaaagatcttgatttggtttgtacaccgtgtcgtcatgctaagatggtttctacttcacatgctcctattgtttctgtgatgacggatgcaccgagacagctattacatatggacactgttggtccagctagagtgcaatctgttggaggaaagtggtatgtgttggttattgttgacgatttttctagatattcttggcttttctttatggcaactaaggacgaagcttttcaacactttcgtggtttgtttcttcgattggagcttgaatttcctggttctttgaaaagaattcgaagtgataatggtggtgagtttaaaaatgcttcgtttgaacaattttgcaatgaaagaggtcttgaacatgaattttcttctcctcatgttcctcaacaaaaaggtgttgttgaaaggaaaaaccgtgttttggttgagatggctagaacgatgttggatgaatataaaactcctagaaaattttgggctgaggcgattaacactgcttgttatatttcaaatcgggttttcttgagatcaaaacttggaaaaacttcttatgaacttcgatttggacatcaacccaaagtttcacatttgcgtgtttttggttgcaagtgctttgtcttgaaatctggaaatttggatgagtttgaggcacgttctaccgatggattgtttcttggttaacccgcacatactcgtggctatcgtgtacttgttttggagaccaacaaagtttcttttgatgaggctagttcaggtactagacccgatattgcaggtacactctcacaggtttagggggaggatggtcatatttttgaagacgagagcgacgacaacgaccacgacgaggtcagctcggccggtcagactgggtgccaggccggtcggactgccggcacacctccggtcagaccgacccatgaggagcggtcagactggccagggtcgtcgggttcgggtactgttgatgctgttcgagatggtcctccagagattacaacttcgaccagtactgatacagaacgtggatcaacttcagaagtcgctgctcctttgcacatttagcgacgacatccgccggaacaaatcattggtaatataggtgagcggactacaaggtctaaggtaacggctcatgatgtttgtgcaaattctgcttttgttgcttcttttgaacccaaagatgtgtcacatgcattaactgatgaatcgtggattaatgccatgcatgaagaacttgaaaattttgagagaaacaaagtttggactttagttgaaccatgtcacaccctaaaaatcccaaatatataaattgttgtctaaattggaattattagaatttattttaaaagcctagaagagaagatctagttttaattaataaattccaatataaaatggggccagataaaatttcattaaatactttgcttaaaatttcattaaatactttgcttaattctataattgctagatttttctgggatttatttgagctaaggaagtatttttaataaatggaattgcatttcatgaataatttaaattggaaaaggttttaaattttctcttttggctttgggccgaaagtcggcccaaaaccttccctctctctctcctcttcggctcagtcagcccgcgcgcgcgctcggccgctgacaggtgggtcccacctgtcggactcgtcgtcctcctcgcgtcgaaaccctagccgcgccgcgccgccgccgtctccttccaaattcggccacccctttccttttccggtgaaatcaatagaggggaaatgatcttcggaatctcctctaccttttctcttttggaatcgtcggctaaaatcgtttggaaatccgtggattcgagtttgattcgaatcgatctctctcctccgaaccctagactttccttcgcgtcgccggtcgccgtgggccttcgccgccgcctcctaacccctataaattgacccccaagcccgccgctacccgccgccaccctcgccttcgcctctcgtcgccggtagagccctagcgccgtgtagcctagcgccgccatcgccgtcgttcgtccagccgtgcgccgccgccactccggtcgtcatcgtcgctcggggatgtcaccatcgtgatcgccaagccgtcaccaacctcatccgcccctccgtaggtcgccggagcaccgccgtcgtcgtcaggccgaaggtcgccgctgcttcttcctcgacgccatcgccgtccgttgatcttccgccgccgttttggtcaccggtgagttcgccgcgtcgccctctacgtgttggttccctccgttcgcgctgtcatgccatcgttcgccggcgagcatgcatgcccgagccgccgccggtggtggcgtcatcgccgacgtcatcgttgccatctgtcgtaggccgctcgtggaccgatagatctcggccgttcgtttttggatggatcggtctcggccgttcgtttccgtgagccgtcgccgtgcacccggtccatcgcgaaccctagctgctgacgcaataattcccttttccttttcaaaaataattcattattgcgtcataattcaattaaaatccatataagtgttttaatccgatttaatctttaaaaattcataactaattcatcttagctcggatatagttggttgaagtctctaaatttttctaaaattgagatctacatgttaaaaatatccacatgtactgttcatgcttgtttatgtgctgttttggtgattttgctcttttctctttagattccgacgttttcggagagtctgagtttgcaggagaagaatttgaagagtcccaaggctagcaaggcaagtcacacagatcccaaacaaccctttgagcatgttgatcccatttaaagctattgtttctattcaactattgcatttattttcgaatgtcattgggtggaattaacctattatttgttatggcacttttgttcttgattactttattccttgataccttgggatattgtaacttgactagttgagctttatatattggttcaactagatattagatatgattgcttagccatgcttagaaactttagcacactattgggataacttatgactcactattatttaatgatggcttaatgatagttcacgatggtcaatcgtgattggttaattaattaaattgccaactaaaacctgattaaaggtgggttgtgagcacatggttttgttggtcgttctcatgacaattaaggatcggttcacgagtttcggttgtgagacattaaccgtgccaaccacaagccagcgtgggcaacggctttaccttttgtataacatggttcattgcggggcaccagactaagaagtggcggaggtaagcccacgggggttgctggggagtccatgccttgtttataagggggtgattatgatccaggaacggtgcgctgtggtggattgtgttgtgtgaggggtactgtcacagctcctttccgaggtaccgtggtggtattgaggcacatggtgacatgttgtggggctgtgtcttgtgggtatagtggtacacctctggccagagtaaaactattcgaatagccgtgcccgcggttataggcgggtctaacaatgtctttcgtgattagtctcacacttctcatcataataaaagatgctataattggtaataatttgattagctcctggtttggaatggttaattcctggtttggagatagaactgtgcagccgggatggttgttcagaatggttgggcctatgcaatagggtatgttgtatagcgttggattaatattgtttaattattacttaactgttttaataaattctgaaatgtttattaaatgttgtttatgcaaatgaaaccctactatgccatcctttgttatcctgtgcacttgcatatttgctgcgtggcttgctgagtatgtcatatactcaccttgcaatcattcttcagaggaggagttctacagtgatgctgatggtgtggaggattaggtgtagccctggtcaagctgcctgtggagtagagtcgtctgcgccgtttatcttatttttccgctgcttagatctttattgattgagaggaactatctacctctgtaatgacattttattcgcttattaattagagtaataattgttctctattattgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcattaagaagaaatttgcagcggaaaataaaatctagcgaagctccggctccactcccacaggcagctcaactggggtataagccaaacgtcttctccttctggatcctttttcttcaactgaggttgattgattattgcaaggatgagcatataacatactcaacaagccacacagcaaatatacaagtgcacaagcataatataggttcatttgcaaaagcagcatttagcaaaacttttaagagaagtaaaaacagtggagtaattaatcagaaattttaatcaacactgaacagcacacccatgctgcacaggcccaaccagctaaacaaattattaccaggtataacatccataattattgtgagaggtgtgggactaatcatgaaaaacattgctcaacccgcccataaccgcgggcacggctattcgaatagttttactctggccagaggtgtaccactgtacccacaagacacagcctcaacatcatgtctaccatgcgtcgcgatagtggaaagtacccgaatagaggctgtgacaataccctctgcacaacacaactcaccacagtgcaccattcctggatcataatcacctcctcaataaccagaggcatggactccccagcgacccccgtgggcttatctccgccacttctcagtctggtgctccgcaatgaaccatgctgtacaaaaggtaaagccgttgcccacgctggcttgtggttggcacgattaatgtttcacaatagtagctcgcgaaccggtccttaattgtcatgagcacaactctcaaaaccatgtgctcacaacccaccattatcaatttttagttggcaagtaattaattaaccaatcacgattaaccatcgtggactatcattaaaccatccttaaataatagtgaataataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcacgacgcactcacgaaccttcgcaacgacggaaacgacaagctaacacgcaaaacgaaaaaaaagaataataaaaaccaaataaacaatacataaaaagtaaacaaacatgtagatcataattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccatgatggcgacctcgccggagattggatggtcggctgcgactttggaggacatgtacacgtagaggacgacgagacgaacccaaaggtactcaccctcgaaccaaacgacgaacgacgacggccggcgacgaggtctagcggcggcgcggcttcggtcgacggcggcgacggggctccggtgaccggcgacagcggggagggagcggccgagcttgcccacacctcggcgcaccttacagcggtgacggcgaccgacggcaacggcggaggcgacggcgcgacacggccgaagttcggccggcggcggcggcgaacttggcggcggcggcggagaggctatggggcacgggagaccacgggagaggggcaaacgaaagaggaagactagggggtcctatttatatccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaacaaaattggaaaaaaggagcaacggggaggcgagattggtgggaggaggcggcggcactgtgcacgggctggagagctcgggctctgtctggaggtagaagaaggagcactgtagcgacagggacgaaaaacagacttctatgcgggctgagaggaagggagagagaaggggaggcaaattagacttttcgtgttgggctggctgaaaacaaagcaaagaaagaaagagaagggggaagctcggctgggccgacttgggctgtacggccgagcacacaaaagagggagatgggctggaaagggcccaagactaggaagaggattattattacttttcgaattaaattaatcaatgaaatgatctttgaattgttaaaaatacttccaatgcccaaataatttcaagaaaaatcctgaaaatacttggactcaaagtacttaacaaaattataattagaccatttaatgattaatttaatatgtgggtaattactgaaatgctctttgtatgattaaaattaggaattgagcttcgaaaaatctgagaaaattccagagagtataattaaccatggagaatttaataaaaattaaatccatccatgctttatatttaggaaattttatttcccacatttaacttcacttgtaaattaaagatcatttaatataaattctaataataatttattaaataatttataaatcctgaaacgaaaatcaggatgtgacaattatcaatttgttattgtgtgcctcggctgattcctggacgagggttcacacatatgtaagcgtttggaattttggatagaaattccgggcgtgacaaaccaccttctggacataatattattggaaccaagtgggttttcaaaaataaacaaaatgatgatggtttgattgtgagaaataaagctagacttgttgctcaaggtttggattttgatgaaacttttgctcctgttgctagaattgaggcaattacacttttgttggcttttgctacttcaaaaggttttaaattgtatcaattggatgtgaaaagtgcttttctaaatggttttatacaggaagaagtttatatcaaataaccaccaggtttggaaaatccagattttcccaaccatgtttttaaattgtctaaagctttgtatggcttgaaacaagctcctagagcatggtatgataggcttaacaactttttgcttgcgaaaggttttacaatgggaaaggttgaaaaaacgctttttgttcttaagcatggtgataatcaactttttgttcagatttatgtggatgatatcatctttggttgttcgactcacgctttggttgtagattttgctgagattatgcgcagggaatttgagatgagcatgatgggtgagttatcgtactttttgggattgcaaattaagcaaacacctcaaggtacttttgtgcatcaaacgaagtatatgaaggatcttttgagacggttcaagatggagaactgcaagccaatttcaacaccaattggttctacagctgtgttggatcctgatgaagatggtgaagctgttgatcaaaaggaatatagaaatatgattggatctttgttgtatctaactgcttctaggtcagacatataatttgctgtgtgtttgtgtgcacgctttcaagcttctcctcgtgtttcacatcgtcaagcggtcaagcgaataatgaggtatttgaatcatacacatgagtttggaatttggtattctacttcatcttctatatgcttaagtggatattctgatactgattttggaggttgtagaattgataggaaaagtactagtggaacatgtcattttcttgttacatcattgattgcatggtcttctaggaaacaatctagtgttgctcagtcaactgctgaatctgaatatgttgctgctgctagttgttgttcacagattcttggcttttatctactttgaaagattatggtcttacttttgagaaagtacctctcttttgtgataatactagtgctatcaatattgctaagaatcctgttcaacactcacgcataaagcacattgatattcgttttcactttttgagggatcatgttgagaagggagatgttgaattgcagtttttggacacaaagttacaaattgctgatattttcactaaacctttggattctaatcgctttgcttttcttcgtggtgaattaggtataattcatccttttggtatggtttgagggggattttgtacctcatggttttatcgagcaataatatgacaatgagaaaaattgagaaaagagagctttgtttatacatatggtattttcttgtacatgctagcaatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttgactgttgattcaagcataattgtaaaatctttggttcatggttatactttaatgcatgattgttatattatagatgggtttatattctttttattgcaacacatgacttgatatgctatatgtatgctaaactcttgaacattaatgaacataattcctatgcttgatgaaatcattgtccaaagggggagaagtaatgtgaaaatttttggatttttggagaagcaagatgaatttttggagagttgttgagaagagcatgtttctggttcaattgggaatttcttactttttaaaaacggggagaagttttcttttggatttttgagcacgatgtgtacatttgtacgaagtgtgctttttaccacttttgtttttatttttccaaacaccaaaacattttttatgggtttgccaatgtgttcatcaaggtggagattgtaaaatcaaaggtgtttttgattattattctatgataaacaattgggcattagagattattggttttgttatttggaatttattcacgaagtggttttggagatgattggattcacaggtgatcgcaggattcattatttcatgtgaccggtcagaccgggctctggtagccggtcggaccggcggtatgcgcgcggtcagaccggccagcccgcggtctgaccggccgacactgtgtcgatttcggtttcgggttgtttgtttggatatccgtgattatttcatgattatgacttctagatggatactagatgtatataatactgttgtttgctactaatgagtcaagttggagatagcttggtttcggaatatggtttctttgtttgttccatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgatggagttattgtgtgcgtatgggatgcggagtcaaatttggaaggagtccaaattttgtacgattggttatgtaaagtttctttcttgtactagagggtttcctaaggtgtttaggactcttagtatgagtttggttcgtggctttaggctgcctacctcatgtataaatagagggggagcgtgaggtttccctgtatcgctttggagagcaattgagttgagttttgagttagggtttcgagtttagttgaaatttttgtaaggagtgctgttggtgcactttgtaaacacagagagaatcaataaagtcatcatttactttaagagttcttcgatttgtgtttaccgggtttcggcggtcagaccggcgggagcacggcggtcagaccggcggcggcgacagcgagcagcagctgatctcggcggtcggaccgaagatataatcgcggtcagaccgatggcaaccaggcggtcagaccggcaggacaacttcggtcagaccgcgatccgtcgatttcgagggtaacttttatttccgctaaaagttttcggtttttgggtataccaaccattcacccccctttggttggcttagttcttgtgattcgattctacagaaatttgtggcattgaaggatttaccgaaggtgcgatgcccatttcggcctgtttatcgtgaaatggtgataaacggccgcagctataaggtttttaaggttgccgaatggcttcgggtgcaccccgggcgaaccttagaagactacgatctttgttcattcaagacgtttggaggatatggctcacttttggcgaaaccatcaaaagactgatcggcaggaggcgatctcccagcatcgttacagtctagtctgtgtttcaccctcttctcctcttagggttgtgtatgatattagtagtgatgacgaacctagttcgcctgattattcctaagagagagagaatgtgatcgcgggggcgaagatgtaatttatctgtaagctgggctgtaacgccattgctattttcttgtcacttgtatcattgtaatgggtttgtatttttcgatacatttttatttaaaatcaataaaggtgcgttttatttccttttcgctatttttgcattgtcacttcgcgtgcttttcgttgggtcggaacgtgtcggctcctttgcatatattagcgaaataggttttgacttttcagctttcggcttccgttttcgatccgttttgttctacgttgtaggaagcactcgtgctttccttttgatcgagtgtaacggtgttcggctagttgttctccgaaacaagctgttgcggtttcaatcgtttggcgagcgatgcttcgcctgattcgtttcgcccccctggcctttttcgctgatcaggcgtttgccttggggtttttccacaaattatcaatcgcacaaacaaataaaaagaaggcagaggacatagagattttatactggttcgggccttcgtggtggataatagccctacatctagttttttgtctttttttcattttcatcttttttttctcttttttttcttaccgaagggcttacataacgatatatacatttttacaagttggcgatatgggtgccatccgttctagacataaaaacgcttgagagaggcagcgttctaggaatggtcgaactcttcgccttccagtgtcgccagtcgaaaggaccccgtcctggacttgtgcttgatgaggtacggtccttcccacttcgattcaagcttgccaacggctatcgggttcgccttcttccttaagacaagatgaccaggcaacagctccgtcggtcgaacttttttgttgtaagttgccgaagtgcctatggcatacttgcgcatgtgctcgagtgcttcgactcttaccccctccaagagttcaagcgacacctcgcgcccctcttcgcccccagagaacgtcacccttggtgagttagtccttagctctgttggggtcattgcctcatcaccataaagaagcgtgaacgggctgaacttggttggtcttgtgggggtcgtccgaagggcccaaagaacagatagaattttctctggccatttgcccttcgctgccccctcaagccttttctttagtgcttttaggatcttaccatttgtatgtatggccgccccatttgactgcgggtgcatgaccgacgcgaacctgatttccaggttaagcccttcgcacatttctctgaacttgtcagagttgaactgcttgccgttgtcagtgataaactcttttggtactccaaaacggcaaacaatgtttttccatacaaacttctgtactgcggccgaagtgatatgagctagcaggctttgcatgtattgctttatctcgtcgaacgctgcttggcattcgggtgtccagttgaattttcccgtgccctggagggttttgaagaagagcaaacctctttcggctgcctttgagaggaatcgactgagtgccgcaattcggcctacgagcttttgtacttaacgtacgctcgacggaggcttcatttgctgaatggcatcgattttctcgggattcgcctcgatgcctctttcagaaacaaggaaacccaacaacttgcctgcgcgaacgccgaaaacacacttcccaggattcagtttcatacccgctgcacgcaagttgttgaaggtctcctgtaggtcggacgcgtggttgaaagccttccggctttttacggcgatgtcgtcgacataagcttccacgtttcgccccaatttcttgtaaaggaccttgtacaccagcctggcgaaggttgctctggcattcctcaggccgaaaggcatcctgaggtgacaaaaggtgccaaatggtgtgatgaaggctgtcttggggatgttggccgtgttcatgtggatctagtgatagccggaatatgcatctaggaagctcatgagttcgcagccaactatcaaatccacgagctagtcgatccgtggcaaggggaaatcgtccttcggacatgctttgtttaaatatgtgaaatcgacacacatgcgccatttgccgtttgacttccgcaccagcactggattctccagccactcaggatggtcaactcaggatggtcaatctcttgaatgaccccagccttgagcaatttttggacttcggcttttgctgcctcttggcgatcagcggacatcttgcgtagcttctgtttccttggcttggcatccggcttgactgctaggtgatgcatgatgagatctgtcgaaacacctcctacttcatcggggcctcaggcgaagatatcaatgttcttcttgagtacctctaggatgttctcagcttcttcttcgcccatgtcgccccccagcgatacgagctttgtggggtcggcatcatcaatctgtatcttgattatcttgtcgtgtggggcgggctttggcgcgtgcttcgcacggtcatgcggttcggcctcaacattgtgcactacttatggccagatcgccttttgaagcagccaaaggctgaagccccttgaccacgatcactcctgtcgggccgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccatgctgaaggctaccatcaactgtgcttggccaagaacttgaactgcttctccgctatcagggcgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccgtgcggaaggctaccatcaactgtgcttggccaagaacttgaactgcttctccgctgaaacgtcggagcgatgctggtgctggggtaagggcttgggtggctaaccccatcttggcatatgcttcggcgaagatgacatcggccgaagtccctccgtccaccaggattcgccggacctcgaaaccagctatctcggctgagatcaccagaggatcttgatgcgggaacattactccttcggcatctcctggcctaaaagaaatttgctggttcagatactgcggggccccttcgccagccaaagtgatattgtggaccgttcgtagctgcatcttcttttgtcgcttcgacagctggatcggcgggtcggcccttgtaatcacttggattactctgcgctgcgcgtcttggcactgttcggggggtgcttgttcttgagctgcttcacgaggtgcttcgacagctgctccctgctgcggccttggatcttgcccgctgacacgttgccgaatgtttcggcattgctctgtggtgtgtgaagagcgtctgagaaaggcgcagtagaggtcttttcggaccttcttgcggacaggctgctgatggttgcttgcttgctgggcgtcgaactccttgcggagggcttgcacttctttgacagccatcactgccttgcccgcacggtcggttctgaacttcctctagatcatgggggggggcttgaccttgccttggcggttgtccttggatggctggggctggcgaacagcgagaggaggtggttcggcaacttgaacttgtgcttgggcttgggctgcggcgacggaagccttatgatactcatcttgtattgcttgccatcgcttggaatcctcttcgccccttgcgtacccgtcaatgatgcaaagtaggtgctcaagcgtctgtggctccttattggcgatttttcttatgagttcaccctcgagtagaccggtcgaagcggcgtttatgacagatgcctcggttatgtcttgaacttggcaccgggcttgcgagaagcgacgcatgtactcccttatcgactcccccggcctctggcgaatgccgagcagatgttgctgcgtcttcggctcctcataggtgcctcgaaagttaaggacaaagatatcgcgtaattgctcccatgagtaaatgttattggctggtaaattgaaataccaagaacgggcaatgccgtctagagcgagatgtattacctttgccttggtattttcgtcgccatgagccgcttcgatcgcggactcataaatggagaggaattcctttgggtctgtttcacctgagtagcgtgggacgggtgggaacttgaactagggtgggattggacgggtcttgattcccccactcagcgatagccccttttcgctccctgccctgttcacggcaccttgctgcgggtatggcgtggcgaagggcgaaatcatggcttgcgcgtgaggttgggccatggcattcggctgcccggctccgattggtgatgcttgctgagctaccatggatgggtcaaaagttggctgtgaccgtgtcatggcgacctggtttggtgcctggtttgctccgaagcctgacgttggtgcttgcggccgaatggttggtgcctaagaagcattgatgaagttgaactacggtccttgactccacggcgaagctcccagacttggctgattcgacggcaaccaactcggtgcatcatgacttgtattcccctccgggtgtgctgaaggggctatacctgaaatgctatggggttggctgagctgctgaaggaaagcttggagctgcgcccgcagagccgaagccccttctgccattgtttgtggtgcttggccaggtggttgaggttgtacttgtgtaacaccctgcctccaaaatccgcattagtccactctacacgttgagcggacccactttcgcatggtatcgtgcttacactttcgtcctcgcttcgtgtaaaagggttaacctggggataccatggttggagcaccaaggcttataagtaggccttcacccacctaaacttccaaggtggtactaaaccaccactacacatccacttctgggccacatgggccaaactcacactactaacaggcttcaaacgggttggggtgttacattcacccccccttaagggctgacgccccggcagctcaccgtttacacggcagaggcctagaaccccctccggtgcagaccatggccttttaccccccttaagggctgacgccccggcagctcaccgtttacatggcagaggcctagaaccccctccggtgcagaccatggcccaaagcacatgcatcacacaacggaggtttatgctctgataccaactgtaacaccctgcctccaaaatccgcattagtccactctacacgttgagcggacccacgttcgcatggtatcccgcttacactttcgtcctcgcttcgtgtaaaagggttaacccggggataccatggttggagcaccaaggcttataagcaggctctcacccacctaaacttccaaggtggtactaaaccaccactacacatccacttctgggccacatgggccaaactcacactactaacaggcttcaaacgggctggggtgttacaacttgggcagcgaccggctgagcttgcagctgcacgtgaggggccggatgcgctgctgcggtcgatggctgcccgacgaagtacattggcgcttgcgcgacttgtggcggaaggggctgggtcggcacttgtggatagacttggggtgggacataacctgccgaatactggaggattggtgctgaagcgaccttggatcgtcttgccgtctcgtatgcttgctgttgttcttgcatttggcgaagcatgtcttggagtcgtgtcatgttctgtcgcatggcttccatgttggcttcggtttgtgtttcggggttagggttgacttgggcttgcacagcggtgagcgcagttggggccgctgccgactacgacggagcggcttggggcaccagcagttggcttgtcaaaaggatctccgccctggtctggagtgcccttgccgccgcagccgccttcgccataccagccatgttcggcacctgcacagaggtggcaggggccgaaggcggtagtgatggtgcaggtgcggaagctgatggcgctcctccatcttcggcaacgggcgccgaagtctctgctccctcttcggtggccatatccgccctgacgtcactttcctttcgccttgtaaccttctccttcacgaccttcttcggtggcattcgctctcaatggtttcgcttggaggtccccacgatcgacgccagctgctgtcgaaacgacaaccgcatacgtcgaaagacgtggtcactcaacagtggttgggaaagaagttgtcacgtcctgataaatttatcccgaaataaaaatcattctctaaaaggaataatagaattaattaaaaatcgaaaagaaattgacaaacactaaaatacgtacaagaaaaattcgaatatggtccagagaatttttgttaaattctccttggtctaaaaggagccctcaaattttacttgaattttcagagcaccggaaataattattaagcaacaaaaacaattaacaaagtttactaaaaagaaaaactaaaaataatccccctcctccctttgggccaagtctggcccaaagtcctccctctctctctctcggcctgcggccaaagtcctcacttcctccctctctttctctccctctcctcctctccctccttctcttgggcctcctctccttcccctcggcccagccccctcctcctccctctctcccccaggtcgcctctccctcctctcctcctgggccggccgcccggcccaaaccgcgccacccagccgcccctcccgcgcacgcgcgttgcacgcgcgctaactgcgcgcccgaccggtgggtcccacccacccggtcgtctccttcctcccgcccggcatcctttctctcttctctctcccgtgaaacctagcgtcgattcctcccctaaatccacgcgaatcaatgcccttccttccaaattgattggggggaattaatccccgttccttccacatcaattccccctaatttcccccttgattcgtgcccccaatcgtcgggaacgcccacgccaaccccggccaccttccaaggccgccggccggcttttccgccgttgttccctcctctcccgtccccggctccctctcctaccctataaaatggaacaccctcgctccgttctatcgttttagccccctcctgcgctctcccgtggcctcaccacctctccccgcagccctcctctctctcccacaccgccggccaactccagccgccactgccgcgccgctcaggtgcgggctggccgtgccgtcgccgccagcggcctcgcagccgcctcctcttccccggcgtcgcctccgtttcgcgggaaattatcggagcgacgtcctcgcagacgaccagtggtgtcgccaccactccaccgcctccagccgcctgtgccgcctcgccggtgcagcggctgtcgtcatcgccatcctccctcaacgtcgccgcgtcgccctccacccaggactgccctcggtttcgccggaacgccgtcgcccgtggcgcctctccctcggtctcgccggagttccttcggcaacccctttcgctgtgccagcgacgcatcacctccggcatcgcagcggcgagccagcgacgtcatcctcagcatcgccttccctccatctgaacccctccactgtccatcgtcgtcgtctccgttcgtcctcgtcgacgactcctccggtcggtcgttcgtcctcaccggctcatcgtctcgcggcgccgcctccgtcttcggattcacagcggcgtgttccatgccgtcctcgtcgccgtgcagccactgccggctgcccacgtcgcctcctcgccggccccggtcctcgtcatcgtcgtcctcccgtcgttcccggtcgtcgtggcgttcgtccctccgtcaagccgttctcgttcgtcgtcctcgctacgtcaagtgccgcagccccgtcatcgtcttcgtcctcgcctctgcgtcgccaagcgttgcgccggccgcgtctcgccttcgtccaaggatcgccgccgaagtcgtcccctcgcctttcgtctccatcgttcccggccgtctccgccgcgcccgttcatcgttgttgttccctcgcctcgtcacgtggtggtaaggatctctctccctcatcgccctcgtcctcatcctttcggtgtcgcccgtgcccgttgtgcggttgtcggccccggtacccatgtattggtgtcggtagtcgttcgcttgtgcgtgtggtgaccgtgttagtgtgcccgctcggtagccgcgtggtttccacgtgtgcagcccgcgtagtgtctagtggagtccgtttgtcggccactcgcctcggttgacacacagggtccgcttccgtcgacccgtggaccgtctctgtgtacccggtcagccgtggtcccttaggttgacaagtggggtccgcatgtcaacggcgcagccttcctgtcttttccaggctagcgcttatacatgttttatagttgtaaaacctaattataataatccgcaaatctccatataacagcattaaacttcggatgaccatgcattggtcatacgagctccgaatcgatccgttcaagtctcctaatgtttgttataacctaaagaaccctgtgctttatttttatgtattgttattgcttctttataggcttgtagctttgcttgtgtgcttcgcgtagcttctgtcgttcctgagtttcccgaagcgtggttcgcggtcgtcgccgaaggttcggaaggccattatctttgagcaaggcaagtcacatcatccttgagcatattgaatcccagtttataaaattattttgatttaaattattgcattatcgctttattcaaattcccgcattatcactattttatttagccatgcctatttatctttgttatgaccttatcattgttgttattgttattattgccttgttcaccctaggataaacaaaactccaactagtgggtaccctattcatggttccactagtatgaatttaggtagatgcttcgctgactaattaggcaacattaggtggttttataactttagactttgggaattctcatatcatttggacactatggtatggttggcttatgttggaattggacacacacctccccctctattcaaaacccccaaaatggttttaggctgggctcgaggtccgtggttgggttttgttagtcgtacctcgggtactataaggattaagctcgggcctctgttggaaagcactaccgtacttccacatgtctagtgggtaaggcttagtttgtggctcagtctggttataaacaaaggtacacggatggagatggacgaagtcgggggtcgatggacatctttaggacaaataaaggctacacgagttgcggcccggtagtcgagatatcatggcacagggctggtgtcctgctgctaggggctcaatcttgcctgtctgtcccggaggttctggccgtaggcggggctgggtcagtactcttgtttatggctaggatgggttgggaactatgtcgcatcttcagtccgtatgccgtggtggtatgtggcacgtggttacacgtgaggaagatgtgtcttgtgggtaaagatgtacacctctgataagagtataatctattcgaatagccgcgccctcggttatgggcaagcctagcaatgtacccaagttagtgttttaattcttaaaacctgcttaacaactaaaatgtggaatggttggcctgggttggcttgggatgagctgggacccagggtcgggttgccagttcggtctgaatcatcgtaggccttggattaaggcaggttcgtgagggtttacggccttgattaataacactttgtagctctaggatcatctttataaaatggctttgggcaactaagtgacttttaaatgctgtttactgcaaaacttaacccctatattattaccccttgcacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagtgcctgtgaagatagagccgtaggcccgctagtccgctgctgtttatttttgattgtcaggccttaagtgcctttgtaataatttaaatattatcgatataataaagatgtgccttttgtatcatgtttgtgtggtgtaccccagcttttcctgggacggggattaatacactagtgttcgggaaaatgtatttttctcggtcgcgacaagatggtatcaaagccatatcgactgtaggataagccaagtggataaaacctaaggtcatattttataaataaaactatttgcgaaagttctttttttctccttcccctaatgctatttgcaaaaggtttactcttttcttccttcttcaaatttctagtagtactagatggtcagctttgcgaagaagaagatgtcgtcaatttctgccgaagctccggaagattgcgggatccgctagcgaagtggaggaagcagtgaagccagctgtgaaggagtgaagatcttggataacccgtcgcagaacctaagccaccctctagggtagagtcgttagtcgtgtgttcctttgcttgtatgtgtagcgcgtggtttgcatcagtgggttgtgatgtaaccatgctaggttgtttgcttaatcaacttgcagaataagcaaaacaaacaacacatcaacaaaaagagttagttcctttaaggtcttgtccctagttctggtctattctttccttgtttgcttcctctctcaacctctacattgtgacagatggataacactggtaacaaaggctatgtgaatgatggatccgatgactcaagaacccaagccaatgggaatgagaaaagcatcaacgaaacctcaccagagctaatccaaattgtggttaaccaaaccaacatgttggcaacagcatttcaactattacagaattggaacaacccagcaggggcaaccaacgttcaagtacctacagtccagcaacagtgcaagttatcagaatttctaaaaactaagcctccaacctttgccattgccgtcgatcctatggaagctagtgattggttgcgcacagtcgagaagaagctggggttgattcagtgcacagaccaggagcgggttgtctttgcaactcatcagttggttggaccagcttcagaatggtgggatagctacgaagcatcacggccagaaggacataccatcacctgggatgagttttcagccgtgttgaagagatcacatgttcccgcaggaatgatcacactgagaaaacgagaattccgctacctgaagcaagaagatttgaccgtcacagagtacctgcatgagttccatcgtttggctcactatgtaccagaagatgtggaaactgatgaagacaaacaagagaagtttctctaggggttaaaagatgagatcgcagtgcaactactcctagaggaatatgaagattttgagaaacttgtggacaaaaccatacaactcgaaagtgagcataatcggatgaagaactgcaagagaaggattgtcagcatcccaacatttccatgtggtaaccaaagacagcgcactgagccacttcagatcaccggatcttctattgcgcatcaagagttcctgccccaagaagacggacacaatgcagacaataacattagcaatactaatgatgatgataccaccaacaaccatgcttcttgccccattagtgaccactcgaatcaagcgtgcaatgtcaacatcattcaccaaggtgtcgacgatagtatcaatgatggcacccagaatgacaaccctagaaattgtgatagcaactatggtaccactgatgccaatgttagcaaggatttccaaccaccaattccaactccaagtcagaatgatcgtccccagacggacagctcaataaagaagacgttgatttgttacaactgcaaagaaccagggcatgacttgagggactgtctacaaccaaggcaaagtcggcctccacattaccgccaatttacacgaagcagacatcctaatcgtattgtggtcactggagcaaacgccatacctgtgaggcctcgtgttaatcataacccatagcagaaacaatgtaccgatgctaagcacctttccttttaggcagtgcttagtattcattaataagggagaaatttgtaatatagacatgttctatgaggattcttttggaagatgcggatatgggattatgtgtataattgcttactaataaaggagacctagggtctcgtgtcagaggaactatattctaacctcgagttaataaccaacctgttgatggaaaagaaaaccaattaaactgtgttggattaaaaagccaatgagacagtagttggggataagagtttggatacgccttttacggatcaagataaggattgttggatgaaacccataagggtacctcccatgcctctacattgataagttcggatatacctgcaaacagttaagaagatctaggagacatcaatatttgagaacatagtagtcgatggttggtaattagtctatcaggtatcagaaaaggttcaaaggtgatatggcagaagaacaatttggatgctccccatctcgaggaagcactaaagatgatcatcggcaattaaaccctagtggcatagatacagatagcaagcgatgtatttccctgaaggtagtcagtgcagctttttgacgaaccacttcaaggtttcactgaaaggcagcaggccaaaggacctcagttctctagccggaaagaagtaggccgaaaggtgattgataaaggataatcagaagcatgctttgcatcactcgaggaagacccctgatcaccctgcaatagtcaccttgtcattgaggtagaaaaaaaaatttcatgagtaagcaagatgacctaggtaaaagtgtttgtttgaaggcaaggaatgaaatctttaactcggtatcagatgctacacggagtgaaaagtgcaggcaccggttaccaggcaatgccatgtcttggaagatgatccaatgggaatgaacccttcaaggtcgaaggtgtaaaggaatacgttggatgctaaataatgacaacatgaagataatagtgggataagttggttctgttgagaaacataattcaaaggcgaaattatcgacccttgcatcgaatagcagaagtagctagcacccggagaccaggaaagctaatatgaggcagttggtggcaagttagaagtaaatgacaaacatgatattctcatgatgacaagcatggtatcctagtaatgacaagctgatgtcgacgcataacgtgaagtgggtaacttgtatgaggttgatgccaaagatatgaattataagaagttctggaactaaagccccatcttcaagtgccacatcccagtcgaagtcagctaaaggttcaaccagggacaagtcaggtgaagagaagattccatctgcaagaggagatcgagccaagcagtccagagtggagaagttttgctaggcaagtttgttatagaagacgcgacggaagaagtcagacaagaagagaagactgcccaacctatcttcttgctagcctcctcgaatctcggggacgagattcctgtaagaggggtggatttgtcacgtcctgataaattcatcccgaaataaaaatcattctctaaaaggaataatagaattaattaaaattcaaaaagaaattggcaaacactaaaatacgtacaagaaaaatttgaatgtggt

SEQ ID NO: 58985 - DNA, 2085 bp, Oryza sativa
  unsure (1)..(2085): unsure at all n locations
acatgccagtcaaatgtgttgtatcatgaattctttaaacttgaaacttgattgtatcccacagtagtagcagttaacatttataatcatacaactactgggatatgtatttccagtgttttattatgaattatttgaaccctaggtatgggctagtttcttgttaacttctttcaaacctgagcttatcttattttgcctggatgatgccatgactgatgggaaaataaaaggaaatattccctctgtcccaaattataagggattttgggtggatgggatatatactagtactatgaatctggtagcacatttttcagtcttgctatgcatcttgggctagatatatattttacatgtagggtttgccactcttcataagtgtaaagtgccatttgaggatcagccactctctttctcactgacatgaggcattcgagtgacaaattctcatccaccaatggtggagagtgacagaccccaaaatcaactcttggatgataaaatgaactcgatgctgaaattcttagtgggtagagcatggaattttgaaatacagtgtcatattttgcttaattatatcttgtgctaagtgcttctggagaatcaagttcgacatgcaataaataattgtaaaataaacttgaaatgttgtttcaacaagtgttggtgtaaaataaatacaaatgacaggttgagatcttattatctatttgttctttgcatcttttgtgcagttggaaagtaatattcgtggtgtagcattttctactagctggctgaagctaatagatgactggcctgtggaatctcctagtgcatctgctggtgcatcccgtcctgcagcataccaaaaacgtggaactggtggaaggcggggcagaaaacgttcaatggcatctgaatctgctcctgttactgatgatgacaacagctgaaagaagtgaattggtggagtggaggaaatgtttcaaagcgtatctgacagaggggggctctaccagttttgaccattataaaagctgctcgtcaaggtattgcacatgtctgtctgatatgataatccctttctctgtctcaaggtgagaacaagttaacatgatctgtcgctcactaggtggaaaaaaaaggatgttcagtgtgtcttatcatgaaggctccaattttccaaggcggactcggcaacttgcttgnagggcatgtgttggattaagccagagttcatctcaacttgctctccaggttagcaccttctatcatgatgttttgaagtatttagatcaagctatatgtattcctaatatacatatctatctcacaggttagatatcttgattcccacataagatggaaggagttcatccctccagatcaaattccttcagaagggaaaagtgtagattctgactattctgttctcagaaacgcagttgtttgtgataaaaaaatagttgacaataagataagatatgcacttaagtttcccaaccagaagcatcttcctgtccgtgtaacaaagaatattttggaagcagaagataatcaggatggggatgggaaattttggttttctgaaaaccatatcccactatacttgctacgagaatttgagcagaaagctggggttagctccttgcctactccaggaatgttagattctaactgttttgccaatttctaccaaaggcgagtaaaatcatcaattggagatgttttcttctatctgcttcacaagggtgatgtatatccttgcacctcatgcaagaaggatgtttccttcaggtttttgttctacaccttattgctttgttcattctgttattgttttctttataagatgctgctttatctttatttctcatatatctttgttgttaatcttatgtagggatatcataaaatgcagctcttgtcaaggtacgggtttctagcataccccctttttttttgctatttccttaaagtagagaataactgataaattactgacgtttttccaatatgaactcacaatagtaactaaaacaatgtttcaggtaattgtcataaagagtgcacattaaggtctgttggtagcaaaggggg

SEQ ID NO: 58986 - DNA, 26883 bp, Oryza sativa
  unsure (1)..(26883): unsure at all n locations
tgtctcgagagcaaaatgtagaagctaatgatttggcccaaggagtatcagggtacaagctgatcttacctgatttagccttatatttcatgtgcttaattggtatgcttgatctgccttttatattgagatcttgttgcttttaggtatattaagcttcttgtttgatatatttagcttgctttaatatcttaatatagagtagtatcagagtattagcctgtacttgctagatctatctgatcggctatgctataaacatttataatctccttgttagtatatatttcgatctaagtgatttatactgtttcggcatggcgaccgatatgtcccaatcacttgatttaagtatatatcgacataagtattgtatactgttaatatctatagccgaccgagtagatttagttctttattatttattaacatatgccgatcgatgcaaagatgacatcggctcaaagataaatgatatgtcatcggcaactagccaatcggctatcgtttatggatttaacctcggtttctttgtcttcatttcttgttgattacaggatcaaatcaactggcacgctcatagttccaaaggcaagatttcttggacatgcactggagttaagcagatctcccaggcctcgtggttttcacatcaacagggtgtccgtggatgagggcgaagaggtgattgggcttccacgcctcgttcttccttccgacacccagcgtgagtttttcttttgattttcgacatgcttttcgacgtcatcttcattttcttttatgaagatatgtttcgactcactccgcttttccttgttcccttcttacgcagttcgcacattggaagatatggaagcggaagcggcaaagatggtcggagctctgaccaccaccgaattcggctgcttgcttcagcgccaagccgatgggagggcgaaccgcgtctatgtcggcgacctggctgttcggtcgattatttcgaacgccaccgatgacgacgctgggacatcgaaaaaaagcaagcgggccgttgcgaagggtgtgcgagcacaagctcatcgcgccagcaaggacacggtcgacagcgacgcggataacgaggacgaagaggccgggtcagacgaggatggcggatcgcgcggctacacccccagtcccgtccaggcgaaggttggagcgggtgctcatgtttcgcccgtgcgtccgcgagacgtcgctggtgcgaatgggctcctggcgatctccagttctgcggcgaagccaggggcgccagctaggaagaagaagggggtggtgcaaatcgccgccggcttttctaacagcgaggcgtcttccgacgggacgcctacttcgcccgtgctgcggcgcgctggtcctcggaggcgccggtcaccaccgcccgctagcgacgccgaagcgccaacaggtggcaatgtttcggcccctgctgccggctccggttggggtgatcgaatcggcggcggcgaatgccccaggtaccgggagtgttgctgcagctccttcgacgagccatcggcgggacggaaaggggccggctgtcgaaatgactgtgtctgacatgacactttccgccccgcattttgtttccgccgatttcacctctcggaccaaaattacccccttcgtggatggggtgtgccaaattgtggccccatccgacggtttgagtcttttcaccgagctcaacgagttcggcaaaaactacgcagttacagagagcctttttgagcgggtatggactattattattgtgttccctttcgcttgcgcaatgcttttatccttttttgcctttgttataataaatggcttcggcttctcttactcagggtcttgcggcgcatctaagcgcgaaacggtccgcctcggagcgactagacgggtaccgactccgtcttcggaaagctgaggaggaccttcaccacaaagaggacgaacgccgggtcgtggcggacgccctgaagaaggcgaacgcggagaacaaatccctcacgggggaaaacaagtctcttcgcgtcgacctggaaagggcgaacgggagggccgccgaacaggagcgtcaacttgccgcggccgaggagaagattaggtccctcgagacccggcttattgcggccgaagctgctactgaggctttggcgccggcgacggagtctgccaagcaagcctgctacacccttcggctggctctcaatgacatcggcgcgcgtgcggaaggcgctccgggtgaagatgggacggtgttcaacttctccgagtggacgcaggatgcggccggctcggttgtcgaagtggctagcgcctatggagattgctgcgcgcgcgtttctgcgggttttgtgctcagcttgcttcacgagcatggttgcggccatgttgaaaatttttccgagctcgtgaaaggggactggcctgaaaactcccagccttccggagcggctttgatggccttccgaaagggcttttgggaggatggcggtaaagtctgcgcgaagacacgtctgcgcgagaaactcgagaagatggtgaaagccgaagacgccgctgccgccaacgctggggaagaccctgggccgtcggagcctgctgttgagcgtgagggcgaaggagacgaaggccaagaccaccctgaggtgtgagaccgttcgctctcgtgttccttttgccttttaggctttttgtagtttttgtttatgtatatagttttgcatgtttggctaatggccgctatcgccttgtagccgttatggctgtcctttattaatgaaaagtttgtatttcgccaatcgtgcgtttttattggaatgtgggattgatttcgttagcatttctcccttttgcactgttcctttgtgccttgctggcagggttgtagccggaaaatgtgagttcggcctcccttcatggattggcgaaataagaacgagaagttcatggcggagaagggcatacccaagactaaatgtcctttttggcccgtttatcgcgaaatgttaaaaaacggcaacagctacaaggttataaaggttgcaggatggatgcgagcacatccgagccgaaccctagaggattatgaccgctatcatgtggtgcgtcgcgaagatagcacaattttttggcgaaactttaagaggtcgattcgctaagaggcgatcgctcgtcgccgttatagtttggtttgtgcttggcccccatcccctttaagggttgtgtataatgttagtagtgacgacgaaactggttcgccgggttgtaatatagatgagggcgaaagtgtaaacgatgatgtaatctttttgtgaggttctcacgtgaatacaacatgttttttattttgtttagtttatgctttgtaaattttggaacacatcttcatgctatcattcgcatagtcactgtcgtgctttcgttaggtcaaaacatgtcggcccctctgcgtactatagcgaaaagatatgtttatttctcagctctcttctttcgttttcggctcgtggcaggcgtgctgtcgagcatcgtggcctgtgtgtaagctgaatgcaacggtgttttgacttttattttcaaaatcgagctgtcgcggtttcaacgttcggtgagctatgcttcgaccgattcgtttcgcccccctggcgttttcgctgatcaagcgtttgccttggggtttttccacgagaacattattcacaaaaggggaggatgaaaaagatagaaagattttatattggttcgggcctccaaggtggataataaccctacgtccagtttttcttttttgcttttttcattttcctctttttttgtgctgaacggcttacatagtatgtacaactgtacaattggcgaatcgggtgccacccgttttacacataaaattgtctaagggaagcagcgtttcaggagtggtcgaactcttcttcctccaaagttgccagccgaaaagaacctgttagagatttgtgcttgattaggtatggtccttcccacttagagtccagtttccccactgccacggggttcgccttttttcttagcacgagatggccgggccaaagttccgtcggtcgaacctttttgttgtaggttgccgaagtaccttccgcgtacttgctcatgtgttgtagagcttcgactcgtaccccttgcaagagttcgagcaacacttcgcgcccattttcgcccccggagaacatcacccttggtgagttagaccctagttctgccggcgtcatcgccacttctccgtagagaagcatgaaagggctgaactttgttggccttgtaggggtcatccgaagggcctagagaacggatagcatttcgtctggctatttacccttcgccgccccctcaagtctcttctttagaacctcgaggatttttccatttgcccattcggccgccccgttcgactgcgggtgtgcgaccgaagcgaatctgatttgcaggtttagcccctcgcacatttctcggaatttctcggaatcgaattgtttaccattgtcagtgatgaactcttttggtaccccgaatcggcaaacaatgttcttccagacaaacttttgaaccgcagctgtggttattgtgcctagtggttcggcttcaaccgagcgagagaagtactcgatggctactatggcgaacttgtagccgtttcgcgccactgggaatgggccgatgatgtctaagccccaccttgcgaatggccagattggcgcgattggctgtagttcgtattgtggtgccgtttggcttcagccatgtctctggcagctttcgcactttttgacatgttcaacgcatactttaagtatggttggccaatatatgccttggcgaaatacttttgacgcgacggtccttgctgccaggtgtgctccgcacatcccttggtatatttcctttaccatctcctcacctttggagaaagatacacagcgaagcatgggctgtagtattccagttcggtacaattgcccagagattatcttgtacttcgcggttctgatctgcagctgttttgcctttggttcgtcatctggcagccatccctctttgaggtgcttgacgaagggcgttcgccagtcatctgggtcttcgcccagttcgcnctggtcgattgccataatgtgttggctttctgttggcacacttggtgaatacaggacttcaaagaagacccctagcgaatgcggccccccacaggcggctaattttgccaatgcgtcagcctcttcgttttgacctcggggcaagtgttcgaccgttatgctggcgaaagttttttccatagatcgaacggcttcgaggtattttctcattccttcctcctttgcttcaaaggatttatcgacttggctagcgacaagttttgagtctgttcggattagaagcctccgaacgcctaacgactttgcttttctcagccccgtcaacactgcttcatattcagccgtgttgttggttgtgtcgaactgcagtctagctgcgtagcaaattaatacgtcccctggcgaagtcaggattgcggcgatccccgcccccttgtgagaccacgagccgtctaagtgcatgacccatggctgttcgacgggcatccgtgctctgggacggatgcgggtgtccattcagccatgaagtcggcgaggagttgggacttgattgcagtgcgagcgacaaagtgtaggtcgaagggtgatagctcagcagcccacttgcttcgacgccccgtgatttcttttcctcaaagcacttcgcccaaaggatactgcgaaggtaccacgattttgtcggcttggtaatagtgcttgagctttcttgaagccatcatttgggcgtaagcgagtttttccatttcgatgtatctgaccttcgcccctggagcgcttcggagacaaaataaactggcttttggccaacttcagtttcttgtaccaaagctgcgctgacagcaacgggcgaagccgctagatagagccagagttcgcttcctgccactaagctaactagagttggagggctttggagatactgcttaaactcgtcgaaagctttttggcattcgggtgtccaacagaactttcctaccccgcgaagggtcttgaaaaaaggcaagcctctttcggctgcttttgacaggaattgactaagtgccgcaattcgccccgtgagctttcgtacttgtcgtacgctcgatggtggcttcatttgctgaatggcatcgatttttttggggttcgcttcgatcccccgttcggatacaagaaatcccaacaacttaccaacacgaacgccgaatacacacttatctaggttcagtttcatgccgattgcgtggagattgtcgaaagtctcttgcaaatctgatgagtggtcgaaggccttgcggctttttacgacgatgtcatcaacataagcttcaacatttcgccccaattgggaccccaggactttgtacactagcctgacaaacgtagcccctgcatttctaagaccgaaagacattctgaagtggcagaaggtgccgaagggcgtgatgaaggctgtcttcgggatgtcagccggattcatgtgaatttggtgatatcctgagtatgcatccaagaagctcatgagttcgcacccggcggtcgaatcgactagctgatcgatccggggcaacgggaagtcatccttcggacacatcttgttgaggtccgtgaagtcgacacacattcgccacttgccatttgacttcctcaccagtactgggtttgctaaccactctgggtggtcgatctctcgtatcactcccgcttttagcagcttgttcacttctgctttcaccgcctcccggcgatcggccgacattttcctcaacttttgcttcttcggccttgcttcaggcttgactgcgagatggtgcattatgaggtctggcgagacaccccctacttcgtctggcccccaagcgaagatgtcgatgttcttcttaagcacaaccatggtgttgtcaatttcttgttcgctcaggtctccaccaagcgatatgaccttggtggggtcggaatcatctatttgtcgctagatgaccttgccgtgggggtgggcttcggaactggttttgttttctcttgtccttcaacctctacggtgtggacttccctaccgaaaggggccactgtagcggtcgaaggctgggaacccttgacaactattacgccggtcgagcgtggcatcttgagcttgaggtagttgtgatgagagactgcttcgaacttggtcatagtgcccctgccgaagatggcgttgtagttgtatgggatgtcaacaatgtcgaagagtatctcctcttctcttctattctcttgcaagccaaaggcgactttgacgagggtttgtcccagaacttgcactgtttcacctccaaatcctctgagcgaagttggtgcttgggatagcgccaatgtcggcagacccatcttggcgtatgtcccggcgaacatgacatcagccgaacttcctccgtcgatcaggatgcgccggacttcaaaaccagccatttctgcagaaacaaccagcgggtcctgatgcgggaaaagaactccttcggcatcttctggcccgaaggatattggctgtgacaagtatcttggtgccccatcttcggccgaaacgatgttgtgcactgttcgaagttgcatcttcttttgccatttagacacttgtgaggggggatcagatcttgtaatgacttgaatcactcttcgccgcacgtcttggcgttgttctacttgaggtgcttggttagggatcgcttcgcgcggcgcctcttcgacccttccttgttgctgccttggcgcttgagcgttacattgctgtcggatgtttcgacattactcggttgtgtgcgaagagtgtccatgaaaggcgtagtacaagaccttcttgactttcttgtggaagggctgctgctgtccacccgcctgctgggagtcgaactcctttcggagggcctgcacttcctcgaccgccattaccgccttgccagctcgttcggtcctaaatttcctccaggttatcggggcttggttcgaccttgggtgttgtccttgattcgccgggagggttggttgaaccaggacaggcgccgaacttgcaacttgaggcggaacctgagcttgggcgttggcttgcgaagtggctgctgcagctgcggcggccttgtcatattcggcttgtatctcttgccttcgcttggtgtcttcttcgcctcgagcgtatccgtcgattatgcgaaagaggtgtttgagagttttgggttccttgcgtgcgagctttcttgtgagttcaccctcgagcaagccggccgaagttgcgttgacgacagatgcttcggttatatcctgcacttggcaccgtgcttgcgagaatcggcgcatgtattcccttgtcgattcccccggcctttggcaaatgcccaaaaggtcttggtgagttttcggctcctcataagtacctcgaaagttaaggacgaaaacgctgcgcaattgctccaatgagtaaagctattaacaggcagattgaagtaccaagatcgggctatgccatcgagtgcgaggcgaattacctttgccttagtgttctcatcgccgtgagccgcctcaattgcggactcgtagatggacaggaactctttcagatccgtttcacccgaataccttgggactggagggaacttgaactggggtgggatggggtgacttttgattccccagctgaggggcaaacccttttcgccacctggcttggttgtagccccttgttgggaaggccagttcagttgtgggtacggaggcgtgaatagcgaagctacagcttgcacttgaggttgagccgtagattgatgtcccatgccgaacatcactgcctgattctgctggtctgtcgaagtagcttgcctcgccgtagcagggtcaaacatagcttgattccaggcttggctttgcggtggggctgttccgtacccatggggtacggccaatgcgaaagtcatgggtgcctgggccgctgtgcttgggtcgaactatggcggtgggccttgagcttgacttagcaaagcgaactggctggacagctgtcccgtcgaagcaccttgacttgggcctccctcggccgtggccggagatgaatttcttggtatattgttgtggggttgattgagttgttgcaagaaggcttgaaactgcgcttgcaaggtcgaagctgcttccatcatagcttgcggcgtcacgccgaaaagcgtggtagcaggcttcgggtattgggcttgaggtgccgccgggcgaaccggtgccgggatcatttgaggcgttggacgcgcggcaatggccggggcgggcttggcgaagtacaccgacgcctgcatagcgtatggagaaagaacttggggctgagcgtagaactgttgggtgtgagccttggcttgtcttgctgcttcgtacgcttgttgctgctcttgcatctggcgaagcgtgtcttggagttttgtcatattctgacgcatggcctccatgtcagcttcggcttgtgcttcaaggttggtgttggcttgcgaggtggtgatcgctgttgatgtcgaagctggttgtgcgaaaacggcggtcgaagggccccccgctacttgggatgaaaagattacgtcggccttcgccgctgcttccgctttcaccgcttccgcctcaatcgaagatgtgggcgccgaagacgggagagttggtgccaccggagttggtaccgttccggcttcgcccgtggaggccgaaggctctgctccctcttcggctaacatctcgtcttcgacgtcaccttcctttcgcctgacaactctctccttgacggttttcttcggtggcatcagtggtttcgctcggaggtccccacggtcggcgccagctgttgtcgaatggacaactgcgtcacgccgaaaggcgtgattctctcaacagtggttggaaataaagacaattgtattgctttgtaaaattttttggatccccccattacaaggcctaagggggctatttatagccctattacaggttccttcctttagggtttaggttttacaaggcaatttacatggctacccttatgataggaacattattgggggtacacagtgtcctttacatgtatgggcccttattgggcttagatggcttggcccattcatccggcaaatcctcctcgagagtgtaacggcccgctaggcctcctcgcggtggggttcggcgctcggcgaagcccgtgtctccgtgctaaggctttcgcctcaccatcttcgcccgcggagcccttcgacaaggtctttgcctggcgaagcccgcgttaacccgagccacagccttcgcccgtacggtttcctcttcggccttggccctttgctttcggactgagccttatcgcccgagcgggtggtttcggcaggtctggccgaaggcactttgtggtatacctccaacaatatacataaaagaatattaacacgagagtatttatattggcatataaaacataaaatatatttttttgaagttaatacgtgcaaaatgaaaaatcttgaaatatacacactgttatattaagcaaggaggctgcataaaaaatttcatatttattcaaaacttctagtaagttcgtcaactgtaacctcttgtaagtcttgaagagcattttaggtattttttaaaagtatccacccctaatggtatattgtagaaaaaattgacaaagtcagtggcatattataaggaaagacaaagttgatgacaaatcatcgaactagactaaactcagtgacatagaatggattctatgttttatcgctcatctcttgatctaactgtagttttcttgtgtgtaggtctagattatttgcataagggttgcaacctgccaataattcatggggatgtaaagacaaataacattctcttgggtcggaatttaaaagcaaaaatagcagattttgggctttgaaaaacctaccatagcgactcccagactcacatatcagccactgcagcaggatctatgggctacattgaccctgagtatgagcttctttgtacgcaattaatgctaattttgtgctgtgtttcatatatattaatgattctattcaattttatccttaatcacttggtgcaatcattgtgtttaacaatgtgggccatttttaggtactacatcaccggtaggctcactgagagtagtgacgtctttagcttcggtgttgttttactagaggtaactagtggtaaacctcccataatacctgaaaatggccacattattgaacgtgtgaggcagaagatggtcaccggtaacatcaactcagttgccgatgcacgtcttggaggttcttataacatcaactccatgtggaaggttctagatgctgccatgatgttcacagcagatagctgctcaaaggccaatgatgtcggtcgtggtcatgcaattgaaggaaagtctggaattggaggaagctcatggggacatgggcgacatggaaaatgtagcaagagataacaagtctttgatgtccatgttcggtccatcgccaagatgaagaattaaccattgataactagctttgggacatatagtgggttctctgcttcaagtctaaaataaaaaaaactggtttgcatagatgatttgttttgtgttaagacacaataatttatacagtttgtattcgtgacagagctgacagtaagctgtttgtttcaatgtgcaacagtaagctattcgtgagagtagatcagccaaatgctgagaaggtggttgtttacaaccaaagattatgtactagaatcctctgccattttataatttgatcgaaatgttccacagcctcatggataattcagcacaactgcaaagggcagcacctcatgacagagctgaggagcatgtcaggactcgaccatcaagcaagaacgaatgatctcgttattcccgtttccttttttttttttttgggggggggaggggtggtttctctaatgtgtaaaacctatgtagatgtcgttattcatactgctccaacgatgcagttatgaaacttacaaatctaaaagacatgtttcgttgattttggttaggcgtagttgcataacacattgcaaagtcaaggtaagaagatctttacttaggtggatttcttcctaattctaatcatgtgagataggatatctcataaattgatttttctggacgataccctttttaggttgtagacggaccataactgcttctgcctgcaaaaatccctcacacggggtgagttcaaagcgctgcatgcaaaataacatttgcatgcggcctcttaagagatccacatatacaaatagactaaccttttcaggtgagcctccttagtggctacatgcgaaaatcagattttcacaagcgcctccttaagaggtccacttggaaaaatcactgcaaactaaatataaaaacgaaatccactccactcctccacctctcctctcttatcttctccccaatctccctctcgtgagcgcggctggagcagcgggagggtcggcgattggtggcgggcaggagcgaccaacgtcgggctggagtggtagtgagctcggcaatgtgggatccagcgtggaggacggtgggagcggcggtggcggcacactcgtattgggcatcggtgccctcggctacggaatctgacgcggaggacggcgggctcgggcggcggtagcaacgctctcggctagggattcagcgcggacgacggtgggagcggcggcggtgccctcggattgcatggtggtgccctcggttgcaggatgtggagctcggccgcgggatttgatacaaaggacggcgggagcaacggtgatggtatcgggtgacgacggcggtgtcctcggctgtggggtctggccggagtgacaagctcgatggcgaaggatctagccacgccgtcctcgagaggggcggatccaccaccctcatccacgaaaggggtgaccacgacattgggtagcgacagtggatctgacggcgccacccttgggatgggcggatcagccacccctggccccgagagggtgtcgactgcagtgggtggagtttgagggtagcggatccatcccccctccccccagcgcgggttgatgggccttctttatggcactaaaagagatcttatgatagatgacgcttcatttacgttataaacattgaattttttgtcatgtttcataatatgtgacgctcgcgtgacgaaaattcattcgtcacctatcatgcgtctctaatggcgttctatgacgaaaccttattttttcattaatctagtgacgatccttctgtcatcgtaactttgtgatgctcatattcgtcattatctagctaaaaaacgtcataaaatatctgatggcccattaaaatcaatgtattgagcactctgtttatgggctttagcccaatggctagcccgactagattttagcctggcccatctatgatgtagcatattttcagcccaattctattatatccatttgctttaatatcaaataataaatgggccaagtccattgcaaaagcccatataggcccaaacattataccacactattttcagcccgtcatattatattcattatattagtatcaaataacaagtgggctaagcccatataggcccaacaatcaaacataataacaacccatataggcccaacaatcaaacataataacaacccatatagcacaaaggtttcagcccaattagcatccaacacaacccgacaaacatccaatacaacacaaaatttacaacacagcaaatcagcaaatcaactggttggccactcgtgggaagtgtttgaactgtggcagggataggaagtgcttgaactgcggcagggacagggacaagaagtgcttgaactgcggcagggccggcctcagcttgctcaggaacccctatatcaaatacacaaagtgcaacagattaggcaccgattgactcattacatgataaaattgtgcacagctcagaacgcgctataatgtacggctccattatccatttgcaaacaagcctaaatagaagaataggcattgaaaaatacctcaagtaatgaagtttcagcaataaatcacatatatgaatcagggaggatagatatacatagaatctggaaaaaggagagcaaggattgattagggactgcggaggattgaatcaggaggaatgtcacttgcttctacttaccatgctgctgctgctgcttgccttccgcctgctgcatcgcgcctgctgcctgctgcctcgccacttgccacgcgcatgtccctgccgcgtagccgtgctgccggacaccagcgctggatatgagaaacacataagattgttgacaaacaacatactatattcaaccatgaaactacttttgaggtgctcataatcccaggcgcccagcaaacaaacctaatattgcatcttcgatatatttacaggatttgagccttatgagcttcttattagatagagctatgggctttgagcccaaaagagcttctgagagctcatgagctagctagatcttggcttgttaagaagacaccgactcgtttaattaattttacgagtcgagttgagcccataataagaagatgagaacaagcttagcttttacagtaagtttgtaactgttaattggcatgttcttgtcaaaaaagttttttaagtggccatgtttagtaacaggactaatccagaatgcatatacctgtaaatattattcagtaagtaagttttttcaaggcaatcatcagtatgtaagcttattttttcttgggatgtatgataaaagtggttatgaagaactttggaacataaagggggtaaagaaagttgtgcagactcgtatgaaaaaaaagacagatttttcaaagaaccttttctctgaagcatactttgttggtcttcatctccatgctcagttacttgagcaacctactaacctcgtcagcatgcagagatccagagtttagatgagccaagaaatctgcacaagaaaaaggtatcacaatcttctttcatctgcatgagaaataatgccaagagaacttcccagtttgatcagtttgggagaactaatgcagttgccctccctctgaagaaaggtactcctatatctgaacaaataggatttttaatagatttatccttgcgatatgcccttgatgtgtttaaacatctgaataaattttgctccatgcatctgaaattctaaatgtctgatgctgcaatgtcgtgctaattgatgttggtactactacattacaggttacaaattacaagtctttgcacttctcattttttaaaaaagaaaaaaagataggaaaaagaacagacctagacaggctgctgcaagagaggacatggtgaagcagcagcagtaatcagccgccgccggtgccggtgacgccgaggtctggcttgccgtcgtcctcgctgcttgtatgaggccagctccaagaacccccgctgcttgctcctgtaaagcagcctgcgcagcacccacccgaacacaacacgccccagccatcaacaaccgccgccgacgacgaagtatcagggggaaagaaacaagtagagaaaaacgggatgggcgcacctgttgatgaggcgacggcggctctcgtcggaggagaggtcgatggtggtggtggaggcgctgttctgctgggtggtggtgctggtggtggtggtgaaaccgaagaggacgcggtggggggggagggagtcttgacgaatccggtggcagtgcgggaagaggaggaggagaggcgctggtcggggtcgctccaccacggcacctggtcgagcgtcacggccggctccacccggcccacgcccggcgccgccgccaccgaggaggccgaggccgacgcggccgtcagcgagcgctggatcagagccgcgagcgcgagggtttggggaaaggaggaacgagatctggactcagatttggaatcgtggctgagggaagtagcaattttgatgcgattttaccagaataaccctggtatttggaaacttattatacaagttacttggataaaatggtcatttaacctgaaaattttaaaatactaaaaattcgaatcgaattttatcatactaaatgaacttatgtgaaaaaattgtcaaaaacaaagttgtataacttattgagatctaccaattttattttggttatttctccgtatgagtttgattgaccaatataaaattcggattttaaaatataagaaattcaaatatttttttttcaggtagttaatgattttaactgaaaaagtcatcaacaacaaagttgtataacttattaagatatacaacttttgttttggtcattttgctatatgactttgtttcaataaattaaatttgaattttaaattataacaacatcaaacaacattttcaaataataaatgatttcaactgaaaaagtcatcaacaacaaaattgtatagctcatcaatatctgcaacttttgttttggtcattttgctatatgactttgtttcaatatatttgaatttgaatttcaaattatgacaacttcaaacaacattttcaaatattagatgattttaactgaaaaagtcatcagtaacaaagttatataacttttattttggtcatttcttaatccagcaaactgatagtaatattattcacaaattttacacatctcttatgtggttttataaactataagagagatgtaattttcgtgaacaatgttactatcactttatcggataaagaaatgatcaaaatataagttatagatattgatgagttatacaactttgttgttgacaacattttaagttgaaatcatctagtacttgaaaatgttgtttgaagttgtcataatttgaaattcaaattcaaattattgaaacaaagtcaaatagcaaaatgatcaaaacaaaagttgtagatattgataagttatacaactttgttgttgatgacattttcagttgaactcatttagtatttgaaaatattgtttgaagttgttataatttgaaattcaaattttatataggtcaatcaaacccaaatggagaaataaccaaaataaaattggtagatcttaataagttatacaaccttgtttttgacaactttttcacataagttcatttagtatgataaaattcgatttgaaattttaatagtttgaaattaattgagaggagagagccaaaatgaacttctggttggagggaggaggggaaggggcagcttggctgctgggccggcaagttgagtggcgcggcccatggaggagtagaggaggccttcacggctcgggccgaggtgggccgagggagaaaggagggagagggaaaaaggccgagcgggctggcggggatttgaataagactttgggacggattcggcccaaatgacaaaggagggtttgtttttagtttttatttttaataaactctattaattgtttttttcttaataaatatttcggtgctctgaaaattcaagtaaacatccaggacatattttagaccgatgagaatttatgaaaaatactttgtgccacattcaaattttttcttgcacgtattttagtgtttgccattttcttttaggattttacttaattatattattcattttagagaataatttttaatttgggtgaatttatccggatgtgacaattattttagggcgttacaaagggcagttcaagcattcatcattttaaaaagaaaaaaacttatgataaaccagcattgttaggaacttgtgacgtttgttggtaggtctcttatgacaaaataatattcgtcacaatgcaccattagactagtttatgacgatctgtatttgatcttagtgacgaccaccctatttttgtcactaaccagcaccaccccctatcaaacgtcataaaacgaaatggcatagtgacgaaaagcaccgtcgtcacgaggaattcgtcatagaagatcatatttcttgtagtgtggatgggcaataaaatttactttcaattctgacaaagctacgtagcaaggtagtacatggtcaggactatactagccaatttttgcgtgagctgcttaggtttgtgaacttcttccccttcatgcttattattctctttatatttgaggaatatctagacggtaccttgatgctctcaggcattcaaacatactttccttctcttccttgctcagggtgtagctagctggactcaagtaatggcttcctttcttcttcggttccgaatgatggccctcgcgttgttccttatgcttgagatcattatgtgcttcaaatgtatctttcgacttcctatatacacctgaagcccagcaggttgacgcaaaggttcttagtgaggtgcatcacatcgattgcgtgatgggcgtccaagagttcccaatagggtaactctcaaaaaatagacttcttccacatcgccgtgtgactatcttcgctctctataggttggctgccaagtccctttccaaatactactttcagatctttcaccatagcaaacacgacttttccattgcgatgtttaggcttagtacgatggtctgccttctattcgaagtgcctgcctttcttccgtatagagtggcttgcaaaaaggaatcgacaatggcccatgtacataactttcctacaatgttttagatatgtacttttagtttcatccatgcagtgggtgtgttaacaatggaattttgcattagattcagaaaagaaggaacaagatcaaagtggatttgatgaaggagcaagttgtatttgaggtctgactcaacatctactgggcatcgtatcggctggagacagaataaaagtttggcttagccgatatggcaagtggtcgataggatataaattgggcacggtttggggctagattggaataaccgtcattgccaattagagataggatatttatgtcaatttgttagagatttggtaagagaccaccatatggtcttgtttgtatcttatctttaggaaagtttgagtcgtgtctatcatggactaagtttgtacttggggtataaatatgaaccccaaaccattttaataagggaaacaatccaatacaacttcggcgcatcatcatccttttttgttctacttttcgtcaagttctcttgacaagaggtaactcgtctcgatggcttgcgctatcggggttactatgtcgttttagatgttttagtccttttatcataaccatctgctatcatatgtcttagttaatctagtcttagtatcttaattgaactctatcggctggtactcgttttagggttcttgctggtattggctaaatcgttttactatattagattaactaaggcattgtcacacccgaagtttttccccctttcccttagtttctaaatcattgctaaatcgtctatagaaaaaactctgttaaccaggaggaaaccttaaataacaatgtgtttaataatcaaaattgtcggggagaattttttttcgaattctctttgcttgaaatcactaacaggatgttcagtgaaatattcagagtagaggaagtactaatgttaatttaaaatgtcaggagttgaattaataattccttcccctctctcctttggtcgtgaaccgcccccggttcactctccctgttcgtggtacgctgtatccgccaatcccgttgctgccgcggtttcgttttgtataacgagccgagtcctattctttctcgggtcccgttcccttttcctttcccgaaacggcaaagcatctatttatttttcctttccctttttggtaccctattctattaggtttttccccttctccctctcccctagccgccgcacaccacctcctactccccatgtcatgcgcgccacctcctctctcccaatccgactccccttctctctcctttgccgagtaaattaaggcccacctaatccatcttaattccccctatataattattcatacccctctatttttcctatttttccctcggttgtgaaaccctagctgaccctagtcgccgctgccgccttgttgccgcgccgctgctagctgtcgccggtgagctcccattcgattccctcggcatggttgtttccgtagtttccgcttgatccgtctaacctaattaatcttgctttgatctagcgtcgccgtctctccgtgtgttgccgccggaccgtcgtcactgtctcctcctctccgatcatcttggtttggtgaggctcctaaccgtgatctcctggtttaggttttaattttcttagcgttgttattgtaaccctaatcatgtcgctcccaagccttgccaccgcctagcgtcgctgctgccgcagccgtgcgccgccagccatgccgccactgccgggtgccgtgcgtcgccgttgccgtgtgccgccctaccgcgccagccgccgctgctgccgcccgctgccgagtgctgcagccgagcgccgccgccgctgtcctgcgtcgccgtcgctgccttgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaagctctaaaaagtccttttccccccttcccctcttgggccggctcggcccagttccctccccctctctcctcctccccgcggcccacccggcctcctccccgcgcgcgcgccgctgacgggcgggcccgcccgccaccctcgctgacgggtggggcccacccgtcatccccttcctcccgccgctcccgccgctcgcccgtgccctagcgccgccgccgccgcgaatctcgccgcctcccgccgtccccgcgcgcaataaagaggggggaaatattccccacgattccctctctctttccccccgtttttccctctctctctccctcggattcgcttggattcactcccgcaaacctcgccggcgccatcaatggcggccggatcctccgcgccggtttccatctcctccggccgccttccctcactcccaaccctatttaaaccacccccgtgccctcctccaccgtttccgccactcgccgcctctcctccccatcggaatcgagcccgcgccgtcgcaccctctctccgccgtcgccgccgagctccggtcagccgccgtcgtcgctccggaccgtctcccgccccgacgccgcctccttcggcttcgccgcgtccccgccgacctcggccacccctccgcttcgctcgccgaccgccggaacgtcgtcgaccccgtcgacccgacccgcgccgttgccttcctccgctccggccgccgttttcgtcgtcgccgtcaactcggggtgagccgtggaccgccgttcgttttcccctttccctcccctccctcggccgctgctccgccgtgccggtggtcgccggcggcgaccatcggggcgagggcgccgcctcccgccggtcgcgccgcaatggccgcccctcccccgggcgcaccgagcggctgccacgtggggcccggccgtcagccgcccgcgccctcgggtgcggctgacgcctggggcccacggcgccggtcggcgtgatccgcgtgcgcccggtccaccgtggaccgtgaggctgccgcgtgggccccactcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgatttgtttctgcttgttatatggagtttattagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttatgaaattattttgatttaaattattgcattatcgctttatttaaattcccgcgttatcactgttttatttagccatgcctatttacctttgttatgaccttattattattgttattgttattattaccttgttcaccctagaataaacaaaacccccaactagtggacactctacttgtggtatcactagtatgattttaggtagatgcttcgctaattaattaggtaacattaggtggttttaaaactctagactgtggtaatattcatatcacttggacactggaattgttggattattgtggaattggattcaccccgccccctctattcaaaactctcaaaatggttttaggctgggctcggggtgcatggttttgatagtcgcacctcggccatataaggaccggtcttcgggcctctattgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctatataccgtggtggtatgtggcacgtgggtatacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaagacaggttcgtgtgggttcacggccttgtttaataatatggtacggctctaggatcgtgtttacaacatagttttgagcaactaagtgtcttttaatgctatttactgcaactcctaacccctatattataattccattgtactcctttgcaattacgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttctccgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccattgggttatttccggtcgtgacatgcctagccactgtttgtcgctcggtagttgagttgcctagctgcagtcgtaaacccgagtctctaccggcctattgtttgccgtaccgggccattgccgcaaaccaagttaagtctactggtcatgtcgcagccattcgctagccgctaatcgttcgttcgcacgaagtatagtccaaagcctcgttcgttcggtcatcccgagtcgttctttagtaatagagtcattctaagccaccggttccgttcgttggtttggttgaccgtttgagtggtcccatgtcacggtgggttgactcgttgagttgataacccatggggcttgattactgttgttatatttccattgatctatttcgcctttgggcattaatatgtaataattaataaggtttttcggttaatagtaattacacagctcatattctaaaattcatatctaaattatccaagctccgttttaacccattcaagttgtagtgaattctttaaaaagtatagaatccattaaaattggtttcttttgctgtttcaatagacttattggatgtatattattgtatgctttgtttgtcatttagattctggcagttccgatgctccagtttatttcgaagtggttgccgaggttccgtcagctcaagagcaaggcaagtcatacatacaacattgatcatgttgaacctattttataaaatcccctgatttctattaaatcgcattgtgtttagaatgtcatgtgtgatggatacctatcgtacgcagcctgttgataccttatgccattgatagcttgggatataattgattagatgattggtttagggatgcttagaccaattagctcacaatgggattcattataatttagtccttaattatatgatgatgtaccaccatggttatggtttaattaaactaaaatatgctttaatggtgggttgtgggtgtatggttttggaaagtcgtgcccatgacaattatggaccggttctcgggaatccctggaagatataatcgtacttaccacaggccagcgtgggctccaggctaaatctagagtacaacttaacctagctgacataccatggcaagggtagaggcgatggtgcagtttggacttggctctagtctctgctgttttcggatttacctaggcacgagaggggactgccgggcttttctaaaaaggagggggtgaaacctaaggtggttatgttcggttagggagggttatatgaagggttttgtcacgatgtcccccgttgcagtatcacggtggtacttcggggcatggtaacatgtgtggaatcgtgtcttctgggtaaagttgtacacctctgatcagagttaaaactattcgaatagccgtgcccgcagttattgggcggtcaaccagctcaccatgagtagtctcatctttaaataatatgacttaatgaactggtgtagttcaggtggtttggttgggcctgttgcaacgtggtttagtgttgggtagtgatatttaatattgcttaattacaattattgttttactgtattcaaattatggtttataaatgctgcttttattgcaaatatcatataaccattcctttgtgaatatcttgcatcataccttcccgttggtgtgacttgttgagtacggtggttggtactcagtcttgctttattttttccaaccccagaggcagagagtggctgagatggtgagttctatgaggattgagcttgttccggacgttgaggatgcctgtggtttacggaagatgctacgctttttgtcgtgaagattaagtttaggttatttttttatttctgttgtgtatcaacttgtcgtttgtgtaccctggctggtcctagacagagattataataaacattctgcttgaaattcgggtagtgaatttctgagcgtgacatgtagctatcatcttgaaaagtaattaattccttaattgtttagactttaggtttctttacctactttgagatgcatcatccctagtcttgtctagaaccctagaaactaacctgaaattaattataattagagatagtatcagagtcttacctaatatacatgctacttttacatgttttatgtgtatttgccacttatatagatagatcaccatatataaatacatcaagtctagatcaataatcagctaggttatcaaacctggtaattgatctatatttgatatatttctataaatttatttgtttatataagtttgtactagactattagttagtccattatctttatttacctatcttgctctaaatattgttccatcggctattctcatgatatcgtcttaaatctatattatcaaactaagcagatgatatttagggttttatattcattgatctactcagtctatagccgatttggtctaaccacatcggctgagaccatcaatgatacgtcatcggcctatcgaccaatcggctatcggctaactcacattgtttcttgtttccttgctggttgcaggatgaaaccagctggcacgcccttggagcactcgaggaaagccttggacctgcactggagttaggcagatctcacaggccgccgtgttttccgtcaacaggtacaagccttataccccgtgtttgactgttcggataggttgctaactgcaggccaatcgttaatggtaacgaacaacaacgcttgtaggttgaattgcttctatttgacctcatcccacatgaggacacattctttcttccacagcagtttcggatcgtcaaccaatggtcttaggtactcatcaggccaggtgctatggctgttgctcatctcttccaaatagattcatgtcatccatacttaaaccgaaccttacgtttcatgcatcctctccgaagtcttcaaatgttccgtcggtggggtgtctcagcaccctgtcttgttaacattattttgcatgccagcgcatcattctagcatgcgatttgttcctgaaccaacgcccgagccatggtattatagggaaataccacatcaccatagcaagaactcacttcttcgaaggatgtctgttaacatcacctgg

SEQ ID NO: 58987 - DNA, 1234 bp, Oryza sativa
ctatagggcgaattcgagctcggtacccaaataaaataatgcaggattggaacatcttcagatgtggagttttgtgcaagatattacaatcattgtgatgttgtcaaagtcgtccaaatacttgcctcttcagatgcatatacagatatatgtaggagaatgacagagtactggagtcatctacttgatatatttcagaatgagagatcaaaaataagtaaagaggttggtagaagccttatgtcacagtccaatattctatcgaccgctactccagtgaaagcaaataatggaagtgttcaggcaactttgaaagatggtcaggacagtaagatggcagtgctttcccagacaaatgcacatcaggttatggataatcaatttacgttgtgctcagctaacaataatgaagcttttaggcaaactccattagctaagacctatgtagataatgcatacagaaatggagcttttgggcccagtgggacatcctcaatttctcaccagagcatgtctatggtgacagttatgcctaacagaacacaagcacagccagcacatggattgattcgtccagacttgtcgtgtggttcagtaattggtaatggtatgtctagagaaaatatcaggagctctatttctgctagggcagacttgatcagcccaccttataaaagcaagccccctgttcagctaattactgaaaatatgagtggtggcaagccagctaaattctcatcttttagaccacaggcttacatgaatctatacaatcacgggaatgttgcagcatctgctgctgccaatctagctgttcttaaatctgatgaaggtaaggctccaacttcccatctgacaacaaaccaaaggaagaaactggctgctgactgtgctctacaagtgaaagcattttcctcagcagccttacaatttgtttggccaagtactgaaaagaaggttatggaagtcccaagagatagatgtggttggtgccttgcctgtcaaagttcagcaggtggaactaaaaaagcttgttttcttaacatggccactgcaaatgcttctaaaggatctgctcgaattcttagtggcatgcgtttaatcaagaattctgatagccatttccccagcattgttacttatttaagccacatggaggaaagtttgcgtggccttttagttggttcactacaagatgtgcagcggagacaacagtggtataatcaactaaaag

SEQ ID NO: 58988 - DNA, 608 bp, Oryza sativa
agtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaaga

SEQ ID NO: 58989 - DNA, 730 bp, Oryza sativa
tataggccaattcgagctcggtacccataaaaaattttatgatatatatagacactaattaattttacttgcaaaacaaatacatccatatattaaatcttaacatgtctggtaattatcgaaaaataaagttgatcaaatttgtaccttggaactaatatcactaccttaatgaagaatagaatcgcatcatatccattatttctcatgaaaagatacttctcgagcatttcttgatgcaaaatcatcaagaacaagtcgacgatgttgtgcgcttgtgcggttgtgccctgtgcgatgcgatgtcgtctgccgagttgccgacgacgctacaactcctatcgtctctcggacgtttctgcttccagatagacaataggcaggtactagactactagtattaggtgttggcccctccaccatcataggcccccgaccatcatgggcccccggcggtcgcctcggctgcatagccctagggccggccctgatcgtagcaaggtacactcacgaacaacagtagaggagagcaaaaaggccacgcgttttttttaagaaaaatgatgacactgaaacgcacgtatgactcgctcaccgggcttggaaaatttggagtgagcacaacaggcgtggcggacctctcagtagacctctcgcgaatacttgctacagtaaagttttccacttccctactcctctctctttcctccggcctaaggtggcttctcgc

SEQ ID NO: 58990 - DNA, 16708 bp, Oryza sativa
gggatgacgggtgggccccacccgtcagcgagggtggcgggcgggcccgcccgtcagcggcgcgcgcgcggggagaaggcccgggtggcccgcggggagaaggagagagggggagggaactgggccgagccggcccaagaggggaaggggggaaaaggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgctacaaggcagcgacggcgacgcaggacagcggcggcggcgctcggctgcagcactcggcagcgggcggcagcagcggcggctggcgcggtagggcggcacacggccacggcgacgcacggcacccggcagtggcggcatggctggcggcgcacggctgcggcagcagcgacgctaggcggtgtcaaggcttgggagcgacatgattagggttacaatatcaacgctaagagaattaaaacctaaaccagaagatcacggttagaagcctcacctaaccaagatgatcggagaggaggagtcagttacgccggtccggcggcaacacacggagagacgtgtgccccttgttcagtgatggattattgctaaatggccagtgatgaatgctcaataacattatgtctagacttgttcatttttttatgtacacttgtccttttttttttgatgaattgctgcccctgctgcccctgtgccccttgttcagtgatggattattgctaaatggccagtgatgaatgctcaataacattctgtctagacttgttcttttttttatgcataagaacagattatctacacttgttcttttcttatgcataagaacagattatcaacacttgtcctttttttatgcataagaacagattatctacacttgttctttttttatgcataagaacagattatctacacttgtccttttttttatgcataacaacagattatctatgattgttcttttttctggattgataagagactatatacactttgggtctttttcatcctagtagttgatttcctctttttttcccttcatgcaaatagtggtaattgatgcataatttctgagcaaaaccgaggccatatctttcatggtatataatgctaattagtataatgatagaaaatttataagctttttcggaaaaattagaccatgacaacgcccggcgcaaacccgtcttccctgacacctgcgaggatacaggaagaagcaaacccagccacagagactgttgccgaaggtcatccctcgacaacggcggtcgaacaacccgaaagtcatggtaatttataggataaattttcactacatgaccacataaattttagctagcaccccttagcatatgttgccttctgtgtgctgcagaatcgccccagcaagaacatacgtcaatatcgggtgggacaagtacgagtaaatcgagtagaaaccccccggacacaaaatatatggccgaccacagcgcaagttataagagaggttgacgctagtggtaggcccacggcgccgaggactgtcattggaagatggtctaactgctacgggctggcggcacgtgtgaatttcgggatcctccataaagatatcggcaaggtcacagaagccgagaaggagcgagcttggacggcaatggagaaatggctcacatttaaggctaaagcaaaggataggctcaagcggaagtcattccataagatgggcaaagcttggaagaattggaagtcgaagctcttcaccgagtttgtcaacccgcccggcaatcatacgccgttcgatgtttaccctcaaataaccgaagaggtgtgggaagaattttgctctctgaagaacacccaagagtttagggaatcaagcgagaaacatcaccaactgcaacagcggaatgagcacccgcatcggctgggcaccgcagggtacatcggcaaggagccaatatgggcccaagaggatgctgccactgcagcagcgaatgtccctgccccgttttcggacatccctgaacacagagctcgcaactgggcgcgggcaaggggtaaggtcaacccggacggctctgtcacatttcagaacaaaagtgatgtcgtcgtctatcaggaattggtgagttcactacttaacctaactaattaccattcgtatgaagtagaagtttgtataaacgactcttgttgtttatagttggggttggttggtgaacaagcttcacaaagcgaggttgagtccgtgccgaagaggcgcgaagatgacatcctcacaaaggcgctcggaaccaaagaacatactggccggactcggggaattggcagcgatgtgccctgaaagcacggactctcgcagtacaactcccaatacaggaaacggaaagtctccaacgaagagagggacgctcgtttcaaggccgagcttaaggtggaggtcattcaagaactacaagctagcatggaagatagggtggaagaaagggttaacaacgtcctcgccgacatgaatataccccgaggcacaacacctgctgtgcatccaactcctcgtgcacaacacgacgcgagtctgtcatagcgtaggagtagttgtgcatccacagaggtgccggccccaggtctcccgatcgcaccactagctgcagtggaccacatagaggtaattgatgttatccgatccatatctaatcaaaaacatttacacattccaatattaaattcaaacttttacatatgcagggcgtagcacagtgtgtcctactggcgaggatccaccaactttcgctcctgaagtcgctgagggcatggctttcaaaccctcggttacagataaggtccacggcgcagacctgctagccgggtatgccaaggtgtccatcgatacagtaaaggacacctggtcaggctatcggttgcccatgccccccaatgatgaaatcatgactttgggcgttgggcgcaagacgttcatacaatggcccaaagaagacatagttgtgaagatgacttctcgtccaaatcgaccgacggagcttacacctcccaaatctaagctatcaattgaggctccccgtggaccggcattgtcagtacctccttctcctgatggagatgatatggacttgggagatataactcaaagcttggctccaataaagaccacaagaaaggccgatagctccccaccacttgtgaagggccagaagcgtgaacgcgtcaaggggaaggtcggggagttagcaccggtgccaaaaaggggcaaggctgcgacgtcgatgccggagagcaaagcggggaaggtcgtgagggcgcctgcccaatttgagctaggcatgccattggtgaaggacaatgtgttagccgtgatgggtattacttgccgagagctacataagcaatacatggagctaagcaatgcctagcgaaaaatgagggagtcatccatagttggacatcacaaccaccagccgttcctatcgtcgcctgcctatgtaactataggctttgatgacctctccaaccttttcaggatccggaagttggacacaggacttctaaaatgctactccttgtaagtgctgaccttccatacttgtgatatgattggactatatctcctaattaaattagttctaatacgtaaatgtttttaggttgtgttggatcgagagtcgttgccatggtaaataggttgggttccttgatccatccatggtgaacgaggtcaatttacgccagagcttcactgatgtggttgactatgtcaaccgatgtttatgggcccaccaagacaaggagtacatcatgtgcgcacacaaccaggaataagaggataatacccttcgtgtatattgtttttgaagttaaggttcttattactaacgctacataaccactgcgcaggcgacattggattctcttagtcatcgtacctaagtggagtagggtttactaccttaactccaataagacgaaagattatgatttcactgatatcaccaaggccttaaatatggcttgggacccatatgtggaaaagggtggtaggcacaaggagggcaaggacgaactctattatgacactaagtttgcatgcgcacaacagatcagagaccagtgtggtttccacgtgtgcacaacatgtcaacactactaagagaggtgaaagatttcgaccctgagattgttactaatggcgaataagctcatttcaataccaatattgctattctaaatgtgaaaacatctgatttattaaacagaaaggtagagctggcttcaagatctcacccatcaacccccccgctatcagaggcgaagtgtgcgccttcattcttgcagaaataatgaacaagaaatgacgttttcacgtcaaatagactcatgaacttggctagataatttattgtgatataaaaaaattgtttttattatggagtgcaatgtaatttactttcatatgtgcaatatttatggtagttcgctaatttgtcatcaaatttgatcaactacgatttatgttgtactattcatttgttttctgctttttttttctaattgacaggtcatggaggtcgaggacattatgactttaatccatttggtaagtatatatgcggttctatgagcaacgaccgaaattatagctttcaatgggtataaatttgatgtgcaaaattgtggcatttgaactgcatatgtgaatgatgtcaatttttaggatggatctgtgatgttatattgggggtgactggaatatatctgtgatgtttctgtttttcagaaggcatggctagcaaatcctgaggctagccaatatttaggatttattttttttctgtgattaactcatcagtgacgggtcggaaccaaaatccgtcacaggtgacctcacatgtgacggactcgcaaataaaggcccgtcagtggtgacctacctgtgacgggcctttactttcggggccgtcacaggtagatcacctgtgacaacttctatctacggagaccatcacctctgacggcctttatttaaagggccatcagaggtaaatcacctgtgacgggtcctaactggccctaggctagcggagaccaacacctctgacggctgtctagtaacttgcccgtcagaggtgggtgtcacctgtgacggccgaccacccgtcaaaggtgactggactcaccagtgaccactgatcactgaccatgctcaaagccgtcaaaggtgagggtttgggcccgtcacaggtgaccttggccagtgtagtgtctgcccgaggaagtagcggtcggcttctccgcggtcaccgacgcctgcatcgagttgcatcatgatcaggtgctgtcctggtcgttcatctccactctagaaccagccacaaactcaactaaaattttccaccctgtcacatcgaacgtttgcacagaagtattaaatgtagactaaaaaaataactaactgcacagattgtgactaatttgcgagatgaatctattaagcctaattgctccatgatttgacaatgtggtgctaaagtaaacatttgctaatgacggattaattaggcttaataaattcgtctcgcaatttacatgcggattccgtaatttgttttgttattagactacgtttaatacttcaaatgtgtgtccgtatattcgatgtgacacgacgaaatttttcacccgtggatctaagcccaaatctcgcgaccattgcagctttgacagacacctcctcttggccagataggtagtacaaaataattaattactactccctctgtcctataatataagggattttgagtttttgcttgcaacgtttaaccactcgtcttattcaaaaaaattttgaacttattatttattttatttgtgacttactttattatttacagtactttaagcacaacttttcgttatttatatttgcaaaaaaaatttaaataagacgagtggtcagatgttgcaataaaaactcaaaatcccttatattgtgagacggagggagtagcaaatgacgatgataatcttagtattatactcattttgttcaacttggttgattaacagatacaggatcatcctaggtctcggctctgcgctacgctatctccacacggagtgggatcaatgcatatatattgcacggcgacatcaagccaagcaacattcttcttgactctttcaggcagcaccaagctggaggattttcggctggcaaggctcgtcgactatggcgccgacccacggactacgcaggttgttatgggcaccacagggtatattgaccaagcatcgagcttgacgtctacagctttggtgtcgtcatcctggaggtagtctctctggccgctggccggagatggagcagacggaccaggttatcccgctactacagtggatttgggatctgtacgatcgggacgcagtcacggatgtgtacaatcgcagtacgatcgtagacacgaagctagctgcaggaggttggccgagagtgtggcaccgtagaccgtgactgcgattggcagctccagcgtacggtcaccgtcgggctcgagtgaacggccgtccattacgagagccatgaacgtgctgcaatcagacgatgtgactctgcaggtcctgcaacggcggcagacttcgtgtcccgacgatttttgcagattgcatagcggcggcgactggttgtcatcagctactactagcacgggcaggtgacacacgtgtaatgtagggacctgggctagataagtactcctccgttttttaatatacgccgccgttgactttttctcacatgtttaaccattcgtcttatttaaaaaatttatgcaaatgtataagatataaatcacacttaaagtactatgagtgataaaacaactcataataaaataaattataattatataaattttttgaataagacgaatggtcaaacatgtgagaaaaagtcaatggcgttatctattaaaaaacggaggtagtactagatagccagctgccagcacttgcacattctaattttattggcaactatacatttgtgacgccatttttttactaaaaataatctattcgtttttactttacgcttacactgtaaatttcagtagttatatgctataaattttctaatacacattacacataagaattatgatagtaaatcaatccaatatgggatataacatattctactattacgaatgtgttaaagagctagtgttattcaaacttcagagctgtacaggctaacgagtaggattctaatcgactaagggtgtgtgtttagttatttcggtgtaaagttcttaaagtatacggacacacattcgaagtattaaatgtagactaataataaaataaattacaagttccgcctgtaaactgtgagacgaatttattaagcacaattaatccatcattagcaattttttactgtaacatcacattttcaaatcatggcgtaattaggctcaaaagatttgtctcgtaatttacatgcaaactgtgcaattggtttcttttttcttacatttaatgccccatgcataggtccaatcatttgacgtgacattttttgccaaaatgtttcaggatctaaactaggcctaaactaggcctaagtaaatagttattaaaaaaattgaccaaatagattaatgtgtaatatatcacttgacaaatttgcaagttcaaaatcgacttctataaattgtaacaaaaatgacaaattaaactctaactagtataagtatatttatagtcaaatctgttattttgttacaaattccagtagttgaatttaaacttacattacatgtttgtagagtgatatattattattagtattctatattgtcatttaaagaaaaacataaccaattagttcatatgcaatgaacaagtactccaaatttgaattcttttgatactgcttgttatcactacttggacctggaccattttgttcggtcttgtaagatgtaggttagatgcaatatgtgttttgaattgggccacattaggtagttttgctctcaagcttgttctaaatgggccttttctgttacatcctgattttcgttttaggatttataaattatatttataatttatattaaatgttcattaatttacaagtgaagttagatgtgggaaataaaattttctaaatataaagcatgattggatttaatttttattaaattctccatgattaattatactctctgaaattttctcggatttttcagagctcaattcttaattttaataatacaaagagcatttcagaaattatttaaatattaagttagtaattaaatggtttgattataatcttgttaagtactttgagtgttcaattagtttcaggatttttcttgaaattatttgagcattggaaatattttaacaattcgaagatcattaatttaattacaaaagtaaattaaatccccttttccttttcgggctgaaactggaaaagttcacctttagttctcggcccattctcccttcctttcagctgcctttattcctcctccgaagtccatttcttgtccctccttcaatcgggctggataaaagaagcccagacaaagtctaattagccttcctgctacagtatcgtcttcaagcttggacagagcccgtgcagccgccgagccgtgtgtgccgctgccgattcctccgcccgatttgctcgattctctcagccgtttcttgaattagttgaggagatttgtttcccttatcctcctctatcttttcccccaaaaatcctattttatccctttgaattcgacgcgaatttggattcgttttcgagtttatctctccttttcccggcgcgattccatccgttcccgagccgatctctccctcttccggctataaatagcagctcctaaacctcctctttcgttttccaccctcgcccgagctcgccgtcgcccgtagcgccctagccgcctccaccctagcgccgccgccatcgccgtcgccgagtctccagccgtgccgctcgtcgccgtccatcgttgccttcggtcgccgtcgccaccaccgggttcgcaaggaggagctgcacaccgtccacccctcggtcgaagccgaagcctgccggagcgccactgacgccgtcaacccgagcccgtcgccgcctcaatctcgtcgccggccgttttccgtcatcgattgtcgtcgccgtcaccatcagtgagttcctctcgtcgtcctcatcgcgtagatgtcctcggttggcccggccgagtcctccatcgccggcggtcatgtggtccagtgccttgttccggcaatgatgtcatgccgacgtcataaagcccctttttcccttctaaaaataaatcttaattgtgtcataaatcgtaaatccttttccgtataaggctaaaatcagtttaatattgtaaaattcataactaattcatatgaagtcggaatgaggccgttcaagtctctaaattcatctaaaatcatgatctacatgtttgtttactttttatgtactgtttatttagtttttattagtctttttcttcgttttgtgtgttagcttgtcgtttccgtcgttgcgaaggttcgtgagtgcgtcggaagtgtttaagaagactaattgaagaccgattattgcaaggcaagtcacacagatcccaaacataatcctttgaacatgttgatctcatatttaaattctctatttatttcaactgtgcatttattttcaaatgtcaacgggtggtgtgaacctattcctttgttatggccaatttgcattgaataccctattacttgataccttgggtaataaattgattagcttgaaccttatatattggtttggtttagctaaatgctatatatatatatatatatatatatatatatatatataattgcttagccatgcttataaacattagcatatgattgggataactaatgttacactaccacttatgattatatttaatggtagctcacgatggtcaatcgtgattggttaattaattacgtgccaactaaaacttgacaatggtgggttgtgagcacatggttttgaaggtcgtgctcataacaattaaggatcggttcgcgagctactgttatgagacattaaccgtgccaaccacaagccagcgtgggcaacggctttagcttttgtatagtatggttcattgcggggcaccagactgtgaagcggcgagaagtccgtgggggtcgctggggagtccatgcctctggttttttgtttttgagggggtgattatgatctaggaatggtgcgctgtgtggattatgttgtgcgaggggtattgtcacagtcccgtttcgaggtaccgtggtggtactgagggcatggtaacatgttttggggctgtgtcttgtgagtacagtggtacacctctggccagagtaatatttttcgtgattagtctcacacctctcacaataattattgatgctataactggtaataatttgcttagctcctggtttggagttagatctgtacagccgggtatggttgttcaggatggttgggcctgtgcagcatggctgtgctgttcagtgttgattaatattgatgattaattactctactgttttactacttctaaatgtttgctaaatgctgcttttgcaaatagtctatattatgcgatcctttggtatttttgtgcacttgcatatttgttgtgtggcttgcggagtattccatgttttcaccttgcaataatcaatcaacctcagttgaacaaaaaggatctagaaagagaagacgtttggcttataccccagttgagctgcctgtgggagtggagctgaagccatcgctagaccgttttttccgctgcagtttttttctttacttttgtaagtatgtaacgttatcattatgatggatttgtatattaaattgtcagtttgtgtacctcggctaattcctggacgaggcttttatgcacaaataagttcaaaaattactagtgaatttctgggcatgacattttctaaacctaagcccactagcacggagaagggaggttgttattggttaataaatctgctgggtctcagaataaatagtttgggtaaaagaaaagctcccctcttctcctagtgtctcttctcctcctcctgcaatagcaaaaccccaatccaatctcacctgatcgccggtgaatgctgttatggcgaataccaacgctactgtagaagttatctttgccgggatggcgaaaatcacactagtcccggtcaaataggaactgggactaaagaacatttttagttggataaaaaagggcaatggagctttatgatttttagtcctgattggtgttaccaaccggattaaagacagccggggctaaagataaaaacatttttatacttcttcttcctcctccagcccgagccattgctacaaaggtttggaggaagaagggaggtgctaccaaatttttttgtgaaagtgtttcggtgataatatacaaatcgaaggaatctaaaaggttagcaactccatcctctgataatgtatgcttagtatattacatttatagttatggttatatacattattgtctctgaaaaggtttatggaaaatgacaagagagaaaatttgttaggataaaaataggttacttttaaaattagaaacatgtggataaaaatgttataaaatagatgacaaaggaaaaatatagaaaattaagataaaagaatagaaaacaaagttaatttaataaaatagttagaaaaagtacaatacattaaacatatcattagaactttaaaaataattaataatattaataatatgtgggattattgtatgattatttgtatatagttattgtatgattatttaattagcttgactttcgtggattttatttttacgatttttgtgcatttcaggtagatggatcggcaatggatgtacaccgcggaacgacggtcgacaaagtttattgaaggcttgcattattttttgagtgttgccaatgctaacaagcataagggttttacatgttgtccatacaaaaagtgcaaaaaccaaaagtagtattctacatcatgaactatttatgcccacttgtttcagtcgaggttaatgcctagctaaaattgttggacctcgcacgaaaagttaggggttgcgatggaggaagatgacgtaaaagacgagaacattccggactgggctcaatacggtggatttgatgaaaatacaacaaacgaggcggacgagtgttgacgaaaaatacgaggcctgagagatctgcttaactccagtgcaggtccaaaactcgccttcgggtatgctagcgtgccagttgatttgatcctgcaatcaacaagaaacaaagacaaagaaactgtagttaaatccataaacgatagccgatcggctgagtgccgatgacatatcatttatctttgggctgatgtcatatatgaatcgatcggcagtccttaataaataagaaagaactacatctactcgatcggctgtagatatcaccaatatataatcctgacgtcgatatatacttaaatcaagtgattgggatagatcggttgccatgccgagacagtataaatcacttagatcgaaatatgtactaacaacaagattatatatgttcatagcatagccgatcaaatagatctagcatgtatcggctaattctccgataccactctatattaagatattaaagcaagtagaatataccaaacagaagcctaatatacttaaatgcaataagatcttgacataaagggcagatttaatatgtcagtaaagcacataaagcaaatatagttaaactaggtaagatcggctgaaaccccgatactaccctaatcggcaaccagaagacagggtagagattgaaattctaagcacgacttaatagatcaaactcaactgatgcagtattaagtatgaaaagaagagcaatatctagacaatcaagtcgttggatgtttcatagagtggtggatatcttatataatccaagctaacgtcgctatttaacctaatcggacgccttctattaacagaagttagccgattgtaggttagatgacgatattatcgaagattatataagatatatgataactcgacgaattacataaacaagattagagtgtcataaagatggaagcactaatcccgagaacgcaagccgccataacaagatttacctcttgttgaagatcgaaaccgatgcagctcaacccgaaagcaagaactcgccgaaataaaacgaaagcaaaaagggtggcgatgcgccgaaattgtattgaacgtgtgttagtttgattacatgaggttcggggctatttatacccgagaattacaaaacatgcccataccggacacgactcttatctctaacaaactctaagataccacaagtatttacggcagacttttgcccaagcatatctctaatgaaattacataaaatatcctaattagtagatacaattgccttcccaggactccatccatgtgtggcaatcatcttgaagcacttcaacccaacccgatgttgtacaccaagtcgtattgtcagaatcggctgcatcacctaaccaagtctgactccaactcagccgatccaatcgtagccgatccggactccagccgattcttactctgtttctgcgacaatcttcatcttcgatttcgcttcaatctagtcttcatctccgatactgatattaccaaatttggtcgttaacacatgccccccaagtccggaatattcgataatgtttcggatttgccgcatatcgactccgagcaagtttcgcactccgccgttttccgaccgttatcctccgtgctttaaatactaaccgccaccctgaaaaatctttaccccgttacttccgttttcaccgccgaagcaaaccccgtcctctctctctccggcgatttcctcggtgcgcgaggcgatccccaagcgacttcatctccggttagatctccgcccgcgacgatgtcttcttccgccagcccgtctaccgcaccgtcagctgagtacgctgaggtaagttcccgtcggctagatcccctttctcagcatcagattgatcttccaacacttcatcttgttttccccttcttggttcttttggatttgtagcatctttccaacctagttgcaattcccagcctgtcgcacgaaaattattactttctcggcccagtcggcaaccctgatcccaccgagttcattattggcgaaaccaataggattactttcggattgaccaacccagatttaggtcactagaaaaacactttcaaatcctggccatcccttgagaaaacctcacccgagaaaagttggatcacatggttcaagcgcatgtcggctagcaaaagatttcattgggatgaaattggaatcggccaagcacttgatctcaccatagccaactcagctaaagacgagcccctaatggcagctgcctcctatttttggtccaacaaacaccatcaatgccttcttgttcaatcaagggccgatgactccaactctcatagatatcataatgattacgggtctggatgtcacctcatcggctaaccctatgagcttgaacacgaagaaccaatatgacttttttaccaagagcataggcggctggtcaggctatgtagcggcatatatgggccaaggttctgtcactcctcgagaacatgtagcttttctgctaatgtggctagaaaaaatcctcttttgtggatcaagttgtggccctacaaccaactggcagttcgcagccaaagccttggagacaaagagacaatttcctttaggcaaaatcctcctcggctatttgtaccaaatgctaaacaatacatcggctaagttggccgtcggctcagtagtcggagcaggtggaccatggtggctattacagtcttggctgaatctagtagttatgaagtttgtcaatcggccatctgtaacagaagccgaattcccaagactggaaccgactgtagatgatgatggagaagaacgcactcatcgtagatgcacattttacggagaatatacctccacaccaaccgatgcaggagcaaagctatcggctgaactgctcaaggactggttctgtagtttttatgagggtttccaaaaagacactcgagtttggttcctctacgaagattcaacacttctggagaatccattggactttaggttcgaagatatcaatcatgaaagatatcagaaacccagagaaatcttttcagctgcaatcagtccatgtatcctccctgttggcattcatcatggatgaaacatccaagtttcttatgtgttttatcacccaatgagctcaaccagacaactaggaatgggccaactcccaatcggcttattctttgctgataagatccagtgccgaggggaaatttcatcaaccttaatgatggatcggctgcttaatctccaaggaccccctctaggcagcattgacaacatagagctggcaaccttcaggagcaaagcatttgacagatggtggggtgagtggaaactacacctattccatcaatcggcttctatgtatatgacagacctctttccagatgttgtccctcaggtatgtcttgacttgcttaatttcatttgaataattgtttaaccgactaatcttgattaattttccttttaatttgtagacaacagagtcatctcctcctcactagagcaatagtggcagaaatattgagtatgccccggggctgattccaaagggggtggaccatctcctcctattattggttataatgcccccaggacttcaactctccttcaagggctcgtcagagaaccagccgatgccggtaaaaagagaagaaccagatcatcggctgtggacacatcggctccagccccaaagaagaaggttaaattaaagaagcacaagccaaccgatgatctgcctgccctggatctgtccatcgaacaagctctggacgaagaagagattgaagaggacattgatcaagcggcagccgaattgagtgatattggaggaaaaacaccgtcagcctcgcccaagcaaactcccccaactcctgttgcaccggctaacttctcaagggtaaacatctctccttaattaccttttgcagttatcctattcatagccgatcactcataaaacttgtttttgcagaaaaagaagactgctgtgagaaagaaatcggcagcgacaacacttaaaccagccccaccagtaagattcccttatataaattctttcactaatctgatcatggccgatatttattcaacactttgtctttttgcagcctcctcctccttcttcacctcctgtgcagcaaatgtcaagtgatcgaactccatcggctgcagggagtcacaatgtcgaggaagaggaacaacccgctgttcctaacatcccagtaaatgtc

SEQ ID NO: 58991 - DNA, 1323 bp, Oryza sativa
agcacaagatcacgtcataatcagtaagctaaaccaaccaaatcaccaagcactgtcaatgcaagtgtttgagcaacagcatgtaactgtcggttgcctcgagatgaagaactcacagaggccacaaggagagaagaggtggacttgtcgaagagcacaaaggcgtagctgccggtgagctgcgagagcatgaagctagcagggtaaggtgctctgtctctcagcgtcttgtacgcctcgataaccaggagcacctcattggcgcccttggacaggccatactgctggctcagcctgcccagattgtccaggactccctcaaacaggcagaaaatgtcatcttttgatgcaaaggatctgcacaaatgcagttgtatgttctcagtgagcagctgtaaaattatagatgctttccaaccctatgataaaaaaaaactggcatccacaacaaaatttaagaaaattagtatgtttggtgttatcagttcagccattcttgaatgcctgaaggacatggtacttcagtgcagaatgcaaaattaggtggaacatctatgacttaatgcaagatgcacctaacatcaagaattagatacctaaacttgctgaaaaggaagcatatattttgtactggtataatgaatggagtaaaggagtggaattccttggatgatacttcttcagtgaatctgcctagtagtactagataagatatgaaaaaagggtaatcaggccccacaaatcatagtgctgaattgacagcatggcccccttgttcagctttcctttctttcagatctgtgggtatcaaaaccggatagagtcttctggtaagcagtagccaccaagtgctaagtgtcctacactcctactatgaactaagccatgtgaatggcacaacaactaaaggaaaggcataaacaaagaggtttttaaaagcaacctagtagcttgccaaatactgtcatgtttatcctttttaagtttttataattaagaaataggcttgacaaaacaggtttgtccattttcttaaaactataattagtccaatcattagccgcctgatgaagaatatgaggcccgtttgttgtgaagtcaattgaaacctttgtatctgtggaaggtggcttgatgtggtaccatgcaaaataacaaaaggtgatgcggtggccttctttcatcgaaatatatgtggcaatgttcatgtaaacattgatttaactttctttcctgtcatgttctcctcttgtttttcctatggaagcaccaatcatttgaccgtaaagagatctaggggtaccgagctcgaattcgccctat

SEQ ID NO: 58992 - DNA, 725 bp, Oryza sativa
tttcgcccgcgattccctgtccaaacccacaccaccaatccgcatgacggattaattaggcttaataaattcgtctcgcgattttcaggtgagttatgaaattagttttttcattcgtgttcgaaaacttcttccgacatccggtcaaataaaatgtttgatgtgacatctaaattttttttcgcgaactaaaaaaaaggccctagtcactagtgtgggaggcgttgactggacttcgaagcatatgagatcaggataaaaacctttgctatatatattcctcatcagctgctgtaacggactgaatagaggaggctgctctactagcctagtagtagtactgtagtatagagataacttgcacgccgtctttagcgacgattggagcagtcgtgtttcagcttctggtgacgacgacgacactgtcagcagcagccccgaccccgatagccctgcctggttgcccggaaagctgcggcggcatacaagtgccgtaccctttcggcatcggcgacgggtgctcctaccatggcttcaacctcacatgcgacgacgaggcgcaccaccaccagacgccgcccaagctgttcatggccacagacaacggcaccgtcgtccaagtgctcaacatctccttgccggacggcactgtacgcgttcgcagcaagctttcgcagtcatctattgccagctcctcctcctcctcgtctaatgcctcgtcgtca

SEQ ID NO: 58993 - DNA, 6844 bp, Oryza sativa
tagccgctgccgctgcctatctccggccgcgcgccgctgttgctagagccgccgccgcgccgtgcagtcgccgccgtcgcgctcacggagcccacccgcacctctgccgccgcttggttgccgcgaatcaccgccggagctccgattccttcgcgccgccggtgagctcgccattgtttccatctccggccatttcttctcgccgtgccgcggctcttctcttctccctcaccccttcaccgccttttcccaggtcgcgctgctcccgtccgctgttttccgaagcgctgccgccgctcatcccctcccactccggtcgccgcccctccggtgacgactccctccccctcccttttctccccttcccgcgtgcgccgccgcctttggctgtgccgccgcctttggccgtgtcgccgctccagccgtccgccgccgcctttcgcgtcgtccgccgccgcctcccttcgccggtcgtcgccgtcggcagccgcgcacgccgccgccgctcgccatggccggtcggtcggctttgtgccgagccgagccgtgcctagccgccgcccgcgccgtccgatcggtctcgggccgatccggtgtcagtcccgtggaccggcggtggaccacctgcgtggtcccggtccacggtagaccggccaccttgtgccgctgccagtggagcccacttgcccgagccccctctccctgcccttgtgcgctgacaagcggagccctcctgtcggcgcagccgcccctccccccttggatgacgtcagccctgggatttacagcgcaataaattgattaaggactttttctttattagtaaaaacacagtttatcttctaaaattcatatgtaattcatccgagcttcgtttaagtccattcaagtctcagtaaattcataaaaatgcaaagaatccattaaaatgattttgtttcctgtttcagtagtcttatagcatgttttgcttgtgtgctttgtttgtcgcgtagatttcggccgtttcgtcgatccgcggtttctcgaagacgttgctgaggtctcatcagtgcgagagacaggcaagtcatgctttacatttgatcatattgtacccaatttacaaataccttgcatttctattaattgttgcactcttttacaatgtcatgtgggatgggtcctattactcagccatatatcgtttaccatatgccattgataactggggtatcaaaatgattagatgttggtttaggaaatgcttagccatgcttagttcaactagtacacaaaaggggatcacattattacatgagcatagttcaattttgactatgagcatagttctggttggtgccaccgcaatggtgttagttatttaaaatacactgaatggtgggttgtgcgtgcatggttttgctggtcgcacccatggcaattaaggaccggttcacgggaaacactgggagacttaccgtgcttaccacaagcgggagtgggtaactgcttgatctgaggtatagctcaaccctttcctaggcaccggtggcgagggtgggcgtgatggagttgggtcggccggggtgtccggttgtctagctgccggattcaccgcggcacaagaggggaccgcccactaccttttgaggggtgggggtgaaaccttagcatggtgtggatggttagggaagggttatgaggagggtcttgtcacgatttccccctttgcagtgtcatggtgatacttcggggcatggcgacatgtgtggaatcgtgtcttgtgggtacagttgtacacctctgccagagtaaaactattcgaatagccgtgcccgcggttatgggcgatcaaccagatttaccgtgattagtctcacccctagtttagcttaatgaactggtgtagttcaggtggttggttgggcctattgcaatgtggtgtagcgttggacaatgtttggttaatattgattaattactacaactgttttactgctttcaactactgtttttaaatgcctgctttgtgcaaagagcctttagcctccttcggttatatcctgcatcatacctcctcttccggtatgacttgctgaatacagttggtagtactcagtcttgctctcttttcccccacaccagagctgaagatcttcctagtgggaagtgtcttaccgaagttgatttcgtcgctgtcgtcaaggattacctgtggagtggagtcaccccgctgcagaagtcaagtttccaagtctagctcgtttttcttttctgctgcatttgtaatcatctccatttttgtaagacgtggatctgtatgtcaaaaattgtcgtttgtgtaccctggctggtcctagacagggatttaatgcacattcagcttcgaaattctggttcgtgaatttctgggcatgacacatgtcttcttggcactcagtccactcagtgacgaagtcggctaaagcttgggacttgatcgaagttcgcggcatgaaggatatatccagggacatcaattctaaggcccactttgctatccgcccatttgcttcacgattatgaagtatatccccgagtggaaacgatgtgaccaccgtgaccgagtgaccttggaagtagtgaggtaatttgctgacggtcattaaaacaccatataacagcttttgaacctgaggatatcttgtcttggagtcagccaaaaccttgctaacgaagtagattggtcgttggactttttgaacatggccttcttcttcacgctcaacaactaggactgtgcttacaacctgggaagttgccgacacgtataacaacagcggctcttgcggatgtggtgaagctaagactggtggagtagtgagaagttttttgaagtcttcaaaggctttttgtgcttcgggtccccactagaaattgtctgttttcttcaacagcttgaaaaagggcatccccggctcgccgagtcgtgaaacaaaccggttgagcgccgccatgcaaccggtcagcttttgaacatctttctaggagctcggcggtttcatgttgaggatggcattgattttctccgggttggcttgtatgcctctacgggacaccataaatccaagcagcttccctgacggtactccgaagatgcacttttgagggtttagtttcatcctgaaagcgcggatgcttgcaaaggtctcttctagatccgtaatcaaatcatccttctgcttggtcttgacgactagatcatccacataagcttcaacgttgcggtcgatttgagttgaaaaacatctttggatcatgcgttgataagttgctcctgcgttctttaatccaaacggcatggtgatgtagtagtaggccccgaagggcgtgatgaacgaagtctttaagcagtcggatctgatgatatcctgagtaccaatccactgagtagctcgcagccggccgttgagtcaactacctggtcaatgcgaggtaacgcaaagggatctttggggcaagacttgttgaggtcggtgtaatcaacacacatgcgccattgtcccgtcttcttccgaactaggactgggttggccagccagtcgggatgaaggacttccttgatgaagcctgctgctaacagcttggtcaattcctccttgatcgcatccttcctatcctgtgcaaaacggcggagtcgttgcttgattggtttagcgtcttccttaacaagtaaagagtgctcaatcaccactctaggaataccaggcatatcagatagtttccacgcaaataaatctttattattttgaagaaagatgatgagcgcgctttcctatttacaatctaactcagcgcctattacagcagtcttagtaggatcagaggaatctaggggaatcttcttggtcttggcgtcgccttctccgctctttggcatcttggttgcgggcacttctccttcgcttgctgtggacgtagccagtcggatttcttctcgggcgagcgtgatctcgcgggtctgggccatctcacagctttccttgtcgcatgtgacggcttgcttgatgtcactccgcagggatatgtctcctcgaggaccaggcatcttcatcatcatgtaggtatagtgcgggacagccatgaacttggctaacgccgggcgtccgagtatgacatgatgttctctgtacggaaattctcccgagtgctgaaagtaataggaagagtgtggccgagtggtgtaacaaatagccccgggatgactctgtgaaagggcgcattactcggctttaattccgtgcgagggatctgcatgtcgtccagggtcttggcgaaaaggaggttgagtgcactgccaccattgatgagggatctgcgaagcttgacgttgtgaaccaccgggtctagtaccagggggtaccgtcccgggtggaccactcggtctggatgatccgagcggtcaaacttaatcgttgtctctgaccaccgaagatattggggcgtgtcaggttgagcagcgttgatctccgttcggtcagcttttgctttctcttggattcataagccaggggtcaaccaaagatgtggttgagctccttgcgatggtcttggaaaccagtcagtgcatcatcttcaccatccttcttctttgacgtgctttgatctccgtcggaggctttatgtgcgttcttggcgtattgttctgcaaactgtttgtagacgaagcaatctttggccgcgtgattggaattgggatgatgcggacattgggagttcataatcttgtcaaaggtgttgacgtgcgaacgttgtcgggaggatggtgtagtagttgccacaagttcctcgggcttacgcttgcgatccttgtgattggtacttccactcccccctgtagtcggtgtatctttcttcggcttccaagtggtgcccgactgcttggacgtggtaatggcatcttcggctttggcatactcattggctttttcgaacatctgcttgaccgtcctgggaggcttgcgcccgaacttgccgactaggtctgtgtggcgaacgcccttggtgaaggcggcgatgatgacgtcgtcggtgatgtcggagatcttgttgcgttgctcggaaaagcgtcggatgtaatctcgaagggattctctagacttctgaatgacgttgtagagatcaaactgtgtaccagggcgttcaaaggtaccctggaagttggcgatgaagtggtcgcgaagttccgcccatgatccaattgtgccacagggtaacccgtgaagccaggaccgggcagaatccgctagggccacaggcaaataattcgccaattgcgagaccgtagacggtgagccaagactccgggttagtggtgccgtcatacttctcgattccaatcggcttgaagccggctggccaatccactcgacgcaggtcgcttgtgaaggcagcaactccatccacgtcgtcgtcgtagcgatctggagaatggtggggagcgtagcctcttgccgcgcggcgctggttgatagtatcgcgaagatcgacggggcgcctgcgatgtggggagtgtggtcattcaactcgatgctccctgtgtcgtttgggtggcgagtggatagatcgctcgtcgtgacccctactcctgcgagtagatcccgcgccgacgacgctgaggcttggttggtgatagtcttgagatcgaagatggggaactcggctgccagtcggcgtgtggacgcttgcggagttaatcgggaccaaggcggcgatcatggtcttggtctggttcaagatgttgacgacgtgattggcttgattgagcgcgtcttccttgaggaggatgtcgaggagggtgatcgctgcaaccgcgttctgttgggggggcggaaaaccgctgtcccctcgacgtcttgttgcccaataagttcctatgcttgtcgcccggcatccagggcacgttgtcgccagtcctcagcctcttttgcagcccgttcgcgttcctgtggctcacattgtagccgttctcgctcttatgcttggcgctcctcttccagtcggcgtcgttcggcttcctgttgtacacgtagttcttctgcttctcgggctttacgctcttcttccgtctcattgtcagccatgaagatgccgaagtagaggggtgtgtagttgtcttcaaagccttcgtcgaagtcgtcgaggttgcgtagtcgtagcggtagccgaagtcgtcgtactccacgatctccgatggtcgcgagtcgatgccgggggagctgaggtagccatccagttgttcgtcgaaaccgtgccgagaggctggagtatgacaccgacttccctggagctaggccgggccggggctaaagccggatcccacctaggcctacggggagaagacgcccttgtggtgaatacagcagccaaatcatcgggagtttcatcaggattggcggataggccccatcgtcttgatcgggtcgtgttgaagtagattggatcccgtccgagtggtttgaagccaactcggtggagatgatcttggggtagacctcggccgagttcgggataccgaactaggtggagatctggcctcttcccgactggtttgaatccgagtcgaggagagaaatcttgccgaagtcgttggtgatgaagtcgaggctgccgaattggaacgcctgcccgggagggaagacaaagtcgtcgatgccggaaacgaaacccatcgcactagtcggcgaagaacttgacgcttcccatacctggcgtgccaactgttgaaacaagatttcgacaatactaaaagggggtggctatcaggctggaaaagtggatgggtttaaagacaaggaattttatacaggttcaggccttctta

SEQ ID NO: 58994 - DNA, 1073 bp, Oryza sativa
aactattactgtaataacaaattttccaagaatctggatgaatagagaatatgcagagatcaatctgccatctaacataaagaaggaagtgatagttttgttcaaaataaacattaggatacatcactgatcatacaaaaagcccagccttgctggatccctccttgcgttgcaggccacttcctgtcttgtgtcagtctagttctggaaaattatcatgtttctatcttcacaaataatcaagatgctgttaaagtagatgtttgcaccattggcctctgacaccagcctatgaggcttgctacccaacagtcaacaatgcttcagtagatgaatggttgaacatgctgaaggaccttacaactaacaacactgaggacagtgaaccaggataagcaaaaaaaaaagtacaaattcctgtttttactttgtaaactacttgagttcgtgttgtaatgaagatatccatgtcccttgtccacctatcataacacaagaactaaaatagcaaaagctcatttcttgttagaaaagtttatatgttgttacactccagtataatgaaaatcaacttcagatgcaacacacaggtgcactgttggtcttctaaaattttatgggaatgctataagctgtacaagctgaaggttgaagttcagctgtgtaagctgaagtttggacggtccactagccatctatttttcagatatcattttagtctgcactgtcaaagattaattgccattcactctgagactgagtatactggctgtcagatgtgttccctatcatgtcgcaggtattattattgatttattggaaacatgtcttatttcttggagtacttaacaattttaataaacatttgtattaattggctgctggtcttatcaatatgctttgtgcttcacaaaataaacatcagaagaaaaaaaaatagctccatacagccacccgaatcggaattagccagctttgacatctacccaaaagtcacaatcagtcaagcacatactctagctaataaccaagcacaaaagtaaaggtgcgatgcactgcgagagctgaagcct

SEQ ID NO: 58995 - DNA, 4848 bp, Oryza sativa
agaaaaataataagaaaggcaaaaaatatgccttccaaaaaagaacataacatttccgtcataatctttacctatctatcaatctatctattctttctattatatactaaaaatccattaaacttcctacaaacgctcctaaatcgacatgtggcatcctataaacgctctcgagtcgccacacgtcactctattaaaatagagaaatctgactgtcgattttcctttaaattggtggactcattaattttgatggaccttatcgttagatttatcttaaaaggaaatcaaaatctcgatccatccgtccaacgcaagtatgatccctccgtagcgtacgtactatccatgtatccatctgacctcctccgtttcccctttgtgtgtgtacgcttttctttcacttctcatgccggcggagaagagaagaaaaaaaaacacgtacactatttgacaaaaagaaaatatgtacgtacccagtcacatacgaaaaatatagagaaaaaaacacacacacgtacgtacccccggaaaaagaaaaaaacataacatgtactccctccatttcagtctccatttcacaatgtaaaactttttagcattacctatatacatatagatgttaataaatctaaacacatatatatatctagattcattaacatctaaataaatatgagcaatgctagaaagtcttacattatgaaacggaggaagtatactattagacctgtgttttgaaaataaaaaaacccagttataaatagcactctcaaaaattactcactccatactgtaaaaaaaactaatatatcaaaatgaggttagtaaatttattatgtattattttttctttatttatatattattaggaattaaatatcaaatatattatttttacatcgtgtcgttgtcatttatctcctactttaaacctcgttcgatcaaagcttattgggtgagtttatttaggcactcagaataatgcaagtcattagcacaggtttaattgagtattaaatattaaaaagcgaaaataaatttagttgatctttctaaaaaaaacttttatataaaaagtatttgcaaaacatgcaccatataatatactgtttagcaatttcaggaaacatgtttagcaatttcgggaaacatgttaaatataaataagagagtagccaatccgataagcactttagaacacagtcttaaatttgttacttagggtactaaacatatgtcctcacttatctccatatataattctatatacaaaccattgtccacaaatcgctaaataatattacttacgagatatccatgcacaatgcaccgaacgatagctgatatatgagcacgtgtgtcatccagcaccgaagataaagggtgatactaagtgcgcaaccatcaacaaattataggtaaatagaatataaaaacaatatactataaacaaagttgactacaagtacattacacctatgagtaatactattcctacacttctacagatactcctaagatgccacgtgatgctctaataaattagagagaatctatgaaaaattatataaaaaggtaaaatatttatccatcagtttacaattaaatcaatgatccattattttcaaccattaaattagatattctaaactaatccctatgtgttaaaaactatatagttctatgcatatgtacacaactcctacgtaagtatgtacataagagatataaaaagaaaaaaaaaagagtgtgtgtatattatccgtcccatctggtagttttctctttctttccagctctaagattttcctaaattgaagatatataaatgtagcaactactccaactgaggtggtaaaacaagccatgccatatgcaactgccttacgccaccctttgctccactctcttcccatcgattttctcgaaagtattctttttactaataatttaaaagacaatcatatgaactcatataaatatgtgcataagcacacttaaagtacacatgggtacatcctatccctatgttagaaaaaattttgtccaaaaaaaaagaaaaaacaaacgtatgtatgagagactactattccccccccctaaaaaaaaacgtacacgtaactacattatatctatttttttgttgttctcatccaaatagtgttaacaaattagcacaaattccaacgtatattagaccctacgtacatgcataggtgaattagatgtataatacaagtaaaaaaatatcaaaaccatatgtgttagcaaatgatcatcgcgagagcatgtattttttacgtgatcctcgccactgaagctattagatagtcgaatgatcaactgtgctaatcttttttaaacaatatgcctttactactaaaatttagtaccattcattaacatcataaacacattatgtctactctatacataaatcaactcaagacacaaaaaaaaacctttttttcattacctccatcttctttcactcattccctaaagggtgccgagcatggatctcaattggctatgttgtagtaagctatgcaggagtatgcattatttggttgaggtggtctgattttacaggttaccgttgaaaatagagcttaactggcttgaggagcacgactatatcaatacgagaccatgaattaaggcattagagaaaaacccttaacagctatagtcggcttcacccgattgttagagaggcattcttatataagtttaacggttttatcctattaattgatagaagcagtatttttaaatatttatatatagatttggacacatgtgagacataggcacttgggtatgatgtggagatttaactttttctggcattaatggtttattgggtttacttttaggtataactgcaattctatctattaaaaagatactcatatttcaagacaataataataagtaggggtgatagacgaatttacatataactggaacaaagtgattttttgtttggatataatacacattcttatcatttagtatatcaaaatctattatctatttcttatagtgaatatagtgagatagggcttcttttaatattctttttatagacaataaataaattgcccgcacatgtgcgcgggcttccttcctagttatataaattaaagatgattttatactcatcgtattttcgtccgttgtcctttcattttaacaaaccgtcctattccgatttagatccgtttttagcgttgtgaccatatttacgttttcctttttatatccacatccaatatgtttttgcacatatgggcctaaaattgtaaaaggtccaaattattgcccatctgttgacgcgaggctgtctcggtgaaaaacattgcccatcttctaagcatatgtcacatactatttatttcagatttgtttgtgtttatttcaataattttgcacacatgcaaatgcaaaacatactaaattttgtatgggcggctttcatgcatgtccatttattttgtgaaagattcatctaagcatgattctttttaacatcatttttcaacatatgatttcgttcggctatttaggattaagtgatttatattattaaaactgaagttgtttccaccgatagttttggtacgtcgtccgtatttaagttggttttaaaattcgttcgcttttaaaaatagaagggcttcagattggatatcaatctcaaaataaaaatcccatatactttttagacaaaaaaaatatatctaacaataatacaattaaaattagacttcacccgttgcaacgcacgggctttttttctagtaaaaacaaaaaaaaatgtgagacccatatatcattcacacaaaaaatgcattgtggaacccactaacacgtcgaccccacatgtcaaccattactcttctcctcctctctctctccacctatctaactctctcctcccgtcctcccaatagccgagatgaagggccggcgacggacgaggagaaccaaaggcgtgcggtggccctcgttggcagcagcgagacaggaagggggtggcggttggcggagagaggaacgtggtggctgacggcgacgatgctccctgggtagcgacagtgtccccacggcgaagacagcggccggtcgtcgggacggagaagggcacggagctcggacgatggagacgcgctcgatcggtcgagagaggcggcagggatccgaggagacgctactctccctaggcgacggtcgggtccccacagtggcgccggtcggcgagcttgcccgctcgtcggaggaacgccttctccgccctaccgtggccactgtgctgccgttcccgaccgctgtccccaccgccaccaccgccgccgctctagccaatgtgaagagaaaggccgagggagggaaagataagggagagagtgagggagggaggaggaagaagggaaggggagggaggatgacatgtgggtcccacaatatatttggtgtgaatgacatatgagtcacacatatttttttatttttgctttttattttaatgccacatagaacaaagacccggtcaagaccaccatgtaggcgccacgtcagccaaaaccaccaagaaacattgattgcaccggttttgatagttgaaggagtctatatacccgtttttgtggttggagggcatgattcatactcgagcgatagttgaaggagtcgaagtatactttttcccaacccagaattttcaaagtcatttttcaaaggaacaagtttactttaggttctacttgacgtggaatttgtcctttaaccgtaataatatatataggtccccaagcagtaccagttaaggatggaattcaa

SEQ ID NO: 58996 - DNA, 4903 bp, Oryza sativa
gaacgcctgccgggagggaagacaaagtcgtcgatgccggaaacgaaacccatcgccctagtcggcgaagaacttgacgcttcccatacctggcgtgccaactgttgaaacaagatttcgacaatactaaaagggggtggctatcaggctggaaaagtggatgggtttaaaggcaaggaattttatacaggttcaggctttcttaatcaagaagtaataccctactcctgtccggggattgatccaccaagtatattattgatcatatgatctgggaaaaaatcgtgcccctagaggcacccgtacctctccttatataggggaaggggtccgtattacaaaatacagtccatatccctaacggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactaggatttatccttacagaggcattatgtttaaacttgcatgacatttttattcagatttgtatcaccccgatgtttcaacttgtcacacacgatgatgcatgactttatttttctctcctgtactactatactggtacaattcaataccagataccaccgacggtgggaatgctacagggagcagtgttgtagcttgggtagataccgcatattgacggcatgtttagggccaacatagcttgggcttgagcttgactctgatcgaagtagacgctagcaaactgttgtagccgtagctgctgcacaatagcctgaacactgctaatggcctggcagtgagactgttgcgcgatcatcctgagctgttggcagcactgctgctgcatgacttggcagtttctcagttgaaacacgggtgattggaagaaggggatttccactgtgctgcactgctgccttacgaactcaccgcatgggctaagcatctgttgctgcagcatgagatgcggctgcagctgatattgcctgtaaacatgagtaacagcatcaaactgcgtagaggcgctgcatgcagcaatagcaaggagagcaaagaagaaaatgatcttcattgtggtgggtttctagttcttatgcttttgctgtaatgtttgagttgtgagaatgatgaagtgggtttacattgtgcttgtctatttatagatgcgatggatgggttttctttgaattccttatcggttgctctagagtgtttgtttttgttggatattctattgggatcagagtgagtcatgtcatttggaagttacatgatgtgcctccacagatgtccttgtataccatcgtcaaagtaactttattgcccatcacagatacttgatggttggcaagatagataatgttatgactcctcactcactttatatctcagtgtgacatggtgtcacacccagaaattctcgaacccgaatttctaagctgaatgtgcattaaatccctgtccaggaccagccagggtacacaaacaacaattgttgacatacagacccacgccttacaaaaatataaaagattacaaatacagcgggaaagataaaagcgagctaaaccgggaagcttgacttcagcagcgggcgactccactccacaggcaaaccttgacggcagcgacgaaaccaacctctctgagacggctccaactgagaagaacttcaactctggtgcgagggaaaagagagcaagactgagtactactgtcacgcccgaaaattcactagtaatttccgaacttatttgtgcataaaatcctcgtccaggaatcagccgaggtacacaaactgacaatttaatatacaaattcatcaaattaactaaaacgataaatacttacttaagatgcacttagtcctcaccatgaagaaaactgcagcggaaaataaaatctagcgaagctccggctccactcccacaggcagctcaactggggtataagccaaacgtcttctcctcctagatcttttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagccccacatcatatcaccatgtccctcaataccaccacggtacctcgaaaaggagctgtgacaataccccttgcacaacacaatccaccatagcgcacctttcctggatcataatcacccccttataaaacaaggcatggactccccagcgacccccgtgggcttatctccgccacttctcagtctagtgctccgcaatgaaccatgttatacaaaaggtaaagccgttgcccacgctggcttgtggttggcatggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagaaaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattgtgacttcatatgaatttattatgaattttacaagattaaatcggattaaaacacttatatggattttaattgaattatgacgcaataatgaattatttttgaaaaggaaaagggaattattgcgtcatcaaaggcggtccgggagcacgggacggtctaaggaaacgaacggccgagatcgattctatccaaaacgggcggccgagatcaacttgatctaccgcggttcacgggacaaggcgacgatgacgtcagcggtgacgtcatcaccggcgacggctcggcctcgcgcgctcgccggcgaatgacggcgcaacgacgcaaacagaggacaccaacgggtagaggacaacacagcgaactcaccggtgaccaaaaccacggcggaagagcaacggacggcgccggtgacgaggaagaagaggcgacggtcttcgggtcgacggtgacggcggtgctccggcggtcttctgcggcggcgaagaggtggacggggacggcgacgacctcgcgatcccgatggtggcgacggcgaccgacgacggtggctgcaacggcggcgcggcgcggctgaaccgacggcaacgacagcgacggctagggctacgcggaggcggcgctagacgggacggcgggctaaggcaaaggtggcggcggatagaggagagctcgggggtgcttataaaggggctagcgagcggcgacggaggcccacagcgaccggcggcgagaaggaaagctagggttggagggagaaaagtcgatccgaatcgagctcaaatccgtcgatttccaaacgaaattgaccgaagtttctataagagaaaaggaagaggagatcgaggagattatttcccctcaaacgatttcaccggaaacagaaaggatcgaccggattggaaagcggcggcggctagggtttcggccggcagcggcgcgaggaggaagacgggcccgacaggtggggcccacctgtcagcgggagagagagaggagagcggcggctcggttgcggactgggccgacttgggccggggagagagagagaaagagagaggttttgggccggctttcggcccaaagccaaaaggaggatttaaaaacattttctatttaaattattcatgaaatgatattccattgattaaaaatacttccttggctcaaataaatcccagaaaaatctaggaactatagaatcaagtaaagtatttaataaaattttatctaacccaattttatattgagatttattaattaaaataagatcttctc

SEQ ID NO: 58997 - DNA, 17035 bp, Oryza sativa
aaggaaaaaaagaggagaagaaaaagaaaaaaaagtaaaggggtcccatttgttagtcaaaataatgccacgtcatttctgcgtggcatgccacatcaagccacataggatcctgaaggagttgtagcgatttgggacctagatgacatactataacaagttatgggacttggatatgcattttgagagtttagggacttagatgacatacccctacaagtttaaggaccgcccgtgcactttactctataaaaaatgtctcaaaatagtacttcagtatataacatttacatgatcaatagcaagtgctcaaaatagtacttcagtatataacatttacataatcaacagcaagtgcatatcttctatagtgtgaccagtagaagtttatatggtatgcaaaccatagaggtttatatctcagttactcttaggacattgtctcataatagtactccagtcaattgttatcggaatagtgctcgacgtcgttgtcttaactgaagtgcaaaaaaggagatgtcgtgtgtgaacatgctggaaacatcttaaaaattgaaatgacaactatgcatttctggtatggacttacggaccccatgagcatgtccatcatcctagcagttgggcactggaagggatttcacactgcacatgtccatcatcctagcagttactgccaaaaaatactgctcaatctcggcttctagctaacttcccagccatccgagggtgacccatcgtaatgctggtttaaattgatttatgaaatctgacttcaacagaaatactgtaaaaaaaagccacatcctgtttctggaaaaaaaactgaagtatgtgttggaagtaatgtgtggatcagttgattttgttgaaggaataacaatattggaaaaatacggagcacaataaaacttcagatagaaaacatgatagagaaaaaggatcgcattacattggctggcaaatggaaaggtttatggaagacagcaatatgtgagtataaagctaactggatctataccacagctaggttagtaaagaaagccatggctgcatacatatagaaacaagtaaaaaagtggtagccattacttcattcctacatgtaaatgtaaaatatgatggcagaaaataaaaccaataaactgcagaagtgaaatgaacagtccagtttaagaaccttggtgtaagatttaaaaaaggcacatgattcccatcagggaagaaatatattgccaaatttgaactaaaaagtaaataaaatcattaaaggtggtccagatagtattatttgcacccagtaatcctagttatcagcaggtgggctattggaaatgagttaaagaactgaaattaaattaatggattagcatttgataacaagaaacgatgagaaagattgacagggatagttgacattcaataatacaagaaactgttagatggaccgatatgcaaatttaaaactcttttctagctatcttaatgtgtcttttctttctatctaattcctggacctgtttgtgaagaaataaaaccagtcttttatttttcttgttgtcagcctggatgcccttgttttcctgtaaaatattcgcttatttaatagaaatgggagaggctaacctctctagtttaagaaaaaaaatctaattctttcacatgataagaatagacacaaaaattagctgcaggggtaaacaagagaaaaatatcctgtggtgcatataatagaataagtggttgagccttctacaataaaaggttcagatatatggtgctgacaattaggaaaaaaaaatccagatattgaaacaaacacttatacaactttggtgataaatgtactctccagctccactgtccgaaaccagggattgaccattatctttgtttgtaaattttctaaattttaatctttgaagatttctctgaaatttcaggattcacatggtcttctatttttgtcaaaactattgcatgttcttctacaaataaaacttgattgagagaagattttctacatgacatatttgggagttgtttgacagtattaattaaaaaacattggtgctaaaacagaaccttgcaaaattctacaagcaacaataggggcaaagagtaaagactaagatttatgtatagaaaaacctctgagttattccctgcacctcatgaatcatgacggaactcctgatctatagaagcatgcaaaataacatacaaaagaaatatgattaggttaacactaattagttaaacagtagcaggaactacttctaatataatatgaagtaattgttacttgcacacatggcaacacattgtccttgacagtcaaagtgttggatcatgatcactgccttcatttgatctccaatcaaattcaatatccagatagtgtttccttcacaacaagctgaagcaattaatcaaggtccctcgattaaaaaaaatgtttggattgcgtaaaaataaaaattagcattcatgtcaagagatgcagaatgattaacacatttgtataagcattttgtaggcaatttcctgatatagatgctaatgttatccgtaaagcaaacaataatgttgctaaaatcaaatcataccagcacccaaaatcaatttgttagcaacaaaaaggattgattaatcaatttactccaatggttagataattacattcaggcacaaatagctaaatcttcaaactacatatgtaattctgtgagttatatattatataaatatattcaccgtaggactctcatacagtatttaccttaagaaaacagaagatcaatgctttgtccagtgcaaagcatctcttgccaatacattttttttgtgtgtagctcccttgtcctcttcaagggtatggccagattccagctaattaaagtacaaagttttatcctagaggaaagccaaacaatcatatgagcagctgaaattatgtttcaggaattatgcaatctaatatatatgcagtctagattaatttaatatatgctcctaggatatcaaagagcagattgatcagatctgtgacatacaaagccatagagcacatggagtgtgacatacctatcaaactctccaaagaatgaggatgggaatcatgtcactcctctgtgctctccatcctgcaaaagtttcatgaactggaacatgatatatttgatttctatccatgataaatggcatcaatccaagtaatatcacactactttggcacaatttaatttttaacgaattttaaaactataagttggaagtgtagctagctagtgtagcagccataaaggcacattcgctgtatgatgcaggaattccctgactgccacaaccagcacaggtttgaaagttgttaacgtcacaagtagatgcttgaaatacacctcgctagccaaccagaccagtggcccaggcgcttccttggagatggagtaggcagggggcagtgtcttgggtggctaagcaagccctgaattttctgctcttacggaatacacgtattttccctgaaaacacaagggaacctacaataacttcagacctgtaccataacacaaccagggggaggagattaaatgcaagaacatgcgtcaaatctacaatatttaccaatttgattttaactttttctgcaaatctacaaacaaatggttggggttacagtactcggattcatccatacgaatccaattcctaaccgtcagatttgcactatgatccaatccctaaccctcggatttgcaccattcactacaaattaaattcaccaaaatgaaggggagcttgcaatacttacatcgatgggttgggatatggtcggcggactggacgacagcgacctagtagggcaccttcactgcacgggggaggatccacacgccgtcgcggcgggggcatgcgagggggcgtaggaaagcgcagcggctgccgtagggactcgcggggtgtcatcgcgcgagggcgcacgtggggatagcgcggcggcgggcatcggggcgaggatagcgctagagcaggcgacggcattgtgatggatgggatcggatgaataggtgatactcggatggacggtacggataagtagatatgcaaatggacgctagggattgatcgggtgattgggcaggtaggattggaggaggccaactcctcctttttatattagtatagatatagatggtttattacttccgatccaaatagacctattttgtttggagaatatcagaatagtaataggtagcttttcaaggtaaattctttaagaaaaactgccaagatgaaattgcagaaattttacgagaaccttttcctgttcgaaatgtttgggccgttgcgtagtcatcattgccagtcaggtccttgacaaatggtctcgattaacatggtgcatatgctaatgatctcattgtttaatcactctaatgagcacacaatgagagggctaacatatcttgaaattaacgaagtaatcatgagcgccttactgtcaacggatacatcgtctaacactgtaaaaataattagctataaatatgagcacacgtgtctaagctaggactttaattcgagtaggctggtttcaccaaagggacctaaccagttcatctatgatcacttcatataacgatctcattgttgcgctaataagccctagaaagtaaataataataattgatgggtaaaatttttatattcacattcttaactatttaaaaaccaatactaaaactaaactatgacgaaaacctcaaaaaatttctaaattaagttggaaaatttaaattttggttacgactaataagccgaaaagcaaacgatggaactgaaactctcaactaggctgcataaaatttcctccatgttgccacacctgactatccttcctagcaatcgcattattaggcatatataaaatgtagagtcaggtatagtcttagttaatacatatcacttagaaactatactcctataataattgagataacaaaaactcttaaccattaatgcaccaaaatattttttctacacttctttctttttctccacgcccatacaacaaaattttctttaacaaatgttaggagtcaacttcgaaccattgtcatgtgtagcaaccacccccctatctctcttccatgtcatatattttacttacgtggcaacgaatagagaccgttattacacaccgttatacgtgcccttagttagccaattttaattctgaaatcccatgagatccaacaccctaaatacttgggacgttcaactttcacatgagacgaagttttcaaaattttgaactatcgaatcaatactgaaaagaaccaacagatcgataatccgttggagcatggtgacaaacacccttgatcacggacacgttgcttttgttgtgaaaaaaatgcgccgccccacatggagagggattatattccaggagtcatggaaagaaggttgtgacttgtgagagttgaactgagctgaaccaagcaaatttgccatttgctccggcctctggtttcttgagcaaacaagccttaattatatgcccacacaagtgatcaaatgtaacgtaaatacgccaagattttatactcctacgtcatgacctcaatcatgtacgaatcattgtctctttgtgtgctttgcaaagctgaaattgattttgaatttcagaatgtatttattttaagggttcttttgccactctcactaccaaagctctcttttcacgattttttttaagataatgagctctcttttcacgatggataagaaaagagagtaaaattcaattcttctaaaattattcttaaaagtcgaaatttagaattttaaaatagttttagcttttaagaaaaagctgatcagacaagtaggaattaatctttttttcatataatacctaatagaatcccatgaatattatttccttgatgatatatcaatctggaattctggatgcatttcttacatgttctctttcaaaagatatacactgcaaagtatagactgatctataacgacacaatacatgttgtataatcttatacacacaacacaagcagagtattcagtacacatcgatcctcattaatttggccacctcatcaaacttaagctacttacgctgcatgccccttctgtatgctctgcaccaacgacgtcgccgacgaggccgtcccgaccacggcgaggacgacgccggcggcgatcatcgccgcgttgagcgcgacggcgggccgcgacacccgcccccaccggatcttgaggtagaacgcgcaggggaagatgatcgagatggccacgctgacgagcgacccggtgaggctgagcacgtactggaagtacggcacggagagcgccagcgccaggatgagcagcagcgccgccgagccgacgccgccgcggacgagcgtgcgcgcgcgcggcgacatggccgccggcaggtggcgctcgagctggatggcgaagggcgcgaactcgagcgcgtacttggtgaccggcgtgagcacggtcgcccagagcgcgatcctggtgacggcgagccccggcggcatgctgagcgtgatctgggagctgacgctcgggccgaacatgctcgcgccgacgaacgccagcgccgtgtacagcgcggtgaccacggcgaagctcgcgacggacaccctggtgaacgccgaggggtccttcatggcggcgtggatgttggggaacacgatgtgccccgcgtagctgaacatgtacagcccggacaccgccgggatccgctccagccgcagcgccgggatgtaccccccgaggccgacgccgccgaacgccgccgcgcagacgacggtgccgaagatgagcagcgacatgacgatgccggcgaaggacaggaaggagatggtcgacaggtccctgagccacaggctggggagcgccaccagcacggcggcgacggtgagcagctgcgtggcggtgaggcgcacccacggcaggtggaggtgggaggcggcgccggcgaagacgagcgggaggttgtcgctgagggagatggtgtaggagacgagcgcgaagaagatctcgaggtagatgaaggcggaggcgaccacgcggcccttgccgccgaacgcgcgctcgccgatgtcctggtacgtcttggaggccgggtcgtcgtcaaggcacttgccgatgaggtgcgccgtgtacgcgcacatcacgccgaggccgacgaggaggaacacggacgcccacccgccgttctccagcgcgtacggagtcgacagctgcccaagtcctgcaaaatattatgaatatatatcattattaaaacctattaatttttcgagatattatcattttgatgtgaattatgacatcgatattgacataaaaaattaggagcttaggattctgataagcagcttacgagtataattaatgctaattaaaatattaagttggagtttgagaatatagagaaataatttggattatacgaagctgaagatttttgggtggccagaaacttgttgtacctatgagcattccgaccatgttgatgacggagtgggcgaaggagctggtcggcttgccatggtgaacggcctccacagccgcgaccctcccggcagccgcggcctccgtatgttcctcgccgcacttgcacggcttgccggcctcgacgtcgacgcaagcggcgtccccgccgccgccgcagcgcctggccgcggtgagccgctgcagcgcgagctgcgcgccgtggacgctctcgctcgccacctgcttcggcttggcgcacagcgacagcccgcaccaccacccgctcgccgccattgttcgctagctgccggagtgtgcgagctggagcttgttgctgctacgaactagaggtagcttgtttaggctttggctcttgctgcatagggatgccaagttcgtgcctatttatagtgtgctggagactggagtacgttgcaggaggctgcagggcaagttgggaggaggtcaggagggaagatggaatccatgagtgacaatgatgccactagctagtggtttcaggatttgggagcatacacaactacacaaacacaactacacaagtactcactctggattcagtgtaattggtggttactactactccgtagttggttagtttggttttcacggccagcatatatccacatcgatcccatccctcttccgttgaacacgtacgtcatacttatgatgtttcattaacctaaaccttagtgcatttgctagggtttaaatcttactgcttaacggatcagtgaccggtctatgtgtaaatataagcatgtcttaggctacgttcggttcggctcaacggctgagatgctttcccctttttttatgagaatgtttcctaaaatgttaaatggtgttttttttaaaaaaaaagatctagataaaagttactaaaaagatgaaataaataaaattttcaattaattatatgtttatggcttgttttatttcacgtgttgctgaatctcatattatcctctcattgtcttgtatatgctctaagcggttgcgagggagagggacggtaaaggacggacggtatcttggtgtggttaattggtgagtcgatgatggtaccactaaaacaacattaagggagatggtttgcggcgtggttaatcagtaggatgggtaggttgaaatattacaaagggaaccttgttgagaatatagacatataatgatttaatatattctatacataaatcatgacattacggacgtatactagcattaacgcatcattagatctacacatgtaaactaagcagtaaaacatgaacagatcaaatatgcgcaacatgtcgaacacgtactgaggtggcggaaagaccggttgctcggcaggaactactcgcggttgcgagcatcgacgaaggcgcgaagcacgcgagcggagagaaaggtgagccgtcgcggacgaacaaggagcagtcgcgcgaagcacttcccaaaaaccttattgtcgtcttctcccggtgcaggacgacgaaggcagaggtttcggagacctgctctcccgatcaccggtgcacgccggcgagcgggatggagtagtctacaagcgacggcgcagtacagagtaggaggcaaaccctagattgatttcgcgtgtgttgcgtgaaggcggcagctcggtttatatagagataggtcgcttgatcagggcgcccgcacgatctccactccgcgtaaccgaaccggataagccgcgcgtaacttatccggactccacgccgttttcacgcacaggatttttcggaatgtttccaacaacaaaacaaatccgaattttcctgcagcaaaacaaaaaagcaaaaggaggctgcatctgcgcaagggtgaggagctaattttgcggaccattcgacgcgtacgtcgtgcacgcgcgccgccggcccggcccggccaggcgagcgagcgagcacgcgcgtgtgttccccctcttctctccaccacacatgcttcaagtggctaggagggcatcctcccttttaaggaggtccccctctcctagaataagcaaggtggtactaaactccacatgcatgccatcccatgaggtgggtttttgtgattttccaaagaattaatcttcgaatgggccttagcccatctattaattccaacaatcccccaccaaatctcaaaatcccactgagatttgccttttccaatgtattgtttatataccagcagttcgatggagaccgattaaggttgaacaaccacctagaactccaagctacaattattcacaacttgaacaatggactacgccttgaattgcaagtcttgtgcaagcaagtttcactcaaagtcttatctggtactagaccgtctgtagactacccctcgggtggagcgtataagtcatactcttaggtctttagtaagcttcctagaagattcacccaaaatcttcatagactgcgaccaacagtcaagcttacaaaggtgagttctttcaagaatgctctgcaggacagcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacgggatctccgatcacatagactaggttaccaccatagtattactcacatgggtctcaaacccatctccttcaatgcattatctatcacatttcgtgatagtaccttcgtgaagggatctgccaggtttctagctgtttggatgtaatccaacgttataacttcggagtttctcaatttcctgacagacttcaatcgtcttttcacatgtctagacgatttcatattattcttagaactattcactttgacaattaccgtttgattgtcacagttcataaggatagccggcaccgggttttcaacaataggcaaatccattaatagatcacgcagccattctgcctcaacagtagcagtatccagtgccgccagttctgcttccatggttgacctcgtcaaaatagtctgtttgcaagacctccacgaaacagcaccaccacccagtgtgaagacatatccactagtggctttgatctcatccacatcagagatccagttagaatcactatatccctccagtatcacaggatacccagaatagtgaagccccaattccatagtacctttcagatagcgcattactcgctcaagcgcacgccagtgatcatctcccggattagaggtaaaccggctcaacttgctcacagcaaaggagatatcaggcctagttgcactagccaggtacatcagcgagccaatgatttgggagtattccagttgattcctagcaattctcttattcttgcgaagcaacaagctaggatcataaggtgttggagaaggcttactatcaaagtagccaaagcgattcaagatcttctccacataatgggactgcaagagtgtaatctcattctcacctctaattagtttaatgtttaagataacatcagctactcccaaatccttcatatcaaaattttgaaacaagaatgatttaacctcatttatcacctcaaggtttgtcccaaatatcagtatgtcatcaacatacaagcacagaataactccctcacccccaccatggcgatagtacacacatttatctgcctcattgacagcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctccattaagaaaagatgtcttaacgtctatttaatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctgagcttcttcttgaacacccacttgcaccccacaggtttacacccatagggtcgctctgtcacctcccaagtcccgttagcgataatggaatccatttcactatggacagcctccttccagtagtctgcatcaggagatgcgtatgcttctgaaattgacttaggagtgtcatccacgaggtacacagtgaaatcatcaccaaaagacttagtcgtcctttgtctcttgctccttcgaggagcttcactgtcatcctcctcagtgacatgttcatgtgtatgttcagtttgttctggtggtgtgattgaactgggaattattttagagggttggctagaactactatgtgtatccttcattgggaaaaagctctcaaagaaggttgcatcacgagactccataattgtaccaacatgcatgtcaggtacctcagatttaactattaaaaatctataggcaatgctgtggtgagcatatcccagaaagatacagtctacagtcttaggtccaagtttgctcttcttcgttattggtacattgactttcgccaagcacccccatgtgcgcaagtaagaaagtgatggttttctcccaatccatatctcatatggtgttttgtccttatttctgttaggaactctgtttaacacatgattcgaggtcaacaatgcctccccccaccatgccttaggtagtccgcggtgtccaacatggcattcaccaagtcagtcagtgtgcggttcttcctttcagcaatcccattagactcgggagaatagggaggcgtcctctcatgtataatgccatgttcctcacagaataagtcaaactcgtttgagaaaaactccccaccacgatcagacctaagtctttttatctttctgtcaagttgattttcaacttctgccttataaattttaaaatagtctagagcctcgtctttcgttttcaacaagtacacatagcaaaatctagtagcatcatcaatcaacgtcatgaaatatcgtttttcacccttcgtcaacaccccattcatttcacagagatctgagtgtaggagttctagaggtgccaagtttctctcctcagcagccttgtgaggcttgcgaggttgctttgattgtacacaactatggcagttagaacctttgacaatggaaaacttaagaattaaacacatgctggaaagccgagacatcaagccaaaattaatatgacataaacgtgagtgccatacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatccttcgcgaaataaacttcagatctaccgtgccaacaccatgaacagaagcatgtgacccattccccattaggacggtgaaaccccgtgcgacctgataagaagaaaacaatgagatgtcagcacaaacatgtacattggcccctgtatcaatccaccaattagtagactgattaactgaaaaaatagtaggtaaattaccatacccgcttccatctccagtgttgccaatggtcacattagcagacttagagatctaccctgcaggtgccttcatccccttgcgttgtggacacttcctggcgagatggccaggttgaccacacacaaagcaagtcctctcatcctgattaggattgttgttgttgttcttcttcttgaagttggtggtctgctgagctttgtatttccccttgctcttgttctgggccttgtgcacaacattggcagtggactgcccaccatcgcccttagacgtggcatcttttttctgagctttctcctcaacatcaagagacgctatcaacccctcaacggagtattcctgtctcttgtgtttgagtgcagtaccgaaacctctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcattagtagcatcgaatttagtattcagtgcatcccacaactccttagcgtcggtcatatgcatatacacctcgaccagacgatcgccaagcatgctaagaatgcatcccacaaagagagtagtggcctcatcgaattctttctgctgatcagcattaagaatgcccataggcttgctagtactcacccagaagcatttcatagctggcagccacagagtgaccctgatctgccatctcttaaagtgcacaccggtaaatttattcggcctcagtgcatcggcaaaaccagccatagtaaaatcacagcgcctataataaggtttttggattgttgagaatataggcatataatgatttaatatattccataaataaatcatgacattacagatgtatactagtattaacgcatcattagatctacacatgtaaactaagcagcaaaacatgaacagatcaaatatgcgcaacatgtcgaacacgtaccgaggtggcgaaagaccggttgctcggcaggaactactcgcggttgcgagcgttgacgaaggcgcgaagcacgtgagcggagaggaaggcgagccatcgcggacaaacagggagtagtcgcgcgaagcgcttcccaaaaaccttattgccgccttctcccggtgcaagacgacgaaggcagaggctccggagacatgctctccggattgccggtgcacgccggcgagcgggatggagtagtctacgagcgacgggcagtacatagtaggaggcaaaccctagattgatttcgtgtgagttgcgtgaaggccgcggctcggtttatatagagataggtcgcttgatcagggcgcccgcacgatctccactccgcgtaaccgaaccggataagccgcgcgtaacttatccggactccacgccgttttcacgcacatgattttttggaatgtttccaacaacaaaacaaatccgaatttttctgcagcaaaacaaaactgcaaaaggaggctgcatctgcgcaagggtgaggagccaattttgcggaccattcgacgcgtacgttgtgcacgcacgccgcctacccggcccgacgaggcgagcgagcgagcgagcgcgtgtgttccccctcttctctccaccatacatgcttcaagtggctaggagggcatcctcccttctaaggaggtcccgctctcctagaataagcaaggtggtagtaaactccacatgcatgccatcccatgaggtgggtttttgtgattttccaaagaattaatcttcgaatgggccttagcccatctattaattccaacaaacctagcaaatggaccaggtatcatcaatctcagtccaatctatttaatttaaaatataaaactattttaaaagtaaaataggtaaacattttctaataatggataaaccatccaagacaatagctagagctcaaaggcatattagtacaatagcctaggctgtgtttttttcccatgggttctgacccatttccctcgtttttcgcgtgcacgtttttcaagctgctaaacggtacgcgttttgcgaaaagtttatatcggaaagttgttttaaaaaaatcatattaatctattttcaaatcttttatagttaatacttaattaatcttgtgttaatctatcgcttcgtttttcgtgtggagggaagggttctcaaccctccaaaagaacatagccggggataaataaagggctggttcactttgctattattttcaaccttaccaagttttggcattgccaaattttagtaaggttgccaaaattttggcaaaatttcatatgtatttactaaaatttagcaataaattaaatgtagccactttttttaactttgccaaaaaaaaaaggtaagattgaaaatggtagcaaagtgaacaagcccaaagcaacaggttcttagcaagataatcaaacacccagtctcaatttacacagtccggcctgttgctagaccattgttcgtataaatgctatatgcgccataaattcaacgattatcttgggataaatttgtatcttgagatgcaattggaatggtgacatggccggatattggcgctacgtgtgtgaggtgtaaacgtgtgagcttggattcagatacgccaggaatcgatccaacatagctaggatagagagctggtgatcgatcgatctctttagtgatggcgtatgaatcatgtggtcataatggaattggaggcggcatggcatacaacaccagttgcatacatatatacgcagtataatcaatttgtggaatcatattccacggagccaacgagcaaaggtacgattataagctattgtggtccgtttgttctagcaatgtggccaaaagggcatgggggatgagattaaccacttcattctagtgggagagagaggggcaagatcaattcaaaaaaatgtattgatagtcctagcccgggtagtacacatatataactagatgaataccccgctgcattgttgcgggaaattaagttgcataatatatacaagtaagataaaatatgaattaaaactaaaacaaattaattgatactcatgaattttgaggcctaaaaatgattgagattacttggtgttatgtgagaaaaaagaagagataatttgaaccatagatctatcatccaatggctacaaataattagggtgatgtggtttaacgagagaagagaaaaatagtattaaccacacttagtggggatgaactatataagtacataggattagggattggctgggtgggtggattgagaataaaatactggatcgtggtcacacacatacgaagtggcggacgatctcctacatggtagaaatgtgtaaggaatgagacgtttgaggaggacggcgcttttaaaatagttatagagatattttgcatgtctaatatatatgccttacatatttattgggataacacatatcacaatacatgacatatgacatatgtacgcatataatgatgatgcacatacacacgtttgtgtgattatacatgtctagcgcacggttgacacatgtcaaggcccatgttctgccacgtgtgtttgattatcgatgccggctacttgccctgtatccgttggaaatgcgattgtttttttaaaaaaaatttatgacactatagttttaaataaataatact

SEQ ID NO: 58998 - DNA, 3799 bp, Oryza sativa
aagtcataccggaagaggaggtatgatgcaggatataaccaaaggaagctaggggttcttttgcataaagcagtcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacagtgaatctggttgatcgcccataaccgcgggcacggctattcgaatagttttactctggccagaggtgtacaactgtacccacaagacacgattccacacatgtcgccatgccccaaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaactgaacacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcactcacagcccgccattcagaatattttaattaactgacacccttgcggtggcaccaatctaaagctatgccagtagtcagagtctatgaaataatgtgatcccccatttgtgtactagttgaactaagcagggctaagcatttcctaagccaacatctagtcattttgatacccaagttatcaatggcataaggtaaccagtatgtggctgaggaatgggacccatcccacattacattgtaaaagaatgcaacatttaatagaaatgcgggatattggtaaattgggtacaatatgatcaaacgtattgcatgacttgccttgctctcgaactaatgagaccacagcaacgtctttgagaaaccgcggatcgacgaaacggccgaaatctacgtgacaaacaaagcacacaagcaaaacatgctataagactactgaaacaggaaacaaaaccatttttaatggattctttgcatttttatgaatttactgagacttgaatggacttaaacagagctcggatgaattacttatgaattttagaagataaactgtgtttttactaataaagaaaagtccttaatcaatttattgcgcaataatacccagggctgacgtcatcaaaggagggggcggcgccggcaagcggggcccgcatgtcagcggctcaaggcggccggtccacgggaccaagggtccggatcggcccaagccgatcggacgatgcagggagcagccaccgggctcggcctcggcttcaagtcggccggcaagcatggcgaacggcggcggcatgcggtcgctggcgacggcaaccggcggcgtgggaggcggcggcgggcggcgcgaaaagcggcagcagcggccgaaggcgacggcgcacgcgcgaaggatggcggcgcacacgggagagagggaaaaaggggagcagaggggagcctcaccggcgagcacggcgaccagagcggaggatgaaaggcggcggtgacccggcgacgaggaggggtggacgggcggaggcgacacctataggaaaggaggagagggattaggggtggagaggacgaccgcaacgaccaatgtggccggccggagatggatgaaaaaggagagctcaccggcgagcgagggaaacggggcttcgggggtgattggcggcaaccaagcggcggccgaggagcggacggcacccgcgagcgcgacgacagcggcttcatggcgcggcagcggctctagcggcggtggcgcgcggccggagacggcggtaggcggcggcgcaaggggcgagcggcgcggcgacgataggaagcacgggagggcgcggcgagtgcgaaaaacgagagagggggacgtggggagtgatttataggtgcgggagggggcggacgtggccggggaggtggccgatttggctggcgacgtgggggtggagagagagagaatgggggggattcaaattcgaatcccgccccttgcgagcgcgcgcaagggtcgggagatgcgggggagagggtggcgacgtggggaggacgcgggagcggcgcggcgtgggcgcgggaggagcgaataaggcggcggcgcggacggtttcggcggcggttgccgtcgtggggcgggcggctggaggaaggggacgacctgataggtgggccccacctgtcagcgtcccggagagaggggagggagggaggacttcggggaggggaaaggggaatgggccggcccaaaggaaggaggccgagcgcgggagggagtgggccgatggcccaaaagaggaaaaagaaggaaaagaaaaaagaaaaagaagaaaggatttttcctgggattttaaaaatattgcgcttgctcatttttaattggttaaaattatttccaaggctctgaaaattccactaaaaatcttgttaatgcattgtagcatggggaactcaagaaaaattccaccacgctatttccgattattaattgcatttattaactagggatttagctctaggttaattaagataatttcttcgggcaatttatttaaccaatttttaaagcaagaaaaaggggggaaacttcagggtgtgacacatggattgctgtcattttcaaactaagtttgttatgtattgtaagctattgttttacaaatgcactttacatgtcaagggcgcgtggaactttcatgatatatccagacagatatttgtatgtgtaaagtgagttatgaaaaatatattagttatcaataactgcttacgttcaaatgagatatgtagtaaagtgcccttacgacgacatgtctaatactacaacggtttagacattccgtgttaaaaatcttatcatagcctttaagaacgtcatcgattttatgaccactttggaaaaaaatctgaaagattagcttgcgtttattttgccaaggagttaaaaaacacgttagagagaaaaaatcacgaaaggaaacgaaatcgtgacagaggagacattatttctcataacagctcagctaacacgtattgacaacgatttgcctataaaactagctagatttttctcacggtcctagatggaagaacgaaaggacatttaggaggcagaacataaatgaaaatagccccttgctagcatcaaaccatggatcgattgtatcacggcggtcatcaacgataccagcaaagaacgaaatgcctacctattcactctcaggatagagcagcggctatattttgtgactttaggtgaaaacagatgaaaccgatatgcatgggcattaatgtggactattaagcatatatgaattttatttaggcagcaatgcttaatgtttttaacttataaattgatatttccgcgaccaggccttcaaatatgaaaatttaacttcatgttacgcggagcgtcttgtttcggtgacaaggtaagattgaattaacaatgatatggcaaatggtcccatcgatacttacattttgaatagtggatttataaccgctataggttgggcatgttttatatggtgtaggattacgttatagggtatatactatttgccaaatgcgttttgactctgttctgatcgaaatgaaaagattgacctgcttaacacactccgttcacgt

SEQ ID NO: 58999 - DNA, 7971 bp, Oryza sativa
ttgtatttgtattttgtattatttattcatacagttgaaagaaatctttatgtataaatgtgaggacaatattaatgaatatcaatagaactcttactaggacaagagtgttataagggagtttaacggcctatttttttttcctgattccatcttttggatttttgtttgcacgctccacgctttccaagttcctaaatggtgcttttttaaacaacttgttaactttctagaagttaattcattcatttataatctcaaatagctatcatataaataagataattcatcaattttagttgtcgtaaaccctaagtagtatatttttttttcatgcgagtcatggtgatcaacatataatcaagatcgtaagatgaatctgtaacaggtactgtaacgccccaggtagccacgtacctggagtgccacactaaaaaaacactcaaaccactaactttcaaaattagaaatttcagcagagtctcccctgtaaatacggacatccacgataggcaactgtaagttaaactaataacaatatcattcccacaatacgatccatccttataattcatggggaagaaactattagaaatctaaaagattattacaagaccaaaccaggatataatttaagtgtcattatggacctaagcaatatagtttgatagtgtgaaagtggatgtgtatataagggtgctacttcccgcccatgcatgtcggtctcaatatgtacctaaaaccaaataaaacacaagagtgagtataaaaatactcagcaagtacaatatggaactagaaaacacatatacacaatattggcaataaagcatgaacagaagtctttctttcgttgatacaccaagtcaaagaagatagtagttcccatctcgggcaggcatgaattgaaatagtagtttccatcccggacaatagtgaatacatcctagcatttgccggcaaagccgagtaagcgtgatcagcgcttacccataggaaattgaataaagaaccaaattgcactcccatgactacgcatggtacttgaataattgaaaccggaatcaaagaaccaaattgaaaccatattgcacatccatggcaagcagggaacttgaattatttatgcagaaccagaatccggaatattgaaacaagaataacgtcgtaaacataggataaacatgaaaacctaaatggcacgaacaacaatatgaatataagtggtcacatgtcacatagaaatatatctaaaataaatagatagagcaaacaatccatgaattacacaattagttcgtcatgcacttgcctccaatgaatggttggtatcatgcatgatctgaagtaccaccacctaatcacaaacaaaatctcagcaaacacattcaaacatgcgtataaaacaatgaaaaaaagtgaacctactgccctatcccatcacaacgcaataacaaggaacgccgcttggactataaacaagactgctgcttcaaacctttatatcttgaaatatgaaatggctatgaccgcaaataaatacattttggaaatctgaagaacaaggcctacaactcttatgtgaaatcatatttttattatgccatttaaatggtctaattagcgcttgaaagcaggcttcagaatctgtccagaatttcagactgtccacactaaaacaaccataactagagttctactcgcccaatcaaagtgtactttaccaatatggaaagctaagaaaaacctctacaactttgtctagaggcggcccaactgattccgctgtttagcccctgcaaaaacagtttttcaaaggatttttaagataccttaagaaaaatagaacccttaaattattacaaaataacattatccgaactttagtttttccttaatctatgagacaaaatttttgaacaaagaatacaaatcttacttttcaataatataagtgcccgcgcatgcgcgcgggccaccttcctagttataataaattttggctagaaaatatgagtatgacgcgtgtgccaaaatactaataaaatatgacttaacccaattatgacatttaatcaaacactaacctaataaattgtgacacgactaaggtttggtgtgcaaactgtagccaccaaccaaacatacccttaggcctatgggtccatgggtcctaaccaattaccatccttagttaggggatacatacgggggtgtgagtataatgttgtggctgtattggtatgtcgattttgctatacatcactcgggttattctttgcatgatatttgacgttttttctcgctgctattatctccagggtggggtggggcccatacggccaggataaagcaatgcatgcaactccagtgggatcattagaatccgattttgctatagcttttgcgattttgctatacatcactcgggtgattctttgcctgatatttgacgttttttctcgctgctagtatgtctgcgtgtgcctgccgtgcattcgaattttttttttgaaaacccagaaaaaatcgatttattttttcttgtgctcccaacggagcggaagctagaaatgaaatgccagcccagaaaaccaggtgggcttatccagagcccacgaaccggcccatattcctttcctttccccgccccggccgccgcttgcaaggtcgccgccgacgacgcgcggagaggagaggagaggagagaggaagagaaaatcttccgattccggcgaggaggggatggggtcggcgctgctgccgacgctgcggcggaagccggaggtggacgccgccatccgcgacacgctcgacaaggtcctcgtcctccgcttcggccgcgccgacgacgccgcctgcctccacctcgacgacatcgtgagcgaacctctccttttccctgtcgattccacgcgatgcgattgccgcttgctatgggggattgattggttcatctgctcgtgcagtaggtttttaggccgcccatggtcctggaagatttttgcttgctcgaacagtattatttacttgtgggaggctggtaaacctagcagagctagaaacgaaatcgacctacaattatgcatgtctgttagttacaactattgatggaatgaattggaagcatgtgaatggagaggaaaagagagcggtgcatatccttgttaggtattgttcgtttaatcccccatcctatgggactgaggggggatttggaggggattaattgcaaacctattatggtgtggaattattcccctcatttctctccaatccctttctcatggggactaaacggacaaagccttattgttccagtcttacactatggggtgggatagtgtgtgcaaatttgttatcaatccttttatttacaaaaaaaaaagagaagaaaatgtatatgggagttgcatggcttctgcgtgctggttaattatatttccctgtttttccttttttaacagctcgctaaatcttcttgggacatatcaaggtttgcgacggtagcattggtcgatatggattctgaggagatgcaagtctacattgactatttcgatatcactttggttccagctaccatttttttcttcaatgcccaacacatgaagatggactcagggtataagtttgttgttttgtgtttaccttagtggtggtataatgttatttggatcattggatgtggccttattttcaacttgcttgagttccttaccatcgttcaagtcttgtctcttaaattctagtagtccaccgtgaacataatttcttatcagctatttatgtacactatactatcgctgcagttactaatacttggttttcacatgtcatccataagtcatatcaacaaaggttgaaaaattagtttatactctactctataaatttatgttgaaagtgctagcttcaggaatagctatggacaaaattataaatagtatgaatttataaaagggttactggtcagcaaaaagactcagtggaacatatcgagcgaagagtaagaatcaaccagtgtctccttgcttcagtaattaagctctactttagcgtgattactgatgaccaagactttttgaagttataggaaaattttttgagatcttaagatctattaacaaaaatatgagctacagttttttttgtaagttttaatgctctatgggaattgtgtggtgaacctaaatgacaccgtgaacatgtatttctttctaaaatttgaatatgcttgttagaaaaaaatgaaagctactgacttcggagttttgatgaatatttctgcttccttttttaaagtcaactttaagtagtactctaactcttcttttttattatgaaacgtatggaattaaattttgtgaaaacaagtgaataatgaaataatggctgcaattcagaacaaattcagttcctttgagtcaattcttaaagaatgttgttttctttgatattgagtgatatgcaccaacaaaaatatttttctcattgcacttttcttattagttgttttagggtgtactatagctgcatcacaaatatgccaaacttattgtaatgtatatacgcaggacacctgatcacacaaaatggattggctctttcagcagcaagcaagatttcattgatgtagttgaggtgagtgggccaataagcttttcatgggattaagatttaagaacaacctttttctttgtcaattgaccaatgttgtaaatctcgactttgcttttttccttctactttgtcatcccggtccaggttaggccaaaaaaaaaatgtgatggcgtatgaatgaggccaataaattaatagttgtgaaatttactttatcttcaaaatgattcatagagtacataactaaagaatatgggaaacaataatggacatctataaggtgaaggaaaattgagatggttcactctaggggaatcaatttgtggttgttctaggaggccaaattttctttgactgcctttcgggtcacctcagtactggttattccaggatgccccctttacctgcccaagataattcacaaacctttgaaagttttaatttggtctcttgatcttttattctttagaatgttcttgtttatagcagtccacaaggcctaaggtacaaccatacagcagttagatgtatgctttggtttgtacttgttcaccaggaaggtcatgatgtgccatagtgaacaatttggcaagggtatggattgctttctgtctgaaagcaatggccagttacaatacagcaagtggtccagcattcccttctgttttatgaaaactacaactcttagatcctttcagatctcatgtgtcatgtgagatctatattcagcactgtctgttttggagccggaggaatattttctcactgtagcgtatcttttggtacgattttcctgttcttgtaatccttacattttaaagtagttcagcagataaactgtcaattttaacaccgctatcatatgggatttatcatcatctgtgccattcctctccactaattcagctaagtcaattaatcgcagctgtgctgtcttgacgattgacatttatgaagttcaactcctgcttaatttagcagtttattggttcatgaataacatgttaaaacagtagttcacttctgccttctgatatcttaatggcaggcaatatttaggggtgcgatgaaaggtaaactgattgtttcttgcccacttccaccagagaggatacccaaattccagctccttttcaaggatgtttgagcaaggaaagtgctcatcacatgcgcatgctaaaagagtgtcttggtcatggtaagcaaagtaaaaacatgcgacaattatttaagtataaacaaccacctttgctaactacctttgtgcttacttttgcacttatgtgcgacagatgacagaactatatgaagctatgttcaggcagaagagtttgtgaagatctcgtctctccaattggtttgtctcgactactttcatttatgtagtagtatatcacatgctgtgttgatatgtaccaggcatggtagcttttgttctgtacttctataggaggcaaactgaatcgatcaagaaaagtgcatatctgacatggtgccgcatagtaagcttttagtaattaacacaagttagaatgacactttgcatgtagtttgcattgcactctaaatacagagaagggtataaaatattattgctcgttaattgtgaggtggtaaatcaataatccattttacatgttccccagactatccatttcaaagataccgggagtctgggagacatttctggtctggaataatgtgtgagctatacctgaaaaggtgctaaacacatctcctggagcctagaaacctcagtttccgaggcaactgaatcataaccactgcaacaaataaattatacagtgaaagaattgcaccgtatgcaccacctgtaattccttccctccatctaaaactcaggcctcgaatctaatctctaactcatccttgtcaaccatgaggtagtgagaccctctgtcgatcaccttcttgccgtctttccttaccctgctgaagtgctcacatgggctgatgtcaaacctgatgttggccttctcccctaccttgagatgctggctcctgaaaccgatcagctgggttgtcgggcggccgcccttagcattcggccaccggaggtacatgagcacagagtgcttgccatccatggggccatggttctgcacctccacaaccgccgggaacttgagctgctcacagccgtcagtgccgatctcttcaatgtggtagctctcatcaccttctgatgttgttgttgtcctcagactagcaagtaggttggtgtaggactctgctggcttaccaccagagaccagctgacgtgagtagctggagtagctgagaccgtagccgaacttgtagacggtcttgccctggtagaagcgatagctccggccagggtagccggtggctgggtcggcacgcatccgcatgtccgtcatgggcaccttggtgaactcttctgggtaccatgtcactggcagcctcccaccggggttgtggtcaccgaagagcaccctggcgatggcgagaccaccagcttgccctgggtaaccagcccacaggatggcgccgatctttgggttcgtctgcgcgaacgtgacgtccaccgggccaccggtgaggagcaccaggatcacagggcgcttcgccgcgtcggctacggcggtgatgaggctttgctgctccccggggagcaacaggcttgtcctgtcgcgcccttcgctctcctgcttctggctgagccccatgaacaggaagacataatccgaagagctcgctaccgcagcagcttggtccgtggcggctacgtcgcaggccgccgaattgcaaccagcgaggaacctcacgttcttgatgtaccccagtatgccgttgagcggcgtcgtcgattcacacggcgggccgaaatagttgccgatgagggccaggccatcattggcattggggccaatgactgccgcggaggccaccgccgtccggtcgagcgggaggatgccggcgtcgttcttgagcaagacaatgccgtccatcgccgcctcgagcgcgaggctcctgtgctccggtgtgcagatgtcggcagccccgagcccgccgtacacgctgttgctcctgggatcgccgtcgaagtgcccgagccgcatccggatggcgaagaggttcttgagcgccttgtcgatgtcctcctccgtcagcttcccctgctggatcgccgccgtggcgtgctgctgcatgtaggtgccacagttcatgtccaatcctgaaattcccaaatcacttaaaattaatccaaatctgtccaagttatttttggaacaattaagcttctgatgaaccgaattgtttctctgtccaattggcgttggttaaatgaatcagtccagcttt

SEQ ID NO: 59000 - DNA, 6459 bp, Oryza sativa
gcctttacgacgacatgtctaatactacaatagtttagactttctgggacaaaaatcttattatagcctttaagaacgtcatcgattttatgaccactttggagaaaaatctgaaagattagcttgcgtttattttgccgaggagttaaaaaacacgttagaaaataaaatcacaaaagaaaacgaaatcgtgactgagaagacattgtttctcataacagttcagctaacacgtattgacaacaatttgcctatagaactagctagatttttctcactgtcctagatgtaagaacgaaatgtcattaggaggaagaacataaatgaaaatagccccttgctagcatcaaaccatggaccgattgtatcacggcggtcatcaacgataccagtaaaaaacgaaatgcctacctattcactctcaaggcagagcagcagctatattttgtgactttaggtgaaaacaaatgaaatcaatatgtatcgacagtgtgatggccatcaaatgaaactaataagcattgctgaattttattaaggcaataattcttaatattttaaaactataagttgatatttccacgaccatgtgacatcccggcctagagcttaataggattactagaatactcatatcaacaagttgcaacttcttttcctaaagccgatctcaaaagaactccgaggttaagcatgcttggcctggagcaatttcatgcttaacctggagcaatttcgggataggtgacccaccgggaaattctttacgggtgcgtacgagtgaggacaaagtgtgcagaaaagggttgtgttggtctgtgagagcagtctatgacctatgaaagctgtcagatgtaagcggggagaggcgggacgttacaaagtggtaccagagccgactctcgtggtttcacgggcgcgtgtgtcgcagttacgcgggcccagcctgggagaggtgggacgttacaaagtggtatcagagccgactcttgcggtttcacgggcgcgtgtgtcgtagttacgcaggcatggtgcgcatggctggtgtggaccaggatggtcacacagcatggcacatgagctggcactggacacacggacgtggccaaaaggggacgttcctggcccggggtgaccgacgaggtcgtcgatgtcttaagggggtgaggatgtgacttcccggcggtgtcttaagggggtgaggatgtgacttctcggcctagggcttaatagaattactagaatactcatatcaaagccgatctcgaaagaactctgaggttaagcgtgcttagcctgaagcaatttcgggatgggtgaccgaaaggcttgtgttggtttgtgagggcaatctatgacctatgaaagctgccagatgtaaccgggctcagcctgggagaagcgggacgttacagaccatgcctttaaatttgaaaattatcaaacatcacaatggcgtttctctcccttctatatttgggcaccgtccccgagtataggaatcctggaccttctcaatttctattgacgagatgatccaggtcaataaacttttctctatgatggttgatctgaaaagaatggtctaacatgtgttcatatcgcctgcatcatcgtcctccgtgtcacgcctagaaattcactagtaatttacgaacttatttgtgcataaaatcctcgtccaggaatcagccgaggattttatatacaaatccattataataacatcgttacatacttacaaaagaatagaaaaacagcagcggaattaacggtctaacgatggcttaagctccactcccacaggcagctcaactggggtataagccaaacgtcttctccttctggatcattttcttcaactgaggttgattgattatttcaaagtgagcatatgacatactcaacaagccacacagctaatatgtaagtgtacaaggataccaaaggatggaataatataggctcatttgcaaaagtagcatttagcaaacatttaagagtagtaaaacagtagagttattaattatcaattttaatcaacactgcacaggcccaaccatcctgtacaaccatacccggttgtacagatctaactccaaaccaggagctaaacaaattattactagttatagcatcaataattattgtgataggtgtgagactaatcacgaaaaacattgctcaacccgctcatgaccgcgggcacggctattcgaatagttttactctggctagaggtgtaccactgtacccacaagacacagcaccacaacatgttaccatgcacctcaataccaccatgatacctcggaaaggaactgtggcaatacccctcgcacaacacaactcaccacagtgcatcatacctggattataatcaccgaggcatggactccccagcgacccccacggatttctcgccacttctcagtctggcaccccataatgaactatgctatacaaaaggtaaagtcgttgcccacgctggcttgtggttggcacggttaatgtctcataacagtagctcgcgaactggtccttaattgtcatgagcacgaccttcaaaaccatgtgctcacaacccaccattgtcaagttttaattatcaattaattatcataacacgattaaccatcgtgagctaccattaaatataaccataaataataatgtagtatgatccattccattaatgagctaatgtttctaagcatggctaagcaattacatatatatagcttttagctgaaccaaaccaatatataaggttcaagctaatcaatttgttacccaaggaatcaaggaatatggtattcaatgcaaattggccataacaaatgaataggttcacaccacccggtgacattcgaaaataaatgcacagttgaaataaatagagaatttaaatataggatcaacatgctcaaaggattgtgtttgggatctgtgtgacttgccttgcaacaatcggtcttcaaatagtcttctaaaccacttctgacgcactcacggaccttcgcaacgacagaaacgacaagctaacacgcaaaacgaataaaaaggactaataaaaaccaaatgaacaatacataaaaagtaaaaaaaaaacatgtagatcatgattttagatgaatttagagacttgaacggcctcattccgagttcatatgaattagttacgaattttacaagattaaactgattttagccttataaaaaaaggattaatgatttattttagaaaagaaaagggctttatgacatcattgatgacgtcatcgccggaacaaggcacgggaccacactgtcgccggcgctagaggactcggccggaccaaccgagggcatctacgcgaagaggacgacgagacgaactcaccaaggggcggcacgacgacgaaggacgacctacgacgagctccgaacggcggcgaagtcgggacgacgaggacggcggctttccggcgacgagcagcggcaacgaaggggtggacgggcttctcctcggtgctgcgatgccgagggaggtggcggcacaggtcggggacgaccgaggcgacggcacggcgcggatggaggcgaagcagatcggcttgacggcgtcggcagcgctccggcgggcttcggcttcggccaagtggtggacggtgtgcagctccttctcgcgaacccgatggtggcgacggcgaccggagaaggcggctgcaaaggcggcgcggcttgaaactcggcggctacgacggcgctaggacagacgcggctagggcgctacggccgacggcgagctcgggcgagggtggcaaacaaaagaggagagggaggggactctatttatagccacgggagagagatcgggcgtggaacgcagggaatcgcgccgggaaaacctagggtttggtggagagataaactcaaaaacgaatccaaattcgcgccgaattcaaagggataaaataggatttttgggggaagagttagaggaggataagggaaacaaatcccctcaactaattttagaaacagtcgagagaattgagcgaatcgggcggaggaaacggcagcgtcacacacggctcggcggctgcacgggctctgtccaagcttgaagaccacactgtagcaggtaggcgaattagactttgactggggttctttttctccagcccgattgaaggagggacaggaaatggacttcagaggaggaataaagccagctgaaaggaagggagaatgggccgaggactaaaggtgaacttttcgagtttcagcccgaaaaggaaaaggggattttaattacttttccaaataaattaaacactgaaatgatgtttgaattgttaaaaatactttcaatgctcagataatttcaacaaaaatcctgaaaatacttggacaaccaaagtacttaacaagattatagtcagaccatttaatgattaatttaatatgtgaataattactgaaatgttctttgtatgattaaaattaagaattgagcttcaaaaaatcaaagaaaattccacatagtataattaaccatggagaatttaataaaaattaaatccatccatgctttatatttagaaattttgatttcccacatcactagtaaattaatgaacatttaatataaattctaataataatttattatataatttataaatcctgaaacgaaaaccaggatgtgacactccgtcagacccagggtttgaaagatcgtgtccacctagcatgtgaacacaagggagaacctaatcccacttgggagacacccaacaaaaatgagaaaggggctccttatagacggatgaaaaaattattccgccacaaggttatcatcagtgcccaattacatctaattgttgaatagtcccacattggttgtggaagtgcaaatgacctaagatataagtgggggagcccctcacctcaatggctagcttttgaagtgtgaaagcccctttacgatactacaattggtatcagagtctgactaggttaacatctctgacccgatgaacacagtgtgtgaagatctgatggaccgtgggtgcctgcggggctcgtatacttgatggaccgtggacctgttctgtggggtctatacacggtgaaggggcggtgaagggctgagggacaccaatgtgtgaagggggagattgttgaatagtcccacattggttgtggaagggcaaaggacctaagatataagtgtggggtctatacacggtgaaggggcggtgaagggctaagggacaccaatgtgtgaagggggagattgttgaatagtctcacattagttgtggaagggcaaaggacctaagatataagtgggggagagcccctcacctcaatggctagcttttgcggtgcgaaaggccctttacaatctacatgtgatgtgtcatacactccaatgctaagtaatcttacttcaaaccttttatttatttgttaagtcatgatagcttaaatgtcttcttgatgttttctgaaggaattcgcagtcctcatttccaacactcctctaccatcagcatagggaaaagaaatctcacaaatggtcagccatcccctctaccgattaaccaagctcaaagaggccaatggctgagaaagaatctcaaaagtgagcgctaactgccggtggtccaaagatcgataagtggataaacccatcaagccaaagaacgcagtcaagaacaccaccaacaaaactatccgagcagccgctgcccacacagtcaaagccatctatgccaccgtctcccaggcggcgcggcggctgctggcggacgcacggcggcggctccgcgagcgaacgacaacgacgaggtgcgacgccgacgacgaggcgcggcggcgggcgcgacgacgacgacgacgtactacgaggcggcaccgccccggatccaggagcggcgagcctgggcgggcggcggcaggcgcgacaacgaccgtgcggtgccagcgaggatccggccggagcggcgagctcgggcagcggcggcgtggttctcgcggcatcgggcgcgacgacgacgaagaggcggcgccggcccggatccaggagcggcgagcccgggcgggtggcaccggcgcggatccggccggagcggcgagctcgggcggcggcggcgtggttctcggggtgtcgggcgtgacgacgacgacgacgaggcgcggcggcgggcgcaacaacgatgacgaggtggcgccgccctggatccagcagcggtgagcccgggcgggcggcggcggccgtgacgaggaccgggtggtgccggcacggatccggccagagtggcgagctcgggcggcggcagcgtgtttctcgcggcgtcgggcgcgacgacgacgacgacgagcggtgccgacacgggataatccggctagggttaggtttttttttttcaattttttttgttccttttttttcccgtgcggctagta

SEQ ID NO: 59001 - DNA, 1091 bp, Oryza sativa
gttagtgaaatcgctctctaaacctgtcaaggaagttaggccttgggtgtcacatcgaacgtttaatcggatgttgaaaggggttttcaaacacgaatgaaaaaactaatttcatagctcacctggaaacagcgagacaaatttatttcgcctaattaatcgatcattagcacatatgggttactgtagcacttatgactaatcatagactaattaggctcaaaaattcgtctcgcgattttcgtgcgaactgtataatttgttttttcgtctatatgtagtgcactatttagatgtctaaatatttgatgtgatgtttttggaaaaaaaatttaaactaaatcagaggccttaaaataaaagagttaggatatccggtgttggttcattatagtctgcacttattgcgatacgaggggcgtcaaggacaagaagtagagaaaatctcgtatacgagagagacgtccccaccttgggccccagcacaacacaagtccggcgtcgtttcctcacgtcgctccaaaacgtgctgcacccatcagtcgcttccagcccgctaacgggcggagcgatgaacggacggctcacgctgctccctccgatccacgacgcgagccatgagtaccccgcacttttgccgcggggcccataagggccatcaaccgacggccctggtgccgcctcgccccacccgtcggccgtcgggacgggagacccctccctcccccgcgatcccgcctcggcatattcgccgtccttcgcctcgcggcgggcgcagtgagccgtggccgtggcaggcagccatcatgtgggctgtggcgcctgtgagccggccactacctgcgcgccacctgtcgggcgcccgattttttccctgctctttgatctcctcctcctctctctctcccccgtggtgtgcgcctctctattcttcgccgcctatttctactccagcattgctgctgcgcgactcgccgtcctccacttccgcagcgggtgggtagcttgccgcagaactcgttcggctttcgcatataccgccgccgccgcctacctagtacaaggtaaggcgactgccggggctgcaggaa

SEQ ID NO: 59002 - DNA, 31037 bp, Oryza sativa
cattgcatggatctgaggatgtataatctgtggtgtatttatttggtgtgtaatttttttaaggatttgtgatgtagttgatgtgtttgtataagtaacttaggctttgtgatgtgaatgatttgggatttggggtgttacattgatttggggatttggggtttgatttgggatatgcagccaattgatttgggaggaaatacaaggattaaccctggcaagtagcaaaggagcaatgaaaataaaaaaaaagaaaaggggatcaaccgggacgtggctctgccatctttagtgccggtcggcaccgaccgggactaaagatgagtctttactcccgggtatttgaaccgggactaaagactggcatctttagtcccggattctttctcccggttcgctacccgggagtagagggggttgctaaccgggagagatatggggttctccagtagtgttaatgatttgccactcgctgtctatgacatgtgggccctcatgtgtttatgacatatggccgttcagtgggaaattctttagaactactcataagagtggcaaatagttaattattccgtaattaaagtggttcgaagcatgattcctgatacattaccatgtttgccggcccttcatataaaaatttttagtggataaatttgtttgcagattgttaccaagtcaggatgtctattgtttaatgccagattgtatcccactttatacagaaacttgtcatgcaaccaactaaccgggacaattccagactacctccgcaaaagcaatggatcgattgttttcaggtgtgcctactttcattattattgatttcccttttagtattttccagattgtggggttgttcttcctgtaatctttggacatcctaaaagaaagtagggaagggaagtgatactatgcttctcaaataaaaacttgcatggaaattaaagcacatcaatggtggagattaaaagtggattaacagagtaatcctcccattagcgagggggcaattttatacttagaaaaactgagcccctatccatatcgatcgagcgaccgactcgcggcggttaattcgctacgattccatctctccgctgccacccatcatgctccttgcaggctgccaagcgcctctgcgttcggggtggcagcaaagctccggtgagtagggatgccagctgccgtcatcggggccatgcgctgggacgaacgccctgtttggctgttgggaatagtcccacattgcttatttagggaaaggccggtcgaggtggtcaggagttcgattgtccttgagggttgatatttgcttgcagagttgcagttgattgatgtttagaaggaagaatcgttcgaaaaatgtttacaaggaagacaacctcttatggttgtgatcatgtgggatgatctgctcaatgtggtcgtgaagctgctccatagctagttgggagcgtgaggggtagcagcagagaggcggaaggagcctggtagaggaagaggcggcggttttgctcgttgccttggtggatgaagcttggcggccgctgctcacgggagatcgcggccatggcagcgcgagcgaactgccgcctgcaccgtgaatccatcgctcgatcaatgggaccaacatgaatacgggctcagatttttctaaggacaaaattgcccctttctaattcccaccattgatgtgctttaattttcgtgtcggttttaatttgcgtaggatcgaattcaagtaaccaagccaaccagaggggggtgaatggtagattacgtcagcggaagtcaaataatcgaatctaaatagaataaaacacaccccaaccttgtggagattatggataccacatatctacacggcgattatatttagactggatataggataccgaatatagatagaatatctttatctgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaacttttctggagattatacatccaataatacactcggcggattcatccccggacaggagtagggtattactccttgaataagaaggcctgaacctgtataaatcctttgtctccaaacccatccacttttctagcttgatagccacccccttttagtattgccgaaatcttgtttcgacagttggcgcgccaggtaggggttgcgtcaagcttttcaccgatcagtgcaatgggttccgtctccggcatcgacgacctcgtcttccaacccgggcaggcgtttcggttcggcagcctcgacttcgtcaccaataacttcggcaagatctctctcctcgactcggaatcggaccagtcgggagagagccggatctcagtcccgtttggagttccaaacgcggctgaaatctactccaagtccatctcaatcgagtcggcttcaaaccactcgggcgagattgcatcttctccaacgtcatcagatcgagatgatggggcttacccaccgatcctaatgaagctccccgacgatttggcggccgtcttcaccaccacagcgtccccatcccgtaggcctaggcggaaatcggcttcaacaccgatctcgcctagctccagggaagtcggcgtcatccaccagccactcggctcagtttcgacggaccagctggatggctactggagctctcccgccgtcgactcgcgtccgaccgagatcgtggagtacaatgagttcggctttcgcaacaacgacccggatctcgacgacttcgatgaaagcctagaagacaactacacccctctctatttcggcgtctttatggccgataacgagacggaggagcaacgccaagcccgggaaaccgaagcacgacgcgagtccgagcgatgccgactggaggaggagcgtcaagtacaagaacaagaacggctacggcgtgagcaacaggagcgtgagcgggctgcaaaggaggctgaagaccggcggctacgagccttggaaacagggcaccgagcgcgagatcttatcggccaacaagacgttgaggggacaccagttttccgcaccccacaacagaatgctgttgccgcgatcaccctcctcgacaccctcctcaaggaaaacgagctcaatcaatctgaccacgtcgtcaacatcttgaaccagacaaagaccatgattgcggcttcggtcccagttaactccggaagcgtccgcacgccgagcggcagccgagtccctcatcttcgatctcacgactaccaccagccaagcctcagcatcgctggcgcgggatctaatcgcaggagcaggggtcacgacgagcgatctgtccactcgcctcccgaccatcatagggagcgccgagtggaacgacctcgttcgccacctcgtcgtcgccccgtcgatcttcgcgagacgatcatacaacgccgggcagctcgaggccatcatcattcggcggatcgccacgacaacgaccttgacggagtagccgctttcaccaacgacctgcgtcgagtggattggccagccggctttaagccgactagaatagagaagtatgacggtaccaccaacccggaatcatggcttaccgtctacggtctcgcgatccgcgcagcaggaggagatagcaaggccatggcgaactatttaccagtggctttagcagattccgcccggtcctggctccatggattgccccgtggtacaatcggatcttgggccgaattacgcaaccacttcatcgccaacttccaaggcaccttcgagcgccccagcacacaattcgacctctacaacgttattcagaagtccggagaatctcttcgagattacatccggtgattttctgaacaacgcaacaagaactctaacatcaccgacgatgttatcatcgccgcattcaccaaaggaattcgccacgaagaattggtcggcaagttcgggcgtaagcctcccaaaacagtcaaacttatgtttgaaaaagccaacgagtacgccaaggctgaagacgccgtcatcgcatcaaagcagtcgggctccagttggaagccaaaaaaggatacgccggctacgggagggggtggaagtaacaatcataaggaccgcaagcgtaagcctgaggaacttgttgcaactgctactcactcttctcgacagcgttcgcgcgtcaacacattcgacaagatcatgaactcccaatgcccgcatcatcctaactccaaccacgcggccaaagattgtttcgtctacaaacagttcgcggaacaatacaccaagactacacggaagaactccgacgaagaacaaagcacgtcgaagaagaaggacgatggcgaccccccggcaggttttcaagaccaccgcaaggagcttaaccacatcttcggcggccccttggcttatgaatctaaaagaaagcaaaagttgaccgaacgggagattaacgccgttcagcccgacacaccccaatatcttcgatggtcagagacagcaatcaagtttgaccgctcggatcatcccgaccgagtggtccacccggggcggtaccccctggtactagacccagtggtccgtaatgtcaagcttcgcagaaccctcatcgacggtggcagcgcactaaatatcctcttcgccaaaaccttggatgacatgcagattcctcgctccgagttaaaaccaagcaatgcgccttttcacggagtcattccagggttatctgcaactccactcggccagatcacccttctggtcacctttggcactcgggaaaacttccgcacggagaatatctgcttcgaagtcgccgatttcgagacagcgtaccacgccatactcggacgcccggcgttagccaagtttatggccgtcccgcactacacttacatgatgatgaagatgcctggtccccgaggagtcctatccctacggagcgacatcaagcaagccgtcacatgcgacaaggaaagttgcgagatggcccagactcgcgagatggcgtctgcccgagaagatatccgactggctgcaaccacggcaagcgaaggagaagtgcccgcgaccaagatcttaaagagcggagaaagcgaagccaagactaaaaagattcccctagatccttctgatcccactaaaactgctgtaataggcgccgagttagattgtaaataggaaagcgcactcgtcacctttcttcaaaataataaagatatctttgcgtggaaaccatttgatatgcctggtattcctagagaggtgattgagcactccttacatgtcaaagaagacgctaagcctattaaacaacgactccgccgcttcgcacaagacaggaaggacgcgatcaaggagtaattaaccaagctgttagcagcaggcttcatcaaagaagtccttcatcccgactggctggctaacccggttctagttcggaagaaaactgggcaatggcgcatgtgtgtcgattataccgacctcaataagtcttgccataaagatccttttgggttgcctcgcattgaccaggtagtcgactcgaccgccggctgtgagctactcagttttttggattgctattcagggtatcatcagatccgactgaaggaatccgactgcttgaagacttcattcatcacacccttcggggcctattgctacatcaccatgccattcggactaaaaaatgcaggagcaacttatcaacgtatgattcagagatgcttctcgatgcaaattagccgcaatgtcgaagcgtacgtggatgatgtagtcgtcaagactaagcagaaggatgatttaatctcggatctagaagaaacctttgcaagcatccgcgctttcaggatgaaactaaaccctgaaaaatgcaccttcggagtaccgtcagggaacctgcttggttttatggtgtctcatagaggcatacaagccaacccggagaaagttactgctatcctcaacatgaaaccgccaagctcccagaaagacgtccagaagctgactggatgcatggcggcgctcagccgattcgtttcacgacttggcgagcgggggatgcccttcttcaagctattaaagaaaacagacgatttccagtggggacccgaggcacagaaggccttcgaagatttcaagaaactcctcaccgagccaccagttttggcctcaccacacccgcaggagccgttgttactatatgtatcagccacctcccaggttgtgagcacagtcttggtcgttgagcgtgaggaagaaggccacgtccagaaagtccagcgaccgatttgctttgtcagcgaggtcctagccgactccaaatcgagatatcctcaggttcagaagctgttatatggtattctgattactaccaggaaattatctcactacttccaaggtcactcggtaacggtggtcacatcgtttccgctcggcgatatactgcacaaccgcgaagcaaacggacggattgctaaatgggctttggagttgatgtctttggacatatccttcaagccccgaacttcaatcaagtctcaagcattagccgacttcgtcgccgaatggaccgagtgccaggaggatacccccgcagaaaagatggagcactggaccatgcattttgacggatcaaaaaggctttcgggcactggagcgggagtggttttaatttccccagctggagaaagattaagttatgtgctttggatacatttttccgcatcccacaacgtcgccgagtatgaggcgctcctccatggactacggatcgcaatctccctagggataaagcgtctaatagttcgaggcgattcacagctggtcgtcaaccaagttatgaaagagtggtcctgccttgacgacaacatgacggcatatcgacaagaggtacgcaaattggaagacaagttcgacggacttgagcttagtcacgttctccgacacaacaatgaagccgccgaaagacttgccaactttggatccaagcgcgaggtggcgccttctgatgtattcgttgaacacctttatgagccgaccgtacctcagaaagaaacagctcaagttgcggacactcataacatagctatgattgaagccgactggagagagcccctcatacgatttttgacttctcaagaactcccccaagataaagatgaagccgagcggatttcaaggcgaagcaggctttatgttattcatgaagccgagctatacaagaaaagcccttcaggaattctgcaacgctgcgtatctctagaggaagggagacaattgttgaaagacatacattctggaatatgtggaaaccatgccgccgcacgcaccattgtcggcaaagcttaccggcagagttttttctggcctactgcagtgtccgacgccgacaaaattgtgcgcacgtgcgaaggttgccaatttttcgccagacaaatccatttaccagctcaagagttgcaaacaatcccactgtcttggccgtttgcggtttgggggctcgacatggttggcccgttcaaaaaggcagtcggcggttacacgcatctctttgtggccattgacaaattctccaagtggattgaagctaaaccggttgtcacaatcacagcagataaagctcaagatttcttcatcaacattgtgcataggtttggagtgcctaatcggattatcaccgataatggcacacaattcactggcggagtttttaaagacttttgcgaagacttcggaattaaaatttgctatgcctcagtagcgcatcccatgagcaatggacaggtcgaacgagccaacggcatgatacttcaagggataaaagcgcgagtttttgaccggctaaaaccctatgctggaaaatgggtggaacagctgccatcagtactttggtccttgtgtactacacccagtcgggccacaggccagtcaccttttttccttgtctacggggcagaagcaatgttgcctagtgaagttgaattcgaatctttgcgctttcgcaattttcgcgaagaacgctacgaagaggaccgagtggatgatctgcaccgattggaagaagtccgcgaagcagctttaattcagtcggcccgatatttacaagggttgcgacgttatcataatcgcaatgttcgatcccgtgctttcctagtcggcgacctggttttgaggaaaattcaaactacacgagatcagcacaagttatctcctttatgggaagggccatttatcatctctgaagtcacccggccaggttcctatcgactcaagcgcgaagatggtacactcattgacaattcttggaatatcgaacatcttcgtcgtttctacgcttaagtttatccatgtatctccctatcttgactgtcaacatcaagcttacttcttgaggttgtcagtcgggggctaccataataataatggagtgtgattttttatcaatttagtttgcttacttggtctatcattgccttgtttgatttttctacttagtttacgaggactgaaagtttttaatagcttttgcgggttttaggctcaacaaagcttgataaaggcttttaagaaatcaacagctaagccagaaacaccaagcacagcataaatataccggtattgtacaaattgagcctcatcattcgtcattcgatgcatttacatttaatcagtatcagtcttctcatcatcagagttattgttactagtcggccgaaggtcggtatcctgaaaccgatctacgacgtcaccagcaatcttgtcggctgctttttgagcgtcgttgataagatcaagggcagcctcttcgcttgtcccgtccgcaaaaccatcaaaatatcgatcttagggtacagggatttggtcattgctaatgctaagcctactcccatgcttccggcttctctaatgttcttgaaataggtgtccggagcgattctcagcttgtcaaacacttcggaagcatcaagtctactcgggccattgttattatagaacatcgcctggacaagtggggtagcggcattggcgacctcgtccctggctccttcaagtcttttgatcttgccaaccaggacgtcgaactgggcttgggacttgatcttgcggtctacaaaaacaaatttatgtcaatgatctgctgcatcaaagagagaaacttaggttgttggctgacaataccttcaacctccttcaaagccgagtccctttgtgcagccaattctgccttgttattttctaaggcctcaattcgtttctccagttgagctatcttggcagcttgcactgtttggattccagacggttgaggatacaattataacagcacaaattaatggggcagatcttgaggttaccttttgatgagccactcagttcaaagttcgaatcctggagttgggtaatccggtcccttagatcatgctctgtctttttggcaagctctttggcttcgtgtagctgatccctaactgcttcaagggtccctaaatgaggaaccagcttttctaaagttgtggttttggcctcattacggagatggattctctgcgcgatgattcacggtttagtcttgctgagaaaaaacaaggtcaccaagggcagccacctggaagacttacatttacaatacgggtagcttctccgagtgctttcttcagctggcacacctcctcgtcttctttctgtcggtttatgacaatgcctgcaggttgcgagttctcgtcccaccatttgattaagatagggggacgagagtcagcagctgcctttatgcgagggatttcctctccgtcaccgcctagtggtcctgatgtattcccagacattagacaagtgaatcggagttattcagattagcattacttgagaagatgggttacctgaggtgatttccggttgagcgtgaggtgatccttgccctttatctggagacccaagcgttgggtcgttaccagcgtccggtccttgggaagttgtagcctgaacttcaacttcaggaatttcttgatctggacctacttccgactgattgccagtcgggggctcttggttttttgcggtttctgcttctgccgactggtttccagtcgggggctggtcgcttggattgacgttatcagctgaagtctgggcgctagtcggctggtcctcagtagtcggcccagcttctttggatgaacctgtttctgtgttagccggatcagaatccttcccggatggatctatgtcggacggtttcttgcaaagtttccttccagttttcaatattatcttcatgagagaagcatgttgaagtgaaacggtaccggatggtttatacctggaggattttctaaactttggcatggggcggctagacagtttcttcttcggagcagtgtgctttggtaattttttgggtgatcccttatccccaaatttattattgtcgtcgccttcgtcgtcgttcagcataagctttctcttgtgagaatctgtctgcccagtcggattgggagtttgggattgggagtctgacctgatttttggtcctccactcccctgaccggtctgatgacgaggagatcggcgttgagcgattggggggtcagactttatcaaagcaaattcctgaatgaaatgcctccacggtcagttaattcaacaagaagacaaaattatgttttgatcacggtttgaagagttctgatacataccagcggaggtggattgaatgcattgtatggcacgactggcagcagatgcgaataactgacgacaatggcgtttgagaatatcttgtacatcctctccttcatgatcttaaagtccagagaatctgggtcttcacggtttggatcatgcttgccgtcaaactcgaatgctgtgcgagatctctctttgattggagctaatcggcacttaatgaaatgtcgagtgatttgctctccctgtaagccttgctctttgagcttcaacatgcgttccatcagttctaaggcttgggcagcttcatctcccatgggaagagagttccaggtatcttggtatactgggggaagacaggagtactcgggaagagcgggctcgggattttgaatataaaaccagttggcgtgccatcctttgtttgaagtcttgaagggcatagaaaaatacttttggctcaaggtccctctcagttgaaatccagcccctccaactacgcatggtttgtttttgttcggttggggcttaaggaagaagattcggcggaacagagcaaaatgaggcctaatgcccaaaaaagcttcgcagacatggacgaaatttgcaatatggactatggagtttggattcaaatgatgtaaactgattccatagaagttcaatatcccacggaagaactttgaggttggaagagcaaatccgccatagaaaaagtgagaaaaaaccacgacctcatgtgtatcgggggttgggaaagcttcaccacatgctggccgccatccgatgatctccttggctgggagaacgccgtgcgccaccatctccttcaagttttcctctgtcacgtcggacgacgcccattggccttcaaagctttctttttcttccgccatcgatttgatccgaatgagctgatctgattcgagggatggctggggagagatgtggaattgaagcggtgagtcgcggggaggattttggtgaactttttgaaggtggattggagcagaatggtgaaccctagtttcgccggcgcagttctatactatagcaaggaatggggaaaatggcgagagtcccggtggggaagacgaagcgcagcttagatttcgggattttctgttaagggtttcgggggtgctaatgggcctaggcctgaacagtacttcagcccaatattattaacagcgtggcccgttgtgctccttagggacttaggcatttttgctttggcaatttatgctcacaatggtgtggctcaatgctgataaaatcctttttaatgcggttatataattctttggaattattgcaatgcaaattaaaaggtacccgacagaaaagtgttatactatttttgtaagcttttttaggctgcaaaagctgtctgggttaatttgggatgacttgtttttacaatggtcattctcttggcgtgttatatgcctattttaattatggtgaagagtcatagcctaggctattagacttattaattaccataatttttataatatttgatgggttatctttagagttttctactcgggtgcctgtcaaatgtgttcatttgtgaactttttagagtgttattcactcagattctttttactatggctggaaagcagtcggctaaatgccttgttgggcgccgcatatgcttttgtcatatgatacatgattatgctataattttgttctcgactacatgtttcgtttgttaactaatcatatagtcgggggctacacctaattaggtgcatctattcgatgcacaatgttttttatcttttcgcccattacagtctttgtcttcgctactcggcaggccttagcaggaagaaattaaagcactcggattattatttttgagaaagctatgattgttgactgcaaaggtctcgggggctactgtggagattatggataccccatatctacacggcgattatatttagactggatataggataccgaatatagatagaatatctttatctgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaacttttctggagattatacatccaataatacactcggcggattcatccccggacaggagtagggtattactccttgaataagaaggcctgaacctgtataaatcctttgtcttcaaacccatccacttttctagcttgatagccacccccttttagtattgccgaaatcttgtttcgacaaacctcaaaagccaatggaacacacgtttggcggtctatccgacctactaggatcggtctgaccgaactctaaccggtctaaccgcaggtcctctcgcggtctgaccgtcagcctgaaaacagcacgacagcgcttcggtaaaaacacgatttctcttaaaccaaccgttggatcgagttgaaaacttgacagaataaactagacaaactaaggaacaactttactggagggatttgcaaattaataaacggtttaagagaaaacaccctcgaaagttagatgtatcagaattgcagcaaatctgaacaaaacctaaaagttaagcaaattcaaatctaaccagaaccaatcaacgaaactttccagatgtgatctatgaagtattagaaaggttttggatgaattaacttgaacaaaatcacagcaacacgaacaatcacaagttaataccaaaaccaaacataaacgtaaaacttacgaaaccggaatagatcgtcgatgccttgacgattgaatatgatctttattgctaaagtatattgttcacaaggtgcagccagagaacccctcaaaagtttctcacaaaaccctatctaatatctcaaacttggcttcctaaaactgatacaggagggccacaccctctccctctatttataccgaaaacttcctactcaaattaggagcataactcctagttccactaggactttatccaaattacaatctccaaactcatctaaaccggaatcctgatctcagcggactccatccaacgcaagcaaatcgtctccagttcggactgcctcctcggccgactcgatctccatccaaccgagccgctgcatgctgctattgcacagaacgcacaaacacacacgcatgccaacctactagctgcacatgtacagccacatgtacatgctagcccacacagtacgcatacacatacatgtacgtactgcacgctacagtacctccacgtactgtagcacatcttttatccttcatgaacaccgacggttgcacgcacacctcgtgaagcccgttgtgaagatctctcccacacggtgtccatccaccgtatgccatctcgtatccaacttcgtcatccggtatccttgaccgtctgatccccaccgttgaccgaagttgacctccaagaatcctgactctagtcaccttctcacatggtatcccgaccgcactagacctctgctcctccctgagcatagtcccagtcctcaccattgaccaaggttgacctcaagtcacctgcacacaatcagacaaaacaaccgtttctgggcacagatatcacaacatgacccacattagtcacacgcactcacaccaacatccacacatctttttaaaccaattcattgattaaatcatttacacagccaattgtttatcacaaatattaatcatgacaataatttcacaatttgacgagcataccaatttaaaaccatggactgattgttttatgtaatttcagctacgagtctgacgaagatatgtgcaaaaaaccaataacttcgtcctcatcaagaaaaagagcagctaccttagctgtttatgtagtggctccagtgcttgtagtcgccatgcttgttgtagcatatttgatctggagagccaaaagaaagccccattgtgtgtactactataatctgcattgaaaaacacattgtttaatatctgcattttaatactgctaaatctgttctttctgcaccagtttctacagatgattctcccatggtaccagaacagataggtcctcccagacattggataaatcattgggaccatctacaaaaacctaagaatcatcgattcacatatgaggaactagcgaagttcactgatagcttcaaacgtttaattggacatggagggtttggaaatgtctattacagctgtttagaagacagtactgaggttgctgtcaagatgcgaaccgaatcatcgtcccacgggcttgatgagttcttagctgaggtgccaaatatagttagtattatgtttaaccacaaataaaatcaatatttacagtttttcagtaaaaaatattcaatatttagaatggcatatatgtgcatgtaaacttagggtgagtttgagagacaggggattgagaagattgggaagatacgtaaaacgagatgagccattagcgcatgattaattgagtataaactattttaaatttcaaaaatagattaatatgattttttaaagcaactttcctatagaaaatttttgcaaaaaacacatcgtttagtagtttgggaagcgtgcgcgcggaaaacgaggtgttttctcaccctatctcacacaaacgaacacagccttagtcacatccactgtgaggtttcgtacccatcaagagatttgaccatttgttttatcacattacataggttcagagcttgaccaaggtgaatcacaggaatcttgtttctttgattggttactgctgggagaaggatcatttagcgcttgtctacgagtacatgtctagtggcaatcttagtgattatctgagaggtttgtccattgcaatctttaagtattgaatatttgggaaatctgcactacgccggaccaggttatctctgacgggcccaaaccctcacctttgacgggtttggtcttggtcactgattagtggtcactgatgacaaaatcacctgtgacgggtgaacccatctctgaccggtatataagtcatctctgacgggttaaaacttgtcacccgtcacagatgagtcatcagtgacgtgtcgtaactaccgtcactgatgactcatctctgacgggttgtaacttacgacccgtcactgatgacaaagcaagaaatataatttttgaattttaaacgcaacaataaaaacctcaaaaaaatattttgaattttaatagccatcctatacatcactacctacaaattcacaatttttcacacaatataacttgcatgctacacgtgagattcgaactcaagacctcaacctccatatagagctcccttaccaatacacctactcagcacatattgactactcacccaatgttgttattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtattttgaacatgtaaactttgtgaaatgaaaatattttcaattataatgttgtagatctgattgagttctatgactttgatacggggcatgtatccatccatgtcatttgaaaaaaactcaaaattttgtttttaaaagtagatctgatcaacttgtaatgcatgttcggggatgtaaacgatctctaatagaaatgttgttagttataaagttgtggatatcattgagagctacaacttttatgtaagacatgtctcaatctgaggttttttgcaaaattttaaaatttgaattttcactcatcactgacgggtcataactaccacctgtcagagataacgttatctgtgacgtgtgttagttaaagacccgtcagagttgagtggtctcttttgtgatggttcataatactacacccgtcacagatgacatgtcatctgtgatgagccatggttgtgaccgtcacagacgatctgtgacgggttacaagtgcaagccgtcacagatgacctcacatctgtgacgggtcctccctggtagccatatattgaagaggatattttttcggcccgtcagagatgactcatctttgacgagttgcgttggcctgtcacagatgacccgtcactgaagtccggatctgtagtagtgctgagggaggatattggacatatacattacgcagacaaactagttggctatagtcatctttccttctttacaacttaaatactccgcgtgtgcccgcagacaaactagttgactcatgttgcacaacagtttgcagaactatgacaagtagtactgcttacctggagagagcatagttagactttttgaggaaaaaaaagactggagagagcatagtttttttttttttttttttttttcggggatggagagagcatagttagtctctacctaaggggcttcatggccatcgcttaaactcactaaagatatcataatatatttagagcaatttttggatactaaaatgtgccctaccaatcaattggttttttgaatagtagatgtgagtagttcgcattaaagctaaactattagcaatgcctaaattaatatggtaactctacatgtaccaatcaaatttgactctaaattggttctaaccaaagatgatccatgcaactctaccctaaaaaaaaaattagtagtacccaaactttccatggttctaatagtgccaattatttagtacgatagaaaacaaaaaactacccttaattctgccctcacgtatggaatatgttaatcttgcagtaccatttttttgtcataattgttcatcatctcattatcaagacatctcattaagacaacacaataataaattgcgtggatgtttaaaattgtatacaaaataattgtttttgcattattgatggtctatctcgactgattgtgcagacatagtaatatcaagacatggttgtatctatctaataaatcattacattgattctatccttttgttaaaggaataatactgttttgacttgtcaaataacaccccccccctcttcccctccctcccccaccttctaattgcgtataagtaatgtatgaaggcaaaactagcatgggtggaaccatgaattgggcaacacgcataagagttgtgcttgaagctgcacaaggtatgctacagtaagaaggcaatgacaaatacacagagaaagaatctattatatgccactgaatttatcctactttaacaatttgtcatcaactttatctccctctataatatggcactgactttacactactacaataagcattttcccgtgcggatgaattcaatttttgcgtgcgcaggtttcgactgtctggaaggtatcgtctgcaaaaatcgtgattttttcgtgcgggcgacgcacccgcacgcgaaagtcgcgtgcggcgcttaagccgcccgcacgggaaaatgaaaaatcgaaacaaaaaaaaaagaaaaaacaaaccctaaccctaatccagtcgccaccgccgccggcaccgccaccctagccgaggcctgccgccgtcgcccccgcggtcgccggcgacggatccgccgccggctaccgtcgctgatgccggatccgccgcccgtgcactcccgcggctgccggggaggggatgggaggggagagggaggggaggagccgcggccgcccatcgtcgccgccgcctgcgcccgccgccgcctcctcacgtccgctcgccgcgagcccgctgccacgagctcgttgccgcacgcacgccgctcctgcccgcctctcccgccagccgccgtcgagcccgctgtgtggagaaggaggcgtcggccatatggtgagaagaaggtgagagagagaggaaaatgagaggaggagaaggaaggtgagaagataaaagagagagagaggagagaagggggcctggggggagagagagaaggaagttaattttcttttaatatgatgggagagaagtctattttcctgtgcgggtggattaggaggcccgcacgtgaaaatagggttattttcgcgtgcggacctgttaagtgacccgcacacgaaaattaatttttgtgtgcgggcgatgacccagcttcgctcccctcatttttccgtgcggtctaacttacggactgcatagaaacaaaatggggtggtgtccagaaaaatcaatcctgtagtagtgttacagtatgctattgtggtggatacttttctgaaatgcctagaatgcccttcgagttatccaagagttgacaattgtttaacccactagaagttttgaaaaaatatgaaagtttttgtgtacttagccttcttacaaaatatagaagtttgtgtgtatatttcaaatttttctttcaagttttttaaataataatttcatatagtgtttgaaagaggaatcatatacacaaaagatagccacatcacaataaaaaaggaacaacatgtgaatgatgatatatgttgtcgaatggacaactacgtcacgccgaaaggcgtggttttctcaacagtggttggaaataaagacaattgtattgctttgtaaaaatttttggatccccccattacaaggcctaagggggctatttatagctctattacaggttccttcctttagggtttagattttacaggggaatttatatggctacccagtgtcctttacatgtattgggcccttattgggcttagatggcttggcccattcgttcgtcgaatcctcctcgagagtgtaacggcccgttgggcctcctcgcggtagggttcggcgctcggcgaagcccgtgtctccgtgctaaggctttcgcctcaccatcttcgcccgcggaacccttcgacaaggtctttgcctggcgaagcccacgttaacccaagccacagccttcgccaatacggtttcctcttcggccttggccctttgctttcggactgagccttatcgcccgagcgggtggtttcgacaggtctggccgaaggccctttgtggtatacctccaacaagcccctcacgggaaagggtgagtaggaagcttcggccgagaccgtgcaagtcatgtggtataccgcgaggcgctcctttcggccgatgttcatgctgaaacctatgctacgcacctgcgatagtaaaaagtttgctcttgtgttaacgaaaaattttgaaggaaatttccttactatgttcgcaaatgggtggcgaaggggttagattgcccgtcatgctgttattgaacagtgatgggctccatgggctttgctgtttctgctttcggcttttcactgtttggcctcggcccgatgggaatttatcgtttcgtctaccaccggacacgtgtcgggctctgattggttggtagacgaaacgtcgcgtgacggggttatataaccctgccgctggttaccgcttctccccctccactttccatttttaccgctgccccatctctgcgctctctgccttttgctttcgcacttgctccttggacattctcactccctttcgcttttcgacccctcctttcgacacggacttaatggctccttgcaaacccaccaaagccgggtcaactggcaaagaccccgggggcctcggcgaaggttggtcgtgttaccttggcaagtcacttgtcaaggaatccgacctggctgagttcgtccactccggcgcccttgcaaggggccaggcaacgtgcgggggcgaggccgttgtcccttcgcctggtgataggcgaacgattgttttcgccgccttcctcaccgcagggcttcgccttccatgcgacaattttcttccgcccgtgctggagatgtacgagctcaagctaccccagctcagtccctcggcgttccctaagctggccgtcttcacatggatgtgccgaacatgcgggttcgctcctaccgccgagctgttcgccatcttgttcacggcatgcgctatgaccaaagacgtaaacataccggccagttcaaggaaaacggtcttcagctgtgtcaactttatgcttcggccggagcgttcggatgcatggccggtgcctgcgttgatggtgaaatgggaccgcagctgaatgcagaagtggttctacgttgccaacccgtaccctactgaggacgacaaggcgaactggcttcgctttcgacggctacttgtttccatcgtcgctaagccaagtgtggaggtcgaccgcacactcgagtccaggctcatcctccttcgcaaggttgcacggaggctaagtgcccgcgacctttgtgaggagttctgccttcttcgaatctctctccttgctcatgaatgagtggtgtgttaacaaccaaatttggtaattttagtatcggagatgaggatgaaaccgaagcagaatccaagagatagatcgtgctgaaagcagagcaagaatcggctaaagtccgaattggctacgattgaatcaacagagttcgagtcagacaaggttagccgattgagccgattctgacaatatgactcggtgtacatcatcgggttaagtttaagtgcttcatatggattgccatacatggctagtgtcctgaaaaggcaattgtacttattaattagggtattttatgtaatttccttagagataagcttgggcaaaagtctgccgcaaagacttacggtatcttagagtttgttagagataagagtcgtgtccgacatggacatattttgtaatctcgggtataaatagaccctgagccctatgtaaaaaactaacacacgttcaaatacaatctctgcgcatcgccacccttttactttcgttttgtttcgacgagttcttgctttcgagttgagctacatcgatttcgatcttcaattagaggtaaaacttgttatggcggcttgcgttctcgggattagtgcttccatctttatgatgctctaatcttgtttatgtaatttgtcaagttatcatatattctatataatcttcagcaatattgttatcgaacattcaatcggctaacatctattgctagaaggcagccaattaggttagattccgatgttgatctagattatataggatatccaccaccttatgaaacattcaacagcttgattgtctagatattattcttcttttcatacttatagctgtatcagttgagtttgatcttataagtagtgattagaatcatagtctctagcctgcttttggttgccgattaaggtagtatcggggtttcagccgatcttacctgatttagccttatatttcatgtgcttaattggtatgctagatctgccctttatattgagatctttgttgcttttaggtatattaagcttcttgtttgatatatttagcttgctttaatatattaatatagagtagtatcagagtattagccggtacttgctagatctatctgatcgtctatgctataaacatttataatctccttgctagtatatatttcgatctaagtgatttatactgtctcggcatggcgaccgatctatcccaatcacttgatttaagtatatatcgacataaggattgtatactgttaatatctacagccgatcgagtagatttagttttttattatttactaacatatgccgatcgatgcaaagatgacatcggctcaaagataaattatatgtcatcggcaactagccgatcggctatcgtttatggatttaagctcggtttctttgtctttatttcttgttgtttgcaagatcaaattaactggcacgctcatagttccaaaggcaagatttcttggacctgcactggagttaagcagatctcccaggccttgtgtttttcacatcaacacgcttttggcacgcccggtgggacaagggtttttgacaacttcttcccgatggctgagaaaccaccaccgtcaccggggacaggagtcaagcctcccgtgggtaaaacgggaagcgaacaaccgtcaactgaagtggatcccagcaacattgttccgatcacattggataagctgacgaccgagcaaaggggcgagctcgaacagatgatcagcaatgtcaaggatcagttcatgaattcttttcgggagactcgcaaagggaccatcgttcagagatacaagctgaaggtagttacagctgatgaggttggctcaagctcgtctcagggcgataaaggtgctgcagctggctcgggtgataaaggtgatggtcttcaggaggggatggtcgaagatcttggaccagatggcaatggactagaactgcagtttgacaatttctaggatcaggtcaattatgccgtgcaacatgctttgatcaaccaatctggagtgctggttaatactctaacaaacatggtgaaatctgtggtcgatggttcaatagctgagcatcaagctacaggaccagtgtatttgccaggtggtgttttccaaattacaggcctttggttacaggcaatcagcaaaatcctgctagtgcaccactaactcagccgatggcatcggttacggctcccgcttcagctgcacaagttgcaccatcatcggcatcaagacaaatgactaatcctaggctactgaccagggaacagccataggatgccggtcaaaacatcaatcggctgactcaggagcaggtggctaccatgttcttgccaaatccaccagctgccgatccagcactgccgattcagcaaacgccatcaagacagcaggctacccagccgattcagcaacaaaacttgctaaatgcatcggctaggatgaggacgcctgataatcagctaaggcagcatgttacaactcaagttgtcccggagcacctggttcataatgtgcaaccagatcagacaatgatacctcaagttatacctgaacacttggtgcgtaatatacatccgaatattcagaactataatgggggatacttgaattatcaatatcagcctccttcacctcatgttcatcaagggggatcacctcagcctcagtttgctcctcagttcaatcaattcgagcttgtgtcgcaacaagcacaaggggcacctcagcatagacagtgggccgatatgatcgcagatgtaatgagagagaaatttgggctcaagccgaaggatactgggaacttgtatcggcatccataccctgagtggtttgaaagaattccattgcctgcccgatacaaggtaccagacttctcaaaattttcagggcaagataatgtttctacttatgagcatattagccgattcttagctcagtgtggtgaagtatcggctattgatgccttgagagttaggctatttcctttgtccttgtccggatcggcttttacttggttctcttctctaccatacaattctatcaatggttgggccgatttggagaaacagtttcacagctattgttacagtggagtccatgagatgaaactgtctgatttgacagccattcggcaaaggcatgatgaatctgtgcaggattatatccagaggtttagagaaacaaggaatagatgctacagcttggctttaacagattctcagttagccgatttggcttttcaaggtttgatagctccgattaaggagaaattttcatctcaggagtttgagagcttatctcaccttgcacaaaaagtgactctgcatgagcaaagatttgcagaggctaaaaacaactttaaaaagatcaatcatgtatatccatgcatgtataattcggatgatgaagatgatgattccgaagtagcagcagccgaatgggttagaagcaagaaggttgtgccatgcccatgggagaggagttctggaaaagaagagaagtttgattttgatatcaccaaggctgacaagatttttgatttattacttcgggagaaacagattcagcttcctgctggtcatgtcataccatcggctgaagtgctaggaaaaaggaggtattgcaagtggcataattctggctctcattctactaatgattgcaaagtcttcaggcagcagatccaggtggccattgaaggaggaaaaatcaaatttgatgattccaagaagccgatgaaagttgatggtaatccttttccagttaatatggtgcatacatctgggagggcagccgatggaggaaggaatagaaattttcagatgaattcggctagaattatcaacaaataccagaagaagtatgacaagcagcagcaggagaggtattatgaagaagatggtggttttgatcctcattgggggggctgtgagtttttcagattttgctggaacgagggtatgagactaccatctattgaagattgtcctggatgcagtaatgttgcagaaagttcaatgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaataacgatctagcgatggcttcagctccactcccacaggcagctcaactggggtataagccaaacgtcttctccttctggaacctttatcttcaactgaggtttgatgattattgcaagaatgagcatacttaacaagccacacagcaaatatgcaagtgcacaaggattccaaaggatggcataatataggctcatttgcaaaagcagcatttagcaaagatttaagataagtaaaacagtggagtaattaatcataaattttaatcaacactgaacaacacacccatgttgcacaggcccaaccattctgaacaaccatacccggctgtacagatctaactccaaaccaggagctaaacaaattattaccagattataacatccataattattgtgagaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaccccctcaaaaaccagaggcatggactccccagcgacccccacggacttctcgccgcttctcagtctggcaccccgcaatgaatcatgctatacaaaaggtaaagccgttgcccacgctggcttgtggttggcacggttaatgtctcgcaacagtagctcgcgaaccggtccttaattgccatgagcacgactttcaaaaccatgtgctcacaacccacctttaatcaagttttaattatcaattaattatcataacacgattaaccatcgtgagctaccattaaatataaccataaataataatgtagtatatatgattcatccaattagtgagctaatgtttctaagcatggctaagcaattatatatatatgtagcatttagctaaaccaaaccaatatataaggttctagctaatcaaattataacccataggaaaataaagtcatcttcggccattaattaattgggaaaggttcaccacccggtgacattcgaaaacaatgcatagttgaaataaaataataactttaaacgggttcaacatgctcaaagggttgtttgggatctgtgtgacttgccttgggcttccgcaaacacttccgaaccttcctcaacgaaaacgctctccttcggaacgtcggaaactaaagcgaaagaacaaaattcaacaaaacagtacaaaaacaagcataaacagtacatgtggatatttttaacatgtagatcttgattttagaaaaatttagcaacttgaaccacctgaaacggatctacgattatttagttatgattttccgaagatttaatctattagaaaatcgggaaaaagaaaagccgatgatgacgtcatgatgacatcatcaatggccggaccaagatggcgacctcgccggagattggatgattggctgcgaatttggaggatatgtacacgtagaggacgacgagacgaacccaacggtacttaccctcgagccaaacgacgaccgacggtgaccggcgacgaggtgaacggcggcggcggctcggacctcgccggcggtggagctccggtggccggcgacgaagggggacaggaggccgggcttcccctcgccttggcgcaccccacggtggtgacggcgaccggcggcgacgacggaagcggcggcgcgacggcgccgaagatggccggcaacgacggcaagcaagacggcggcggcgacgaggctacggagcactagagagctcgggaaagagggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttggggaaaaggatagaggaggataagaggaatatttcccctcaactaattttgcaaacggagctcgggatgtggcggatttaacggaggaagcggtggctgcacagggcacagcacgggcggctcggctctgtccaagcttgaagatgaacagtgccagggaggaaagtagacttcttgccgggcttttctacttccaaggactgattaaaggagggacgcaaagcagacttcgggaaagagaggaaaagggctgcaggctgagaggagactgggccgagagtgagaggacttttcctaattcggcccgaaaaggaaaaggtgaattttaattacttttccaattaaattaatcactgaaatgatctttgaattgttaaaaatacttccaatgctcaaataattccaagaaaaatcttgaacatacttggacactcaaagtacttaacaaaattataattagaccatttaatgattaatttaatatgtgggtaattactgaaatgctctttgtatgattaaaaattaggaattgagctccgaaaaatctgagaggatttcagagagaataattaaccatggagaatttaataaaaattaaatccatccatgctttatatttaggaaattttatttccctcatttaacttcactagtaaattaatgaacatttaatataaattctgataataatttattaaataatttataaatcctgaaacgaaaatcagggtgtgacattcaagccgatcttacaatagaggtaatcggctgagacaaacaagagtttttgttcattaaagattaggcccagtaaaccaggggtatgatcaaggagatgatgaggatagaaaggcttaatagtgtccttctggtattttcacaaagaatcagaagaggagggttcaaaggttgaggaacagagaacgttttcgagaggtagagcaggagatcagtcatcggctgaggaagacaaagccagggcaagagtggcgtgttaagaaccaagctgccacagccgatgaggttgaagcggatgaggcaaagaggttggctaaagggaagagtgtcgtaattgcatcggtgaacatggtttttacactacctgccgaatttagggccaatcaagccgatgttgatgaagttgaggaaacctctgcaaaattggttttttcaccagagcaagcagtttttgagaagccagaggggacagagaatcggcatctcaaaccattgtacattaacggttatgtcaatgggaagccggtgtctaagatgatggttgatggtggggctgctgtgaatttgatgccatatgctacattcaggaagttgggcagaaattctgaggatctcattaagataaacatggttctcaaagattttgggggcaatccatcggaaacaaaaggagttttgaatgtggagttgacagtcggtagcaaaaccgtccctacaacattttttgtcatcgatgggaagggttcctatagtttgttgcttggaatggattggattcatgctaattgttgtactccttcgaccatgcatcaatgtttgattcaatgggaaggcgaccagattgaaattgtgccagccgacaggtcagttaacgttgctagtgcagatttagctatttgggagatgggtggaattgattgcctgtctggaaaagtttgggatggaggttttctaaaagtgtccgattgtgatatacagccaattgaagatggagagcccaagttattattttgagggagtcgtggagggttcaaacgtctacaacaaggacacggcagatgatctcgatgacaagcaaggacagggtttcatgtcggctgatgatttagaagaagttgatataggtccaggtgatacaccaaggccgacttttattaagaaaaacttatctccagagttcagaaccaagttgatagagcttttgaaagaatatagagattgctttgcttgggagtattatgagatgccaggactcagccgatcgattgttgaacatcggctacctatcaaaccgggggtcagaccataccagcaaccgccaaggaggtacaaagccgatatgcttgaagctgtcaaggctgaggtcaagcgtctatatgatgctggttttattcgtccatgccgatatgctgagtgggtttccaatatagttccatttatcaagaaaaatggtaaaattagggtgtgcattgattttcgagatctcaataaagccactccgaaggatgaatacccaatgccgattgcagatcaattggtcgatgctgcttccgggcataagatattgagttttatggatggtaatgttggttacaatcagatctttatggcagaagaagatattcataaaacaacttttagatgtcctggtgcaatcggcttgtttgaatgggttgtgatgacttttggtttgaaaagtgctggagctacatatcaaagggctatgaattacctaatcggctggttggttgaagtttatattgatgacgtggttgtcaagtctaaggaaatagagaaccacatagccgatttgaggaaggtttttgaaagggctcggaaatatggcttaaagatgaacccaacgaagtgtgcctttggcgtatcggctggtcagtttttgggattcttagttcatgaaagggggattgaaataactcaatggagtattaatgcaatcaagaaaattcaacctccagagaataagaagaagttgcaagagttgatcggcaaggtaaattttgtcagaaggtttatctctaatttgtctggccgattagaactgtttacacctttgttaaggttaaaggctgataaagaattcacctggggggcagagcaacagaaagctttggataatattaaggaatatcttagttccccaccagtgttgattcctctacagaaggggattcctttcaaattgtatctatcggctggagaaaaatcaatcggctcggtgctgatccaggagcttgatgggaaagagagggttgtattttatttaagccgaaggcttttagatgcagaaacaaggtattctcctgtggaaaatttgtgcttgtgtttgtatttctcttgcactaagttaaggcattatctattatccaatgaatgcactgtgatatgcaaagccgatgtgatcaaatacatgttatcggctccaatcttgaaaggcagggttggcaagtggatatttgctttaacagagtttgatcttcggtatgagtcaccgaaagcggttaagggacaagctatagccgattttattgtggatcatcgtgatgactcaatcggctcagttgaaattgtgccttggacattgttctttgatgggtcagtttgtactcatggttgtggtatcggcttggttataatttcctctcggggggcaagttttgagtttgcctatactattaagccttatgcaactaacaatcaagacaagtatgaagcggttctcaaggggttgcaattgcttaaagaggttgaagccgatgctattgagattatgggtgattccttgtttgtaatcagtcaattagcaggagaatatgagtg

SEQ ID NO: 59003 - DNA, 9909 bp, Oryza sativa
tcctgcagcccatgtcactgccataaggtgtttgaggaagatcttgtttctggacttatcttgaggttagttaataatttactggaaatgatttaattgattatgacctagtttacatattaatctacatatgatgtaacctgaaatgtgatttgattatatatgatttgatggaacctgaaatgtgggcatgctcaagatgatatctcttcaagttgctgaaatgataatataggctataatgtcaatagcttgctgtatggagcagtgtttctttaagcttgctataggactgttattctattccctattatgtagaagtaatattgagtccatgtcttcaaaattattgcctaagtggacactttggcagacaacaaaaaaagctccaattctgactttaaaatcagaatccgaaatttatgagcagtgattcaatctgaaatttgtgattgttgggcatgtttatcttttgaatttgaatagtatatattgatatatgatctcactgaagctgaatctgaaaatttataattatgtatctgaatctatttttttagtatgtcaggtaataatatctagaagatctgttcaatgtgggtcacatctgtgcgattggaagaatgcaatgtgatcttctgctgctgcacatgtaaccggtcgatctcattgccaagcaaggataatttacttcctagttgtctgaacatgtaataattcactttgttgctacctgaacatgtcacctgggaccatgatattcattgccatgtgattttgatatcttttaccttgcctcgaataatgatacatgttcctattttaatataaatgatgattttgtttcctttgttgtgtgaacatgctatctgcacatctgtatacatgtggtttaaaattagaacgatagaaccagtgttgagtccaacaaacaagtccaatcttctacattgtcagaccatacgatgtctcccaataaaccacctagcagatgacgtcgaagacaatgttgatgtcgacattggcgactccaaccttggctctgacgtcaaccttgatgatgatgccgccgtcgacaccgacctcgcccttgaggatgatgctgttgtcgacctcgacctcaacgatgatgccgccgatgacgccgacctcgacctcgaggatgatgctgccgtcgatgtcgacctcgacgatgatgccgccgtcgacgccgacatcgacctcaacctcgatgatgatgccgccgtcgaccttgaccttgacgatgatgctgccatggaccttgacaactttcatcctatgaatatatacagcatggatgactttatagccgaagcaacctttttggatgaatatagtgaacagattattctcaggctgaaggagaacataacatctgagccacctcgtcgtctatgtcaaagtggtacaagacggtacgtaccaagaaaccgtgaagctggcaatgcggatcttgtggccaactacttctccaagtctccaatctacacagatgagatgttccgtaggaggtttcggatgaggaagcctctcttcctacgaattgtgagtgccctgagtgaatggtctccttattttactaatagattgaatgccactggtagagcaggacattcaccacttcaaaagtgtacggctgctatttatatgctagcatatggaactcctgcggatcaacttgatgaggaattaaagattggtcctagtacagctttggagtgtttgggaaaattcactgaaggagtcattgaaatatttcgcaaagagtacttgcgagctcctaggagtgatgaggttgaaagattgctacaggttgctgagtcatgtggttttcctggcatgtaaggaagcatagactgtatgcattgggcatggaaaaattgcccggtctcatggcgcggccaatttactcgtggtgacaagggagttcctaccatgattctcgaagcggtagcatcgaaagaccttcacatatggcatgctttttttggtactgcaggatccaataatgacatcaatgtgttaaacaagtcacccttattcattgaagcattgagaggggaagctcctcgtgtacagtttagtgtaaatgggaaccaatataacacagggtactatcctgccgatggaatttatccagagtgggcgacattcgtaaagacaatacagcttcctcagacagacgaacataaattatatgcaggtcggcaagaaggaacaaggaaggatgttgagcgagccttcggtgtgttgcagtctcgctccagctcggatgtggaggcagggcgacgttatcaacataatggaagcttgtgttattcttcacaatatgatagttgaagatgaacaggaaatggctgaaattcctttggatttaaatgagaacccaggagcatcgttcgttctgccacctgaagtgaggaactcctctgaccccaaccctttctttgctgcggtattacgaagaaattcatctattcgtgatcgtgcaaaacatatgcaactcaagaaagatttagttgcacatatatggcagcgttttgggaaaaagtagaactactttatgtaacgaaataatgtaatttagcttatcatttgcttaaataataatttcggatgtgtgtgctggtaggatgcacatcatcttcttttatatggttatgttaacacaatgtagcgttagttctatagggaagaaatacaaatatatgtatggctgaaatttacatttgattacatgcaatgaatttattagctatttattaccttgtattaatacagagttggttaaagagacagtactttgtaggtaggagttttttttgctgatgtggagtacagagagagcccacactgagctctacctttgaacatgccctaatatctattgcagatcatgcaccatgtcttgaatggtaagtaagaagaagggataagtccattttacacccctcaactcttgtcattgtgtaaaattcgcccccaaactctaaaaccgggtatccaacaccccctaactattaaaactgttcaatttatatcttttttatattttagacggttttggcccacgtgtaactgagatggcagtccaatcagcaaaaaagtatatataaaaaatgtggtaccatctgtcagtcaaccttcctcctttttttctttcttcctttctcgatatgtccaatctcggcgcatggagaaggtgatgttcctctctcgatctctactctcccctctctctcggtgcagggaggcgatggtgctcggcgtgtgcaggtggaggcggcgtactccggcggaggcggcgacctagaaagaagcggctcggagcggctacgacgagctctgtcagaggcgatgacgctcggggagacaacggggagccggagctcggtcttgttggcacacgaaggaggaggcactcgggaaggtgggggagctgaagctcgagctcgccagcgcatggaggggaagaggagctcaccggcgcatggatgaggaggcacttggggaggcggttgggagatggagtttgagctcactggcgcagatctcatgggctcgagctccccagctcccgcctccaggagctccatcttctccatggaattgagctcgccggtggagcttgcgctgcttggggatgcagagttcggcggaggtgacggggcttggggataaggaactcaagctcgacgaggcggcggcggatgcggagcttcagctcgacctcgtcctcgaccaaccggtgacggtgctccatagggatgactcctccccgcgcgtgtagctccggcgaggtccgcctctttcgcgcggggcaacaagctcgtgattcctgtgggaggcggcggcgacctcctcggcctctcgctgctccaggcgccacccccatcagatcccgtgccaccgttcaccgcataatctcccccacctcgtcatcgatgtcgatggaccacccggggaggggggctcgccgagggtggagggatgatgctaaggatggagctgacagagggagggagctcgccagtttcttttgcttaatcttatctaaaggggaaaaaaggtggatggagatggtctgaccggtgggacccatgctgacatggcgcccgaaactagtctaaaaccgctctaggggtaaaatgtctggtattaacaattggaggatgtattatacctggttttatagtttgggggtgtattttagacaaacataagagttcgagggtgtaaaatggacttttccctaagagggaaattgagggggtaaccgagtaaccattgattccctgaattcaagagttatcatttacacggcggaactagccactgataatttccgaccgtatttgtattgtgaagcggaagagaaagccctgaatacaatcatactcattttaacctttcgcctattataagcaacaaaaatataaaatgtaaactatttgactgttacacgttttttttctgaatgcggatgacttgtatacccctacaagcagcaaaataaatcagcacttttgccaatcactttaagtacatcccattagcaggttcaaacatgtaatgatgtcacataacatttcagtttgaaatagagaaacaaactggagccagacattccctatgaaactactaatttacattcagcatgcccccatcacataacccgtttagcacaaggtattgcgtgctgagatccaaggttgggcatgcatacgtaaaaaggcttacaatgtctgcacgatctaactcaatattcaaaattcaccatagaaaaaaaaacattttttcaccaggcataagcattaccagagaggaagagaggaaacagctcagctccgggatggtctccagttgtttatccattctgtcagtgtgcccacattcctactgatatcctccacattgtcacttcgcaagggcatcactatctcctctttgtagctctcccttgcctcctccaggagcatctggaaaatttcacattctatgttgtttgtgagcttggcacccatataacctctgtgaatagaactcttagtcagaaataagcatttcataatggctattccaacaggtgggtgattgtgcagttctgcatgaattacctgctagtcaagcgatcatgcagaattgagttatctgtttggagcacaactacaaggtcaaaccaacgttctggaaagaaatcacatccatggtaatctactagtataccaccttcttccatcacgtcctcaagctcatcgcaaacctgtcaaaaaaggaaccattcagtgcaattctaaccaacaaaagaaatgatatacagccaacttaagcaatttgcaaagttggaacaaccaatcatgtacttcctttacttcacagttcacatctgtgaggatagcaaaagtgcagaagggagcagaccaaactggtccagataggatgataaccaatcaccaaaaactaccctggacgtcagattttctcagttaacatcagtgggcatgtaattcattatgctaatgattttttttcgtatgttcattgtgagaatgcaatggcattttaattgtatacatctcagaaaaaagcaataataaaactctctcaggacatttacaagcatccatatgtacaactaggtgtaattagtccagaaaatcaggacatgaggttcagcgctgaattattttttggggggtatgcagcatattgtacggccaaaaattaatatttaatatataaatgagtatcaaaacaaaaaaaaacaaaattgcatgatgcagaacatccaaaatattgatatcttcatactagtttttgttcggaacaactttctgccggtgcagacataatcaattcataagacagattgagcagcctgaatcaattcctacatgctttcatataaataagaagggaaaatcattttattgataaagaaaaactgatggtcaatccatgaactagcaaaccagccaccagactgatttgattccctagtccaacattttgtactggcttcactaaagattaaaataaattgttcatattgcattgctaaagacaaatgatgcatatttcttttattgtacagcctccatatttttgttacatggagcacttaacatacataattttaattgtaaaacttagctttacactacatatatatgctatcttaggcctttcattttaagtattattctggagactaaattgaaaaaagtaacaatatgtgctagtactaatgtgtaatattgaagaacttcaaagactcttagtaaaaaaatggtgcagggttggtgggagtggcaaattcactgccatcaccaccattggctttttctaaaaggacatagatgcttagggaccacctatccgtgaaaaacatgagtagttatgcaaaaacatttgttatttattgttttaataaagtatgattaacttacataaacaactaaatcaataaatcatacacttatattaaaagaacaccctgatcaaacatagggacataaatagcccaaattagcaactttgtggatttataattattagcctttttgggcatcaatcaacgcaacaaattttaaagctgaaaagtagctctttatttagcatacctccatctagaaattcaacttcaaatctaatgtgttcagaaaaaaaaacaaaggtaaatcactgccaacataattttcgtttacaattacacttttataatgttataaatcataatttctacacaggactgacaacctagaaaacattgtttgaagagcagtagtaggaagcacctaaaatgcaaatgcgcatcataaaactacaaatacattagaaaactatcacaaaactacacatttcacataactatatttttggccacttataagtaggccccacagtctagattctgtcgcgtttaacatcagtggacaaatgtgtagtttgcaaagtttactccaataaaaatgcaaaaaatgcccataatcaggccatctaatatgtcgctaaccaaaagttcatggtaatacataatacaagaatgctaacactgagtatacacatcactacaattcaagatgcataaatcctaccctaacatatagagctagcgttcaaacaatattgcaaaataaaaattactgtccatcgattagaattgccagcagatggaatcatacaataaactccattattaggttatggttgttgtaaattcagggtgcaggtccaaactgacaccgctgtcaaggaggataggtcagtggaacatcacacacaatgagaatgagcaactttccatggcttgagccatggacactacatcaagctaaaggagaatggggacacttatatggaaagtgttctcccccagattatagtgttttcctactaagcaccagcattggtagagtcatagaaggaaatcctaggtctacaaccatcatgaaagacaagagaactttgctccaagtgctacaacttcttcagtttataacattatgataggcagataccaccataccagcctgtaatattgctagctttacagattacacgctgctacttctttatgctctacctatactcattcttcttgcatgtacatgttttcttctgtatactgtaatgcgctgattcttcagcatatttacatgcaagtatgtctgctgcatctcaagtaactactgcaagtgatgcttctttagtaaaataaaataggacaaaaaagcaggcatccctaagtccttagtttttatcaattaacagaatagacaactcaactaatggatttggacctcctgttccatcaaagttgcacaactaggcctttcactagaaatgcagtctatattaccttcattatgtttgagtgtaataccagaatggcatgatcactatttcaaaaagcacaagatagtgctcacttaatagaagtgtgagtgggaccatgtatacaaaacaagcacttcccgttttcgaattatatttaagtgtctgagaatattttcctgaggctctttaacccaaaaataaactcgaggaacaactctggattcacatttatgaaagaatgagaacgacttttatgcattcttgatcgagtaatgaacagttgatttgtaggatagtttcaggacaagaaaacacaggccctttctttttttggtacctgaggaactgtgcatactggattacttggttgtggtaatccaatgctttccttcatcactggcaaataaaattagtttgcttgcgctataattttcagccattataaagcaaacaaattcacagcttcatatccaaccctgcgtcacaacttcaatctactacaatccaaaatctaaggctaatgatgaatatagattgttcggaatgcagaatcgaacagagatttggattggattgggagagatgcgcggtagggcgggctaataccaggtcctcgttgatgatgtggcactcgagctcctcgtcccagccgtcatggaggctcttctcgcggacgaggtccccgatgttgatgtggcggaggtccaccgcgtcggcgaggagtgagcacgtcgtcgtcttccccgtgcccggcgtccccgtcaccagcacgttcggccgcgtgcgccgcgcgccgccgccccgcgacgccatcgctagaatcggcggctggttagggttttttcgtcctctttttcccggagagaatgggccggcgacgtcacactgctgccctcctggactcctggtggtaccgtgtaagtctagtggttgtcggctggttgggccgggccatggttgagtctgatggtttgggccgtcagccatgtgtccctggtatataggaataagtctattttacctctcttgtcttctctctggtcgaattacatccctcaaacataaaactgggtataacacctcccctaactttaaaaaccggtacaaattgacttctttagtggtttgggaagcggtttttttgctgacgtggcaggtcgacttggtacaagtgtgctgacgtggcagcccagacattgaaggaactaaaaatagaagtggctcccacatgtaagtaataaaggtaaaaataaaaaaaggtgaagcctatttgtcagcccacttctccatctcttcttcccctcttctatttctttctcgagtagctgctgctgctgctgcgttgtgcatacacggaggccgattcgaccacgtgcggcggctgggcggtggtctcaggttgcagcgatgaaatccacggcggcagtcgtctccaccatggcaccatgcggcaccactcgctcgcgaagatgtcgatgaaggcctcggctggggtgggcggcgccgtagtcgccgacgcaaaccttgttgaagacgaaagggaggccaccccatccgtcgaactactttgggcttcaggaacatgcgggttggtgaagaacgacgcgcacatctcagctacaacggtttactggcacaggtggtggtggggggtgggcactagaaaggcggtggcggtgaccccttatctctccctctccttccttctccaagtggtgcggcgacgaggtgcggtcgcggagcatgatttcggcggtagagacggtgatggtgcggtagagatccggtccacggctctgcagcatgcgtcatggcgctgatgacgatggtggccaccgtctgctccatcgccgctctttcgcctactgtcaccgctccagcccgccaccgaccactccctcgggctccgctgccattggtccagctcccggcccctgcaaaccgacgaaggagagagagactgaaagtgaaagtgaaagagaaagagaaacaggagtgagggaggagaaagaagggaaaggagaaatgatgccgatatgtcagtggacc

SEQ ID NO: 59004 - DNA, 4618 bp, Oryza sativa
taatgttttcttgcagatttgcactctcagagtatgtctgttaagtggaattttgttacttctttccatgctatatatattgttaataggatctgctacttcaccctttgttttcttgtaactggccttacaacgtaggaagtgaagttccccatatcctcgttgcattctccaccagtactttacttatgtagtactagtactgtatgttgcttgttatcactcttgtaaatggatagttttcacttgcatgtcccaacttatatttttatttttctaatggaaggactaaggatgtctttctgttcattgggtacatttattaacttcaaaattatgagcactttgctatgaccggttgccgataattttatgttagtttttgggagacattactagaaatagaagaagaaggtattaggcccttttagaatctggttttttttaatcagttccatgtgaactgaacgacttcgtataaatcacggggaaaattcttgcattctaaacagggccttattaggaggtccacaaaaccttgagactgacgttgaaagtgggctgctactaagtgaccgagttgtgagttctgacaagtgaataattggcttccacccctgctcattttgcaccaaaattgattgcacaccagtcatcatcctcggtataagaaattagaaccttaaaaaaaaatctatactcctttaaaatggagtagtggtggtagtgagtgatgattttttttttatatttttagagaaaggccaaaggcctggcttctattaaaagcccggggggggggggggggtctgggagatcccagataagcgtttgcagcacagagaggactttgcctcaacaaaagtaaaggaaggactgactggactactaaagcagaactcaacttgacagcttcaggtttagtatataaacagacactaacgagaaacagaagcagccacaaaacggagacatcagccaattccagttcttctattcccaaatcttgtgttcaccattcttagcttttctatcagcacctccagacttgctagctcatcagcgcgtcctaaagccttccactgcataagataagaaacaatttgaaaggagagatgcagaggtgagtaaacaatctttgacctgaaaatcatattattcctagtgttccaaagaacccagcaaatggaggcgagtagagccgtcataactctgagcctcacttttgaaacctggccaacaaacctaaaaaagtcatcaaaacctccaggacaagcatcccaacccagtgcgtccctctacagatgcaccaaacgaaagtggccatagggcagtcaaaaatgatatggtcagtcgtttccttgttgccacagagcaggcaattttcagacccaaccgaccctttaagtttcaattgctcacaagattggattttgtctctcagggctagccaaatgaaatgtttcaacttcatagggcaaggacaacgccagacaaactgtaatctctcatctaaagcacctctgaacaaaatagctctgtacaaggattttgtggtatacttcttattagaatttagacaccatctcaaggtatcaggggaagaggacaagaccaggttctcaatgatcagcttaatttgacgccattgttccaattctatgggacccatagatccaagtgtttcaggtctgcaatcaaaatctcttgttgattgcagatcataaatagctcagtaaaaatgatcttcagagggcagtcgccctgccaaatatccagccaaaagaagatgtgagtgccattccccacctgccattctgagcccaagttaaaccactttcttgtattgagaattcctgaccaaaattgagaaactctctttgaggagcactgaaagacaccaccaaagatcaagtattttctcctcagtaattccacacataaactctcatcagaggattcaatcttaaaaatccatttggctagtagagcagcattcaaagtcctagtctcagtaaggcccagacccccaaactctttaggaaaagcaaggtcagaccacttaaccatgtggtatttccttccttgcttattccctgcccaatagtatctgcctctaatggagtcaaagttctgatgtaaaccctcataaagttggtaaaagtccatcgcataggatgagtgatgaatttgccatcaccaactcccaaaattctgatatgtgaccatgtgggatcaccatctatccactttctggtacaacagtagaagtcacggactcacggttagaccttggagctctcaatcatgttcatccttgcacaccaataataactagatccttttttacgggagtgaacctccaattaattctaaaagtaagctccaaaaatcaaaatatatttccgctttgcaatgtgctgattcgattttttaattccataacaatgtgcaacattttggtagtatagtaaatatctagaaaccatttgtaagctctaaaaataaaatatatttcctctttgcaatgtgctgattcgattttttaattccatagcaatgtgcaacattttggtagtatagtaaatatctaggaaccatttttgttttgtcctaaattttcaaagttttggtagtataataatgttgcctttcattcagcacatcttggattagatgagcacactgtggattagatcattacattattaagtttttccaaacgagaattatttctagagcagaacttctaaccaccatttggcatttttgtaggtgtcactgaatggctagaacaatgggttcaacacctacctactgctcttaccaaacaaatggtgttggcgctttaaagcaatcacctcatatgcaattccaacaatcgtacaactatggagttaggttcctaaagagggataccctttctgtgcggattaacaaacatatggccaaaagaatagcaacaagcactggaatttgcactaagcctaggaggtctcacatgcctatagtatgctctgctggaatgacaataatttttattgcaactgaatgtcacccatggtgcaaaactggaggcctcggtgatgttctagggggactgccccctgctcttgctgtaaatattctttgtcacgtattgttaaatccaacagtcagatcaaacctcagtgtttctagcaaaaaaatatattcacaaacacaggggtttgatctgattctgcaaacaatttatgctcctgttcgattgcacattcttatgcaactaggtttcattgagataactggttgaagttgagttaacaagatacaagttttgtacatcatgctaatatttaatgcaggatttatcattcatatgttttttcctacattgcattgcacttgccctttatgtacagttcatcttgtgtgaagaaactcattttatcataggcaatgggacatcgtgtcatgacaatagttcctcgttatgatcaatacaaagatgcatgggatacaaatgtccttgtcgaggtaaagtttttaaccatgctgtacgtatttagctggatttaacttataccagttttctgatgttgtagatgctaatttttcctttttacttctgtaggtcaatattggtgacaggacagaaacagtgcgcttcttccactgctataaaaggggagttgaccgtgtttttgttgatcatcctatgtttcttgagaaggtctgataaaccattaattacctgcgttctaattgagtgatgcaaagttctaaaagttttggtatctcagtacaccctttgaatcataaaactttcaggtatggggcaagactggaccaaaattatacggtcctaccactggagatgactaccgggacaaccagttgcggttctgccttttatgcctcgtaagtaaatgcatagatgtgtcgcaacagcctcagccttgatgtacaaagccatgaagtggctacactaagtagttctacaaattgtattgttttgttctatacagagacattcattagttgagatatgtatttatacactaagagaacagaatctgtaaattccatctgataatgtcatataaacgtccccagtcaaaaaaaaaatgtcatataaacgtcaggtttcagtaatttgatacgagcttttaaagtggtccctttttctatctatttatcttttttttttaatttgcatgtgggctcagctaatcacagttgtaggtttgggcaaatctaccattgactgtcagaaattgcatggaattagttttttttcttctaatttgtattatttttgtgcaatttcttctaatctgattgtccttttaggctgctttggaggctccaagggttctcaatctcaacaattctgaatatttctcgggaccatatggttggtttctgtatagtataaactatcacagataattgtctttctccctcattctatctgactgacattcatatttgttaatcaggtgaaaatgttgtcttcgttgcaaatgactggcacactggagtcctgccatgctatctcaagagcatctatcaggcaaaaggaatgtatgtgaatgctaaggtacatcatttcgctatctcttgcaccttatgcact

SEQ ID NO: 59005 - DNA, 36638 bp, Oryza sativa
  unsure (1)..(36638): unsure at all n locations
gcggtgatatggagtcgccaaccacctcgatctagccaaaaggctaaattaagatgggtttttatagaaaacagttaaaccggctagcgaagccgatttagagatcaaaatcagcctctaggccgatttagatcgatatgaggataactacctgtctcgtgggcaaacggaaggttttcagaacaaatctacaaagaagtgtcgcactctcgtagtggcggcggacggtttacggcgtaaaccgacaaagatggactaaaactagggtaaaatagaaaacatagtaaaagaacgattcaagtagattgggttacaattgaaccggtcttatcccttaaataggggttggtcttgccctttacagaccctcctccatgtccaactcgggatagaaaccaaagtaaacccgaaacatgccttcccaagcaagaaaacacaagacccgatgaaaacatactcgggcttagactctgacggtctgaccggccacatacctgcggtcagaccgcccacatacctgcggtctgaccggccctctctggaggaaaccgacatagctccaaactttggcaatcttttctatttcaatcctaggtgtcaaatttgggtgtaaacagatagcatggttcctcattttacattgcaaatactgttttcgtcaatgtagattggtattttaaatcgagagtgagccgttctaccttttggtaatattagctgctggacacccacgatattattttattatatttgaaggacatggaaatagaaatatttgttttagacaggtttgcccatggagttcgacacgttcctcaatctcctgttggatcagagcagcaaccatgtgggcatcgacgtcaaccccatcagctccaaggcctacacaaacgtgtccgatggtctggtctcggaagacgccattatggctgcgagcatcagctacatatatacaacaacctcaccggcttcccggcttcctagctgttcatctccagatcggcgacggcaagccgtacaacgtcagtgcgccggtggacatctgtgacggcatacctctgatgggcctatgaactggtcagagatgaccgtcacctttgacgggtcgctagttttgccgttatcggtggggaattcggccgcgacccgtcataggtatcccatcacctgtgacgggccggaaggaaaagccgtcataggtataccagtgacgagttttgcttccaacccgtcattggtatcccctcacctgtgacgggccggaaggaaaagccgtcataggtataccagtgacgagttttgcttccaacccgtcactggtatcccctcacctgtgacgggccggaccggcccgtcacaggtgagaggataccagtgacgggcaactcaatcgaagcctgtcaaaggtatgaccaatacctttgacgggctttttttacctaacccgtttaaggtgtgttgggtctataaatactctccaaaccgccaactgctttccatcccgaccagttcactgttcacaaatcggttgggagggcaagagggtgaatttttgctaaaattcaaggtaaaaaacacattattcttcccttcattctcaatatatcaatcatcatatatttttcttcctatgttgttgatttcagatggatcgcagttggatgtaccatattcatcgttcgtctacagagtatagagagggggtcactaaatttgtcacatttgcggagaatgacagaaaaagtaggatgagcatgtacatattgtgtccatgtaaggactgtaggaatgaaaagatgatccttgatagctcaaaagtgcattctcatttgataacgaatggattcatgaagaaatatacctgctggactaagcatggagagcaagaggcgccggatgtcgcagctgaagaagtgttggatctggatgtagagaacaccgccgcagctcgagaaggcatgtttgtaccttctccgttaggtggagagaccatagatttggacactcaatgtctatctacaatgttgcatgacattgaagacgcagaggataacgacagagattttgagaagtttagtaagttggcggaagattgtcggatgcccttgtatgatggatgcaagtcgaagcacagcaagttgtcatgcgtgttggaactcatgaagcttaaggctagtaatggctagtcggacaagagttttacctagggttgacctagggttggacctcttctagatccagatcgaccaccactctctctcactctcactcactctctcgaccgccgccctcctctccaccgccgccgctcgccctctccgccctcctctccaccgccatctccgccatctccgtccatcgagaccgccgtcctcaccgccctcctctccaccgtcgccgcctcactctctccgccctcctctccaccgtcgccgcgcgccctctccaccgttcgtcctcggcgccgccccgccctccacgacgccgaacctcgacgtcgcgtcttcaccgccgaacctcgacgtcgtcttcgccgctctccctctccgcacgccatccccgccacgacatcggacgtcggccgccacgacgccgggatccacaacgccgggatccaggacgatcgggatccacaacaccgggatccacaacgccgggatccaggacgaccggcgaccagcgccgccatcgcctctcagacctcttctcctcggccagttctccctgaccaggtacgccgccacccctcctcctcctgatgaatggattgatttgagtcagtgatggatgattttggatccatgtgtatgattcggatgaatgcaggactagatgaattagcttctttgtattatatgattttgaatgaattttgatgcactggatgaattgctgctgctgctgctgttatataaccctatgttatagaatgaactcctgttatagaatgattgttatatacacttgttcttttttttttttgatgaattgctgccctgctgcccctgattgcctgattttgatgattgttatagaatgaatttgctgctgctgttgctgttatagaatgagtgttatttttttatgcataagaacagattatctacacttgttcattttgttatgtacacttgttcgaattgctgctgctgttatagaattgttatatgatcgaattgctgctgttgctgcccctgctgccccttgttcagtgatggattattgcgatttgatgcatgaattgctgctgctgctgcccctgtgccccttgttcagtgatggattattgctaaatggccagtgatgaatgctcaataacattatgtctagacttgttcatttttttatgtacacttgttcttttttttatgaattgctgcccctgtgccccttgttcagtgatggattattgctaaatggccagtgatgaatgctcaataacattatgtctagacttgttcatttttttatgtacacttgtccttttttttttgatgaattgctgcccctgctgcccctgtgccccttgttcagtgatggattattgctaaatggccagtgatgaatgctcaataacattctgtctagacttgttcttttttttatgcataagaacagattatctacacttgttcttttcttatgcataagaacagattatcaacacttgtcctttttttatgcataagaacagattatctacacttgttctttttttatgcataagaacagattatctacacttgtccttttttttatgcataacaacagattatctatgattgttcttttttctggattgataagagactatatacactttgggtctttttcatcctagtagttgatttcctctttttttcccttcatgcaaatagtggtaattgatgcataatttctgagcaaaaccgaggccatatctttcatggtatataatgctaattagtataatgatagaaaatttataagctttttcggaaaaattagaccatgacaacgcccggcgcaaacccgtcttccctgacacctgcgaggatacaggaagaagcaaacccagccacagagactgttgccgaaggtcatccctcgacaacggcggtcgaacaacccgaaagtcatggtaatttataggataaattttcactacatgaccacataaattttagctagcaccccttagcatatgttgccttctgtgtgctgcagaatcgccccagcaagaacatacgtcaatatcgggtgggacaagtacgagtaaatcgagtagaaaccccccggacacaaaatatatggccgaccacagcgcaagttataagagaggttgacgctagtggtaggcccacggcgccgaggactgtcattggaagatggtctaactgctacgggctggcggcacgtgtgaatttcgggatcctccataaagatatcggcaaggtcacagaagccgagaaggagcgagcttggacggcaatggagaaatggctcacatttaaggctaaagcaaaggataggctcaagcggaagtcattccataagatgggcaaagcttggaagaattggaagtcgaagctcttcaccgagtttgtcaacccgcccggcaatcatacgccgttcgatgtttaccctcaaataaccgaagaggtgtgggaagaattttgctctctgaagaacacccaagagtttagggaatcaagcgagaaacatcaccaactgcaacagcggaatgagcacccgcatcggctgggcaccgcagggtacatcggcaaggagccaatatgggcccaagaggatgctgccactgcagcagcgaatgtccctgccccgttttcggacatccctgaacacagagctcgcaactgggcgcgggcaaggggtaaggtcaacccggacggctctgtcacatttcagaacaaaagtgatgtcgtcgtctatcaggaattggtgagttcactacttaacctaactaattaccattcgtatgaagtagaagtttgtataaacgactcttgttgtttatagttggggttggttggtgaacaagcttcacaaagcgaggttgagtccgtgccgaagaggcgcgaagatgacatcctcacaaaggcgctcggaaccaaagaacatactggccggactcggggaattggcagcgatgtgccctgaaagcacggactctcgcagtacaactcccaatacaggaaacggaaagtctccaacgaagagagggacgctcgtttcaaggccgagcttaaggtggaggtcattcaagaactacaagctagcatggaagatagggtggaagaaagggttaacaacgtcctcgccgacatgaatataccccgaggcacaacacctgctgtgcatccaactcctcgtgcacaacacgacgcgagtctgtcatagcgtaggagtagttgtgcatccacagaggtgccggccccaggtctcccgatcgcaccactagctgcagtggaccacatagaggtaattgatgttatccgatccatatctaatcaaaaacatttacacattccaatattaaattcaaacttttacatatgcagggcgtagcacagtgtgtcctactggcgaggatccaccaactttcgctcctgaagtcgctgagggcatggctttcaaaccctcggttacagataaggtccacggcgcagacctgctagccgggtatgccaaggtgtccatcgatacagtaaaggacacctggtcaggctatcggttgcccatgccccccaatgatgaaatcatgactttgggcgttgggcgcaagacgttcatacaatggcccaaagaagacatagttgtgaagatgacttctcgtccaaatcgaccgacggagcttacacctcccaaatctaagctatcaattgaggctccccgtggaccggcattgtcagtacctccttctcctgatggagatgatatggacttgggagatataactcaaagcttggctccaataaagaccacaagaaaggccgatagctccccaccacttgtgaagggccagaagcgtgaacgcgtcaaggggaaggtcggggagttagcaccggtgccaaaaaggggcaaggctgcgacgtcgatgccggagagcaaagcggggaaggtcgtgagggcgcctgcccaatttgagctaggcatgccattggtgaaggacaatgtgttagccgtgatgggtattacttgccgagagctacataagcaatacatggagctaagcaatgcctagcgaaaaatgagggagtcatccatagttggacatcacaaccaccagccgttcctatcgtcgcctgcctatgtaactataggctttgatgacctctccaaccttttcaggatccggaagttggacacaggacttctaaaatgctactccttgtaagtgctgaccttccatacttgtgatatgattggactatatctcctaattaaattagttctaatacgtaaatgtttttaggttgtgttggatcgagagtcgttgccatggtaaataggttgggttccttgatccatccatggtgaacgaggtcaatttacgccagagcttcactgatgtggttgactatgtcaaccgatgtttatgggcccaccaagacaaggagtacatcatgtgcgcacacaaccaggaataagaggataatacccttcgtgtatattgtttttgaagttaaggttcttattactaacgctacataaccactgcgcaggcgacattggattctcttagtcatcgtacctaagtggagtagggtttactaccttaactccaataagacgaaagattatgatttcactgatatcaccaaggccttaaatatggcttgggacccatatgtggaaaagggtggtaggcacaaggagggcaaggacgaactctattatgacactaagtttgcatgcgcacaacagatcagagaccagtgtggtttccacgtgtgcacaacatgtcaacactactaagagaggtgaaagatttcgaccctgagattgttactaatggcgaataagctcatttcaataccaatattgctattctaaatgtgaaaacatctgatttattaaacagaaaggtagagctggcttcaagatctcacccatcaacccccccgctatcagaggcgaagtgtgcgccttcattcttgcagaaataatgaacaagaaatgacgttttcacgtcaaatagactcatgaacttggctagataatttattgtgatataaaaaaattgtttttattatggagtgcaatgtaatttactttcatatgtgcaatatttatggtagttcgctaatttgtcatcaaatttgatcaactacgatttatgttgtactattcatttgttttctgctttttttttctaattgacaggtcatggaggtcgaggacattatgactttaatccatttggtaagtatatatgcggttctatgagcaacgaccgaaattatagctttcaatgggtataaatttgatgtgcaaaattgtggcatttgaactgcatatgtgaatgatgtcaatttttaggatggatctgtgatgttatattgggggtgactggaatatatctgtgatgtttctgtttttcagaaggcatggctagcaaatcctgaggctagccaatatttaggatttattttttttctgtgattaactcatcagtgacgggtcggaaccaaaatccgtcacaggtgacctcacatgtgacggactcgcaaataaaggcccgtcagtggtgacctacctgtgacgggcctttactttcggggccgtcacaggtagatcacctgtgacaacttctatctacggagaccatcacctctgacggcctttatttaaagggccatcagaggtaaatcacctgtgacgggtcctaactggccctaggctagcggagaccaacacctctgacggctgtctagtaacttgcccgtcagaggtgggtgtcacctgtgacggccgaccacccgtcaaaggtgactggactcaccagtgaccactgatcactgaccatgctcaaagccgtcaaaggtgagggtttgggcccgtcacaggtgaccttggccagtgtagtgtctgcccgaggaagtagcggtcggcttctccgcggtcaccgacgcctgcatcgagttgcatcatgatcaggtgctgtcctggtcgttcatctccactctagaaccagccacaaactcaactaaaattttccaccctgtcacatcgaacgtttgcacagaagtattaaatgtagactaaaaaaataactaactgcacagattgtgactaatttgcgagatgaatctattaagcctaattgctccatgatttgacaatgtggtgctaaagtaaacatttgctaatgacggattaattaggcttaataaattcgtctcgcaatttacatgcggattccgtaatttgttttgttattagactacgtttaatacttcaaatgtgtgtccgtatattcgatgtgacacgacgaaatttttcacccgtggatctaagcccaaatctcgcgaccattgcagctttgacagacacctcctcttggccagataggtagtacaaaataattaattactactccctctgtcctataatataagggattttgagtttttgcttgcaacgtttaaccactcgtcttattcaaaaaaattttgaacttattatttattttatttgtgacttactttattatttacagtactttaagcacaacttttcgttatttatatttgcaaaaaaaatttaaataagacgagtggtcagatgttgcaataaaaactcaaaatcccttatattgtgagacggagggagtagcaaatgacgatgataatcttagtattatactcattttgttcaacttggttgattaacagatacaggatcatcctaggtctcggctctgcgctacgctatctccacacggagtgggatcaatgcatatatattgcacggcgacatcaagccaagcaacattcttcttgactctttcaggcagcaccaagctggaggattttcggctggcaaggctcgtcgactatggcgccgacccacggactacgcaggttgttatgggcaccacagggtatattgaccaagcatcgagcttgacgtctacagctttggtgtcgtcatcctggaggtagtctctctggccgctggccggagatggagcagacggaccaggttatcccgctactacagtggatttgggatctgtacgatcgggacgcagtcacggatgtgtacaatcgcagtacgatcgtagacacgaagctagctgcaggaggttggccgagagtgtggcaccgtagaccgtgactgcgattggcagctccagcgtacggtcaccgtcgggctcgagtgaacggccgtccattacgagagccatgaacgtgctgcaatcagacgatgtgactctgcaggtcctgcaacggcggcagacttcgtgtcccgacgatttttgcagattgcatagcggcggcgactggttgtcatcagctactactagcacgggcaggtgacacacgtgtaatgtagggacctgggctagataagtactcctccgttttttaatatacgccgccgttgactttttctcacatgtttaaccattcgtcttatttaaaaaatttatgcaaatgtataagatataaatcacacttaaagtactatgagtgataaaacaactcataataaaataaattataattatataaattttttgaataagacgaatggtcaaacatgtgagaaaaagtcaatggcgttatctattaaaaaacggaggtagtactagatagccagctgccagcacttgcacattctaattttattggcaactatacatttgtgacgccatttttttactaaaaataatctattcgtttttactttacgcttacactgtaaatttcagtagttatatgctataaattttctaatacacattacacataagaattatgatagtaaatcaatccaatatgggatataacatattctactattacgaatgtgttaaagagctagtgttattcaaacttcagagctgtacaggctaacgagtaggattctaatcgactaagggtgtgtgtttagttatttcggtgtaaagttcttaaagtatacggacacacattcgaagtattaaatgtagactaataataaaataaattacaagttccgcctgtaaactgtgagacgaatttattaagcacaattaatccatcattagcaattttttactgtaacatcacattttcaaatcatggcgtaattaggctcaaaagatttgtctcgtaatttacatgcaaactgtgcaattggtttcttttttcttacatttaatgccccatgcataggtccaatcatttgacgtgacattttttgccaaaatgtttcaggatctaaactaggcctaaactaggcctaagtaaatagttattaaaaaaattgaccaaatagattaatgtgtaatatatcacttgacaaatttgcaagttcaaaatcgacttctataaattgtaacaaaaatgacaaattaaactctaactagtataagtatatttatagtcaaatctgttattttgttacaaattccagtagttgaatttaaacttacattacatgtttgtagagtgatatattattattagtattctatattgtcatttaaagaaaaacataaccaattagttcatatgcaatgaacaagtactccaaatttgaattcttttgatactgcttgttatcactacttggacctggaccattttgttcggtcttgtaagatgtaggttagatgcaatatgtgttttgaattgggccacattaggtagttttgctctcaagcttgttctaaatgggccttttctgttacatcctgattttcgttttaggatttataaattatatttataatttatattaaatgttcattaatttacaagtgaagttagatgtgggaaataaaattttctaaatataaagcatgattggatttaatttttattaaattctccatgattaattatactctctgaaattttctcggatttttcagagctcaattcttaattttaataatacaaagagcatttcagaaattatttaaatattaagttagtaattaaatggtttgattataatcttgttaagtactttgagtgttcaattagtttcaggatttttcttgaaattatttgagcattggaaatattttaacaattcgaagatcattaatttaattacaaaagtaaattaaatccccttttccttttcgggctgaaactggaaaagttcacctttagttctcggcccattctcccttcctttcagctgcctttattcctcctccgaagtccatttcttgtccctccttcaatcgggctggataaaagaagcccagacaaagtctaattagccttcctgctacagtatcgtcttcaagcttggacagagcccgtgcagccgccgagccgtgtgtgccgctgccgattcctccgcccgatttgctcgattctctcagccgtttcttgaattagttgaggagatttgtttcccttatcctcctctatcttttcccccaaaaatcctattttatccctttgaattcgacgcgaatttggattcgttttcgagtttatctctccttttcccggcgcgattccatccgttcccgagccgatctctccctcttccggctataaatagcagctcctaaacctcctctttcgttttccaccctcgcccgagctcgccgtcgcccgtagcgccctagccgcctccaccctagcgccgccgccatcgccgtcgccgagtctccagccgtgccgctcgtcgccgtccatcgttgccttcggtcgccgtcgccaccaccgggttcgcaaggaggagctgcacaccgtccacccctcggtcgaagccgaagcctgccggagcgccactgacgccgtcaacccgagcccgtcgccgcctcaatctcgtcgccggccgttttccgtcatcgattgtcgtcgccgtcaccatcagtgagttcctctcgtcgtcctcatcgcgtagatgtcctcggttggcccggccgagtcctccatcgccggcggtcatgtggtccagtgccttgttccggcaatgatgtcatgccgacgtcataaagcccctttttcccttctaaaaataaatcttaattgtgtcataaatcgtaaatccttttccgtataaggctaaaatcagtttaatattgtaaaattcataactaattcatatgaagtcggaatgaggccgttcaagtctctaaattcatctaaaatcatgatctacatgtttgtttactttttatgtactgtttatttagtttttattagtctttttcttcgttttgtgtgttagcttgtcgtttccgtcgttgcgaaggttcgtgagtgcgtcggaagtgtttaagaagactaattgaagaccgattattgcaaggcaagtcacacagatcccaaacataatcctttgaacatgttgatctcatatttaaattctctatttatttcaactgtgcatttattttcaaatgtcaacgggtggtgtgaacctattcctttgttatggccaatttgcattgaataccctattacttgataccttgggtaataaattgattagcttgaaccttatatattggtttggtttagctaaatgctatatatatatatatatatatatatatatatatatataattgcttagccatgcttataaacattagcatatgattgggataactaatgttacactaccacttatgattatatttaatggtagctcacgatggtcaatcgtgattggttaattaattacgtgccaactaaaacttgacaatggtgggttgtgagcacatggttttgaaggtcgtgctcataacaattaaggatcggttcgcgagctactgttatgagacattaaccgtgccaaccacaagccagcgtgggcaacggctttagcttttgtatagtatggttcattgcggggcaccagactgtgaagcggcgagaagtccgtgggggtcgctggggagtccatgcctctggttttttgtttttgagggggtgattatgatctaggaatggtgcgctgtgtggattatgttgtgcgaggggtattgtcacagtcccgtttcgaggtaccgtggtggtactgagggcatggtaacatgttttggggctgtgtcttgtgagtacagtggtacacctctggccagagtaatatttttcgtgattagtctcacacctctcacaataattattgatgctataactggtaataatttgcttagctcctggtttggagttagatctgtacagccgggtatggttgttcaggatggttgggcctgtgcagcatggctgtgctgttcagtttgattaatattgatgattaattactctactgttttactacttctaaatnnnnnnnnnnnnnnnnnnnnnnnnnnnnnnctatattatgcgatcctttggtatttttgtgcacttgcatatttgttgtgtggcttgcggagtattccatgttttcaccttgcaataatcaatcaacctcagttgaacaaaaaggatctagaaagagaagacgtttggcttataccccagttgagctgcctgtgggagtggagctgaagccatcgctagaccgttttttccgctgcagtttttttctttacttttgtaagtatgtaacgttatcattatgatggatttgtatattaaattgtcagtttgtgtacctcggctaattcctggacgaggcttttatgcacaaataagttcaaaaattactagtgaatttctgggcatgacattttctaaacctaagcccactagcacggagaagggaggttgttattggttaataaatctgctgggtctcagaataaatagtttgggtaaaagaaaagctcccctcttctcctagtgtctcttctcctcctcctgcaatagcaaaaccccaatccaatctcacctgatcgccggtgaatgctgttatggcgaataccaacgctactgtagaagttatctttgccgggatggcgaaaatcacactagtcccggtcaaataggaactgggactaaagaacatttttagttggataaaaaagggcaatggagctttatgatttttagtcctgattggtgttaccaaccggattaaagacagccggggctaaagataaaaacatttttatacttcttcttcctcctccagcccgagccattgctacaaaggtttggaggaagaagggaggtgctaccaaatttttttgtgaaagtgtttcggtgataatatacaaatcgaaggaatctaaaaggttagcaactccatcctctgataatgtatgcttagtatattacatttatagttatggttatatacattattgtctctgaaaaggtttatggaaaatgacaagagagaaaatttgttaggataaaaataggttacttttaaaattagaaacatgtggataaaaatgttataaaatagatgacaaaggaaaaatatagaaaattaagataaaagaatagaaaacaaagttaatttaataaaatagttagaaaaagtacaatacattaaacatatcattagaactttaaaaataattaataatattaataatatgtgggattattgtatgattatttgtatatagttattgtatgattatttaattagcttgactttcgtggattttatttttacgatttttgtgcatttcaggtagatggatcggcaatggatgtacaccgcggaacgacggtcgacaaagtttattgaaggcttgcattattttttgagtgttgccaatgctaacaagcataagggttttacatgttgtccatacaaaaagtgcaaaaaccaaaagtagtattctacatcatgaactatttatgcccacttgtttcagtcgaggttaatgcctagctaaaattgttggacctcgcacgaaaagttaggggttgcgatggaggaagatgacgtagaagacgagaacattccggactgggctcaatacggtggatttgatgaaaatacaacaaacgaggcggacgagtgttgacgaaaaatacgaggcctgagagatctgcttaactccagtgcaggtccaaaactcgccttcgggtatgctagcgtgccagttgatttgatcctgcaatcaacaagaaacaaagacaaagaaactgtagttaaatccataaacgatagccgatcggctgagtgccgatgacatatcatttatctttgggctgatgtcatatatgaatcgatcggcagtccttaataaataagaaagaactacatctactcgatcggctgtagatatcaccaatatataatcctgacgtcgatatatacttaaatcaagtgattgggatagatcggttgccatgccgagacagtataaatcacttagatcgaaatatgtactaacaacaagattatatatgttcatagcatagccgatcaaatagatctagcatgtatcggctaattctccgataccactctatattaagatattaaagcaagtagaatataccaaacagaagcctaatatacttaaatgcaataagatcttgacataaagggcagatttaatatgtcagtaaagcacataaagcaaatatagttaaactaggtaagatcggctgaaaccccgatactaccctaatcggcaaccagaagacagggtagagattgaaattctaagcacgacttaatagatcaaactcaactgatgcagtattaagtatgaaaagaagagcaatatctagacaatcaagtcgttggatgtttcatagagtggtggatatcttatataatccaagctaacgtcgctatttaacctaatcggacgccttctattaacagaagttagccgattgtaggttagatgacgatattatcgaagattatataagatatatgataactcgacgaattacataaacaagattagagtgtcataaagatggaagcactaatcccgagaacgcaagccgccataacaagatttacctcttgttgaagatcgaaaccgatgcagctcaacccgaaagcaagaactcgccgaaataaaacgaaagcaaaaagggtggcgatgcgccgaaattgtattgaacgtgtgttagtttgattacatgaggttcggggctatttatacccgagaattacaaaacatgcccataccggacacgactcttatctctaacaaactctaagataccacaagtatttacggcagacttttgcccaagcatatctctaaagaaattacataaaatatcctaattaatagatacaattgccttcccaggactccatccatgtgtggcaatcatcttgaagcacttcaacccaacccgatgttgtacaccaagtcgtattgtcggaatcggctgcatcacctaaccaagtctgactccaactcagccgatccaatcgtagccgatccggactccagccgattcttactctgtttctgcgacaatcttcatcttcgatttcgcttcaatctagtcttcatctccgatactgatattaccaaatttggtcgttaacacatgccccccaagtccggaatattcgataatgtttcggatttgccgcatatcgactccgagcaagtttcgcactccgccgttttccgaccgttatcctccgtgctttaaatactaaccgccaccctgaaaaatctttaccccgttacttccgttttcaccgccgaagcaaaccccgtcctctctctctccggcgatttcctcggtgcgcgaggcgatccccaagcgacttcatctccggttagatctccgcccgcgacgatgtcttcttccgccagcccgtctaccgcaccgtcagctgagtacgctgaggtaagttcccgtcggctagatcccctttctcagcatcagattgatcttccaacacttcatcttgttttccccttcttggttcttttggatttgtagcatctttccaacctagttgcaattcccagcctgtcgcacgaaaattattactttctcggcccagtcggcaaccctgatcccaccgagttcattattggcgaaaccaataggattactttcggattgaccaacccagatttaggtcactagaaaaacactttcaaatcctggccatcccttgagaaaacctcacccgagaaaagttggatcacatggttcaagcgcatgtcggctagcaaaagatttcattgggatgaaattggaatcggccaagcacttgatctcaccatagccaactcagctaaagacgagcccctaatggcagctgcctcctatttttggtccaacaaacaccatcaatgccttcttgttcaatcaagggccgatgactccaactctcatagatatcataatgattacgggtctggatgtcacctcatcggctaaccctatgagcttgaacacgaagaaccaatatgactttaggaccaagagcataggcggctggtcaggctatgtagcggcatatatgggccaaggttctgtcactcctcgagaacatgtagcttttctgctaatgtggctagaaaaaatcctcttttgtggatcaagttgtggccctacaaccaactggcagttcgcagccaaagccttggagacaaagagacaatttcctttaggcaaaatcctcctcggctatttgtaccaaatgctaaacaatacatcggctaagttggccgtcggctcagtagtcggagcaggtggaccatggtggctattacagtcttggctgaatctagtagttatgaagtttgtcaatcggccatctgtaacagaagccgaattcccaagactggaaccgactgtagatgatgatggagaagaacgcactcatcgtagatgcacattttacggagaatatacctccacaccaaccgatgcaggagcaaagctatcggctgaactgctcaaggactggttctgtagtttttatgagggtttccaaaaagacactcgagtttggttcctctacgaagattcaacacttctggagaatccattggactttaggttcgaagatatcaatcatgaaagatatcagaaacccagagaaatcttttcagctgcaatcagtccatgtatcctccctgttggcattcatcatggatgaaacatccaagtttcttatgtgttttatcacccaatgagctcaaccagacaactaggaatgggccaactcccaatcggcttattctttgctgataagatccagtgccgaggggaaatttcatcaaccttaatgatggatcggctgcttaatctccaaggaccccctctaggcagcattgacaacatagagctggcaaccttcaggagcaaagcatttgacagatggtggggtgagtggaaactacacctattccatcaatcggcttctatgtatatgacagacctctttccagatgttgtccctcaggtatgtcttgacttgcttaatttcatttgaataattgtttaaccgactaatcttgattaattttccttttaatttgtagacaacagagtcatctcctcctcactagagcaatagtggcagaaatattgagtatgccccggggctgattccaaagggggtggaccatctcctcctattattggttataatgcccccaggacttcaactctccttcaagggctcgtcagagaaccagccgatgccggtaaaaagagaagaaccagatcatcggctgtggacacatcggctccagccccaaagaagaaggttaaattaaagaagcacaagccaaccgatgatctgcctgccctggatctgtccatcgaacaagctctggacgaagaagagattgaagaggacattgatcaagcggcagccgaattgagtgatattggaggaaaaacaccgtcagcctcgcccaagcaaactcccccaactcctgttgcaccggctaacttctcaagggtaaacatctctccttaattaccttttgcagttatcctattcatagccgatcactcataaaacttgtttttgcagaaaaagaagactgctgtgagaaagaaatcggcagcgacaacacttaaaccagccccaccagtaagattcccttatataaattctttcactaatctgatcatggccgatatttattcaacactttgtctttttgcagcctcctcctccttcttcacctcctgtgcagcaaatgtcaagtgatcgaactccatcggctgcagggagtcacaatgtcgaggaagaggaacaacccgctgttcctaacatcccagtaaatgtcaccttcaaaatgttttcaatcggccgtaccgtgcaatctgatctataattatcttcaattttctcttctgcgggtcttagccgatctgttctcatttgatatcaaagactatcttgatgaagaaacagaaactgataccaccagcaaagctctagctcccttgtccgatgatgtgaaaaagactcttgaggatatctctcatcggctagaggcatcattagacaacttggtgactaactgtggttcgatcagggcaaggtttgcagatattcaagctctactcccagatgagctagccgatgccctcactccagctgtctaccttgagcaacaccgattcaagctggagaaggccaagcagagattagccgattgtcgggagcgaaaagacatcgaggtcacaatccaggccaatcggcagcttgttcatgaagagaaggccaagcttgatctgttacctgaaggaccaatcaaagccaatattgatcggctcgaagctcgcaagattgagctcttggcacaacttcaagaatgcaacaccgagctggatctggaacacaagaagctagccgatctcccacaagttgtcgaaggacagaaggcaagattaaaatcagctatcaagaatgtcgctgatatgaccaagtccttgaaagtcatccctagaatcgatgctcaagatgcccaggccatcgaagaactagaacaaattaggcagagggctgtatcggttatccagcgctatttatttcaatgacattttgtatagtagacttttggaaatttttgtaatcggctaagatactacgatactttacttaacttgtcttgataatcctttgtgccaattaatacaacttctgaattctgctcgaaaatcttcaaaattttgcaactgttgtatgtatgtgcccccctaattttgaaatgacgaaggcattgataaaattataacctagactaagggcgacataaccatatcggccattgaacatcggcaaaacacaaccgattacaaaaaaacaactaagggcgatataaccatatcggccattgtacatcagcaaaacacaaccgattacaatagaaaaacaactaagggcgatataataatatcggccattgtacatcggcaaaacacaaccgattacaatagaaaaacaactaagggcgatataataatatcggccatctcaaggcgatgagaagacatcggctatcatgcatcggcaacaccagccgatcatgcattaacctaaacacttgggtaatatttcttcaagtacttgccattcaacgctcgtccataaacttctctatcaagtcctagcagcatataagctatcttagacacgaccttatagatttggaacggtccttcccaattcggcgaccagttgccgaatttgctatcccgagctcctatcggcaaaatcaatttccaaacaagttcaccttcagaaaaagacttaggcaccactttcttgttataatgccgagcaacacgttccttatccttgataacttttgcaagggctcgcaatcttgattgaacgaagtcctccctttcatcgtccataaggttataatactcatcggctgtcaaatcattttgcaaatccgttctccttgagccgattctaacttcccaaggcaaaacagcctcgtgcccaaaaacaagcttataaggaggaacttggattgaaccatgacaagccatccgataggaccacaatgcttcggccaatctagtatgccactgccgaggataatcggaaatctttctcttaatcaatttgatcaaactcttgttagatgcctcagtttacccattagcttgtgcataatatggtgaacaattcaacaatttgatacccatgctatcggcaaactgaacaaactcatcggacacgaagatcgatccttgatcagttgtaatggtttgaggaataacaaatcgatagattatatgctcttgaacaaattgtatagcatccccagaatcgactttcttcaaaggaatcgcttccacccacttggtaaaataatcggtcgccaccaatataaacttatgtcctttactcgatggtggattaatcatgccgatcatatcaattccccaacctctaaatggcaatggcttaatgataggattcatagccgacgccggtgccctctgaatcgctccaaatttctgacaatcttgacatcccttgtaatatttgaaacaatcctccagcatcgtcggccaaaaataccctgcacgccgaagcaaccacttcatcttatgagccgattgatgagtgccacaaattccttcttgaacttcaccgattacaaccttagcttgatcggtactcaaacacttaagtaacaccccatcaatcgtgcgataatagagttcatcatccaataaagtatacctcaacgctttatatcttaatttccgagaagccgattgagatggattctgtaaatattgatgcacatcatatctccaatcatcggctgttattgcagcgacttcaaccttaacatctttcatcatcggcttataccccgatgccccttgggccaaatcattagcttcaatattttgttctcgggatatatgcttcaaagtaaccagccaaaattccttcattaattcttggcacttctcgttataaattaccaatgtatcattcttgcactcatattctcctgctaattgactgattactagcaaggaatcccccataatttcaatagcatcggcttcaacttccttgagtaactgcaaccctttaagaactgcctcatactcagcctgattattggtcgcataaggtttgatagtataagcgaactcaaaacttgccccccgaggggaaataataaccaaaccgatgccacaaccatgagtgcatactgacccatcaaaaaataaagtccacggcacaatctcaaccgagccgattgaatcatcacgatgatcgacaatgaaatcggctagagcttgccccttgacagccttcagcgactcatacggaagatcaaactttgttaaggaaaatatccactttccgacccttccttttaaaattggagccgacaacatgtatttaacaacatcggccttgcatatgacagtgcattcattggacaatagataatgcctcaaccttgtacatgaaaaatataggcacaaacacaatttctctataggggaatatctagtttatgtatccaagagtcgacgacttaaataaaacacaactctttccttcccttcaagctcctgaattaagaccgagccgattgacttttcaccgcccgacaaatacaacctaaaaggtatccccttctgtggaggaatcaaaacaggaggagagctaagatattccttaatactatccaatgctttttgttgttctgccccccaagtaaactgttgatcggctttcaatcttaataatggtgtaaaagactctaaccttccggacaaattagaaataaaccttctaacaaaatttatcttgccgatcatctcctgcaactctatcttgttccctggaggccgaatcttctggattgcattaacactccgctgggttatctcgatccccctctcatgaacaagaaatcccaaaaattggccagccgatacaccaaaagcacactttgtcgggttcatcttcaagccatacttcctggttctctcaaaaaccttcctcagatcggctatgtgatcgtctatctctttggacttgacaaccacatcatcgatgtaaacttccactaaccagccgatcaggtcatgatagatataattcatggctctttgatatgtagctccagcacttttcaagccaaaagtcatcacaacccagtcaaacaagccgattgcaccaggacacctaaaagatgttttatggatatcttcttcagccataaagatttggttgtatcctgtattaccgtccataaaacttaaaatcttatgtcctgaggcagcatcaactaactgatcggctactggcatcagaaactcttcttttggggtggctttattcaaatccctgaaatcaatgcataccctgatcttaccgttcttgttgataaccggaactatactagaaacccactcagcatatcggcacggacgaataaaaccagcatcatatagatgtttgatctcagccttcacaggttctagcatatcggctttgcaccttctcggaggttgctggtgcggtcgaacccctagtttgataggcagccgatgctcaacattcgattggctgagccctggcatctcataatactcccaagcgaagcaatctctgtattcttttaagagctctatcaacttggttctaaattctggagataagttcttactgatatatgtcggccttggccgatcgcctggtcctatgtcaatttcttccaaatcatcgggcaacatgaaaccctgtccttgcttgtcatcgagatcatccattgtgtccttggcgtagactcctgagccctccacaacgccctcaaaataacaatttgggctctccatcttcaattggctgtatatcacaatcggacacttttagaaaatctccatcccagacttttccaggtaagcaatcaagaccatccatctcccaaagagctaaatcggcactggcaacgttgactgacctatcggctggcacgatctcaatcttgtcgccttgccattgaatcaagcattgatgcatggtcgaaggaatacaacaattggcatgaatccaatcccttccaagcaacaagctgtaggaacccttcccatcgatgacaaagaatgttgtagggatagttttgctgccgactgtcagttccacattcaaaactcctttagtttctgatggattgccaccaaaatctttgagcaccatgtttgtcttgatgagatcttcagcattcctgcccagtttcctaaacgtagcgtaaggcatcaaattcactgcagccccatcatcgaccatcatcttagacatcggcttcccattgacatagccatttacatacaatggcttaaggtgccgattctctgtcccttccggcttctcaaagaccgcttgttctggtgataaaatcaacctagccgactcctcttcaacttcatcaacgtcggctcgtttaaccccaaattcggcaggcaacatgaagaccatgttaactgatgcagtcacaacacttttccttttagccaatctctttgcttcatcggctgcggctacatcggctgtaggaacttgattcttaacccgccattcttgcttcggcttcgtcttcttctgccgatgattgatttcttgctcaacttcctgaaaacgctccatgttcctcaatctctgaaccctccttttctgattctttgtaaaaataccagaaggacaccattgaatcttcctgtcttcattgtcctcttggttataatctcgatttactgggcccaatctttgatgaacaggcactcttgtttgccttggccgatcacctttattatgcgatcggcttggactttatgcaatattgccgcacccaaggcagtccttgatagatggtagcctcataccctcattccagcagaatctaaagaactcgcagccgcaatgaggatcaaaccaccatcatcttcctcataacgcctctcctgttgcttgtcatatttcttctggtacttattgataatcttagccgaattcacctaaaaacttctagatcttcctctttcggctgtccggccggatgtatgcaccatattgacaggaaaagggttgccatcaaccttcatcagcctcttggaatcatcaaatttgattttgcctccctcaatggctacttggatctgctgcctgaagaccttgcaatcattggtagaatgagacccagagttatgccacttgcaataccttcttttgcccaattcctcagccgacggaattgtatgaccagcagaaagttgaatctgtttctcccgaagtagcaaatcaaagatcttgttagccttggtaatatcaaagtcatacctctcctcttttccagaactcttcacccattggcacggtacaacctttttgcttctcacccattcggctgctgctatttcggaatcatcctcatcttcaccatccgatccatatatgtagggacagacatgattaacctttctagagttcttcctggcctctgcaaacctctgttcatgcaaggttaccttctgtgtaagatgtgataagctatcgaagtcttcagatgagaacttctccctgatcggagcaatcataccctgaaaagccaaatcggctaactgggcatcggtcaaactcaagctgtagcacttattcctcatctctcggaacctctgaatatactcatgcacgggctcatcgtgtctttccttgattgctgttagatcggacagtttcatctcatgcacgccactatagaaataactgtggaaatgcttctccaaatcggccccactgttaattgacccatatggcaaagaagaaaaccaagtaaaagaagatccagataaagacaatcggaacaacctaaccctcaaggcatccacagccggtgcttcaccgcactgggccaaaaaccggctgatgtgttcataagtcgatgtactatcttgccctgagaattttgaaaaatctggaactttgaaccggttagggagaggaactctctcaaaccatttagggtaaggttgccgatacaaatttccagcatccttcggcctgagcccaaactgctccttcatcacatctgcaatcatatcggcctatggtcgttgttgaggtgctccttgaggttgctgtggcatgggctcgaattgattgtattgaggagtgaactgaggttgagccgatcctccctgctgatattgaacttgtggcgaaggaggctgataccgataattcaaactacccccctggtaattctggaagttcggctgaatattgtgcaccaaatgttcaggaacgacttgaggtatcactgtttgatctggctgcacatggtgaactaaatgctctgggacaactcgattcacagcgtgctgccctagctgactgttaggtgttgcgaatccagccgatgcattcatcaaaccctactggtgaatcggctgaatagcctgttgcctcaatggcgtttgctgaatcggctgcaacacctgttgtctcagtggtgtttgctgaatcgtctgcacaacctgctgcctcggtggtgtttgctgaatcggctattgctggactgggtcaacagtaggttgaggtggtaaaaacatagctgcaacctgatcttgtgttagccgattcacgttctgtccactatgttgtggctgttctctcaccaacaaccgaggattaactaattgacctggtgctgacgatgatgcagcgggtgcaggggccgatacttgtgccgtcggctgagccgatggtgcgttaggagggactgtttgaacggcttgctgattgtcagtaattaagggtcgataattcgggaatgtacccccttgaagatacaccggccccgtagtctgatattcagctattgaaccatcaaccatcgacttcaacatgtttgacaaagtattgactaatatcccagattgattgatcaaagcatgatgcacggcatattttacctgattctggaagttgttaaactgtagttgtgccgcagtgccaccttgattaataccatcaccttgaacttcttgagagccgacgccctatactccttgagagccatcaccttgattttcttggaggtcgtctgcagcacccttatcactcggttgagccacaccatctggagtttgtttcacttctccatccttgggagaacttgtcccaaggacatcagcaaccacctttaccttgtacttctacacaagtgtccccttgcgggtctctgtgaatgaactcaagaactaattccgtgcttgctacatcattgcgtcaaggtccttttgctgctcaggtgtcagtttatcctgagtgacgggcacaatgtgttgacgtttgatgtcgcgattccgatatttgcatggtatggggatcattgatgctaggatatatgcgagactgaggtaaaagagatggagacgaagatttttatacaggttcgggcccctgaattgtcaggtaataaccctacatcctgttggtcggagccggcgttgcttttattcaccataatcacaccagtacaatatttggggtagcctatctaactgttgtcgacgtggcggtctgaggttctgactcgtagtcgacaacagggtagccttcctcctcgagttcgtgcccggcgagatcagagatagcgctttcgtctctcctgacggtatccagagacaccgtaggggactagccgtgcttatccctgaagtcgatattcggcgtcttgtcttggcatatgttagcttgtatgttgtggcttctgttgttccgtagattatggtggttgttgattgaggtggtcgtgtcccctctcctcctagggggccttgtatttatacacataggtgtccccttgtccaagtagaactagggaaacccatatggatataatccgagtagtccttgtcgtttccatatagaactctggttatctttccttatccggaactccctccatatccgaagtcagtttccgtataagacatggtatgtggtgggtcctgccgagatgttgtcgactactattaggtatgtggtatccataaccctgacagtagcccccgacttcaatgaaaatgaacaggttcatattctcaactgcagaccttggaagaactgttatcgagctcaagtgaccgttctctgtgagttcagagataatgttagactttctttatcagcctcgtgcgggaacctaaagggtttgtctgagtccatctccgacgtcaaccaagaaagtacagaacatacgactaagtctcctgtcttgctgtaatcgagaatttggattgaagtcaagaaattttatctcggcgggtacaccatctcttcattctgtattccttgtcgagatccaccaaccgttctcgagtgatcgagaaggcgcagagactgcgacggagccttgtcaacatttgtcgtactcgccttagtcgatcttggtgtagaaccatagagacatggagtcttccacaatgtcgaatagaattttcctgaaatcaatactcagaaaagaatattagatagaaatagcccccgagcgaatgctcaaagggtgacatgctataatatgtatggaaaactgaaaatgagttaaatttacagaccaatgttttgtatatgagcgtcttctctcttaccgacttcgatcagtcagtttgttgagttatacactctccctagcccccagccttgtcgtcagagaatcattctcggaggagaaggctcttggacccttgacctgccttggttgaacaagcactgatcctagcccccagccgtgaagttggaaaacccaatttccgattacacggcttggttaatacggacggcgagaactcttacacgaccagatcttacatggtcttttgtctctacaggatccgacaaggccttatcggctctgggcatcctcagctgaagttcccttaggttcctcgcaggccttgacaagacggcgtaaagggacatgaggataggtttcaacgctaggagtcgtcgtggtaagggatctctgggtaaaacacttggcaatattgtctacctgataccaactttgttggagtagaggtagtgggaggatcgctacacctctggtagtagtcgtaactcgaccacttaaagtaaatgtacgagagatcgctacgcttaactggttgagaaccagtgagtaggtgtctctcgatcatttggagtcgtggtacgaggaccactacgctgccgatcgaaaaccagtcatagctgttcctcaaccatctgaagtcatggtgcgaggaccgctgcgttattgatgtagtcgtacctcgaccatttgaaattgcagtgcgagagatcgctacgtactggttcgagaaccagcaagcgagtagaattatctctcgaacaccaatgtaagttgcggtgcgagagattgctacgtgctggttggagaaccagcgggcgagtagaactatctctcgaacaccaatgtaagttgcggtgcgagagattgctacgtgctggttggagaaaccagcgagcgagtagaattatctctcgaacaccaattgaagtttgcggtgcgagagattgctacgtgctggttcgagaaccagcgagcgagtagaattatctctcgaacaccaatggaagtttgcgatgcgagagattgctacgtgctggttcgagaaccaacgagcgagtagaattatctctcgaacaccaatggaagtttgcgatgcgagagattgctacgtactggttcgagaaccagcgagcgagtagaattatctctcgaacaccattggaggcgctaaagttggtttattacacgtgcatctcatgtggccagcatgactcacatacccaacttatagcatatccggatgtccgttcgcaatcatgtcgggtgatcaagccgacgacgttcgcgaggaattatccgttaacaaccttttcttgagtagtccagccatggccggtgctatgagataggtcgtcggtcttcgttggtaggttgggcgcgacaactccgcatttgtcgagaatgttctcgatggtggggtgtactcgaccacaacctactcgagtgctcgattgttcctgaaaaatattttctagaaggcaagacatatagcagagaatatcgagtatgtactcaaaaaactgcataaatcttctagtattatcaggatataacgagcagatgtaaatatcagggattatgtaaaccgtaaacaagcatgattcatacaaaagagaacagagcgagcccccagcgttagaccgtggttggcctaacatcggaagcactcgcacaataaatattgtataaaaaacatgctctaggtaaacataataaattatagatctgacaatgctgtatgacctgaataggtacgataaattgcatataaaatattgcgtacctttgtagatacatgccggatatatctacgaaattagtagatcaattaagttaattaactgtcacgcccggaaattcactagtaatttccgaacttatttgtgcattaaaccctcgtccaggaatcagccgaggtacacaaactgacaatttaatatacagattcatcacattaactaaaacgataaatacttacttaagaggcacttagtcctcaccatgaagaaaactgcagcggaaaaataaaatctagcgaagctccggctccactcccacaggcagctcaactggggtataagccaaacgtcttctccttctggatcctttatcttcaactgaggtttgattgattattgcaagaatgagcatatgacatactcaacaagccacacagcaaatatgcaagtgcacaaggattccaaaggatggcataatataggctcatttgcaaaagcagcatttagcaaaacatttaagagaagtaaaacagtggagtaattaatcagaacttttaaccaacactgaacagcacacccatgctgctcaggcccaaccatcctgaacaaccatacccggctgtacagatctaactccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacacacaagacacgattccacacatgttgccatgccccgaaataccaccacggcattgcaaagggggaaatcgtgacaataccctttgcacaacacaactcaccacagtgcaccgttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgccatgagcacaaccatcaaaaccatatgctcacaacccaccttaaccaggttttaattatcaattaattaacatcacacgattaatcatcgtgagctaccattaaatataaccataattaataatatagtacatatgattcatcccattagtgagctaatgtttctaagcattgctaagcaattatatatataacatttagctgaaccaaaccaatacataaggttcaaactaatcaatttattacccaaggtatcaaggaataggacattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtacataaaaaaaacaaacacgtagatcataattttagatgaattatgagacttgaacggcttcattctgacttcaaatgaatttattatgaattttacaagatcaaatctaattaaagcccatttaaaaaaaattaaataaatttaattcaatttatggacaattttaatatgtagatctttattttagaaaaatttagcaacttgaaccacctgaaacggatctacggttatttagttatgattttccgaagatttaatctattaaaagaaaggaaaaaggaaggatgatgatgtcacgctgacatcatccatggcagccacagcacgggtggcgacctcgccggagctagggtggtcggccgggattttggagaacacctacgcgaagagaacgacgagacgaacccgatgatactcaccaacgcgacgaacgacgacggatgacggccggcgacgaagaagcgacggcggcggctcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaggcggcgcaaggtggcggctcgggctcggcctggctgcagccggctgaaggttagggacgacactgtagcagggaggcaaagtagacttttgtcgggcttcattttcctcggcccgattgaaggagggaggcaaaacagactttgacagagagagaggagggggcgggcggcggcagctgggccgattgggccgattcggccgcgcggagagagaaagagttgggccgaaatcggcccaacgacttagggaaggatttaaaaactttttccaattaaaataatcacttaaatgatctttcaattgttaaaaatacttccaatgctcaaataatttcaagaaaaatcctgaaaatacttggacaatcaaagtacttaacaaaattataattagaccatttaatgattaatttaatatgtgggtaattactgaaatgctctttgtatgattaaaattaagaattgagctccgaaaaatccgagaaaattccagagagtataattaaccatggagaatttaataaaaattaaatccacccatgctttatatttaagaaattttatttcccacatttaacttcacttgtaaattaattaatgaacatttaatataaattcttttaataatttattaaataatttataaatcctgaaacaaaaatcaggatgtgacattaacctaccaattacttgattagcctaggtagctgatttgaattcgtcctctggacacacagtaactagcacgtatgggtggcctacatgggccccacaacatgcatgctagtatacgtgtagatggcagtgcagtccgctgggttcttgctctcttcggctgtcctgctgctgcacgcctgcgcttgatgtcggggcaccgtcgtctgtcgacccgacttgtccacggtaagacaggcagggtgacgagttgtagttctcttgtgagttatctgctctccgttcccgagaagaggtcatgtctatacaaatagacgatttgaaagttggcctcgaaataatcggattcgatgcagttgtaacacgacagagaatttgatgacgacgtcgtggcaggaaacattgaattgatgttctccgtggcggcagcgacatctttggagattggatgatctcagtagatcaaaaaccgttgacgatgatggtttcgatctcgtcgggagacatactttggtcaggttagatctctccatagccgaagtcatcgagtagcttgttatcggagaatccatctcttgaacccatctcgtcgaaatcctaaagcaccaaaatccccctacctggcgcgccactgtcgacgtttgatgtcgcgattccggtatttgcatggtatggggatcgttgatgctaggatatatgcgagactgaagtaaaagagatggagacgaagatttttatatagcttcgagcccctgaattgtcaggtaataaccttacatcctgttggccggagccagtgttgcttttattcaccataatcacaacagtacaatatttggggtagcctatctaactgttgtcgacgtggcggtctgaggttctgactcgtagtcgacaacagggtagcatttttcctcgagttcgtgtccggcgagattagagatagagcttttgtctctcctgacggtatccggagacaccgtaggggactagccgtgcttatccctgaagtcgatatccggtgtcttgtcttggcgtatgttggcttgtttgttgtggcttctgttattccgtagattgtggtggttgttgattgaggtggtcgtgtcccctctcctcctagggggtcttatatttatacccataggtgtccccttgtccaagtagaactagggaaacccatatggatacaatccgagtagtccttgtcgtttccatttagaactctggttgtggataatactccgataccactctatattaagatattaacgcaagtagaatataccaaacagaagcctaatatacttaaatgcaataagatcttgacataaagggcagatttaacatgtcagtaaagcacataaagcaaatatagttaaaccaggtaagatcggctgaaaccccgatactaccctaatcggcaaccagaagacaggctagagattgaaattctaagcacgacttaatagatcaaactcaactgatgcagcattaagtatgaaaagaagagcaatatctagacaatcaagtcgttggatgtttcatagagtggtggatatcttatataatccaagctaacgtcgctatttaacctaatcggacgccttctattaacagatgttagccgattgtaggttagatgacgatattatcgaagattatataagatatatgataactcgatgaattacataaacaagattagagtgtcataaagatggaagcactaatcccgagaacgcaagccgccataacaagttttacctcttgttgaagatcgaaaccgatgcagctcaacccgaaagcaagaactcgccgaaataaaacgaaagcaaaaagggtggcgatgcgccgaaattgtattgaacgtgtgttagtttgattacatggggttcggggcaatttatacccgagaattacaaaacattcccataccggacacgactcttatctctaacaaactctaagatacgacaagtctttacagcagacttttgcccaagcatatctctaatgaaattacataaaatgtcctaattagtagatacaattgccttcccaggactccatccatgcgtggcaatcatcttgaagcacttcaacccaacccgatgttgtgcaccaagtcgtattgtcagaatcggctgcatcatctaaccaagtctgactccaactcagccgatccaatcgtagccgatccggactccagccgattcttactctgtttccgcgacaatcttcatcttcgattccgcttcaatctagtcttcatctccgatactgatattacaaatttggtcgttaacaacgaggatgttgaagacaacgacggtgcggatgatcttggtcagatgttgcatgacgtaaaggaggactgcaaaagtgaaaaggagatgcagaaactagagcgcatgtcagcggaccaaacatcgttgtacccaggttgcgaataggggcacaaaaagttgggtaccacacaaggcataaaattagagcgtatgttagcggaccacaaaacgtcgttgtactacgttggaattcttgcaatggaatgccaaaattggtctgagtgactaggcatttggcgagttattgaagctcgtaaagaacattcttcctgagggaaacgaattgtccgaaacaacgtacgaagctaagaaggtagtcttccctcttggactggaagtacagaagatacacgtatgtccgaacgattgtatcctctatcgcggtgaggagtacgagaacctagaagcatgtccggtttgtaaagcactacgatacaagattagacgagatgatccaggtgatgttaacagacatccttcgaagaagtgagttcttgctatggtgatgtggtatttccctataataccatggctcgggcgttggttcaggaacaaatcgcatgctagaatgatgcgctggcatgcaaaataatgttaacaagacagggtgctgagacaccccaccgacggaacatttgaagacttcggagaggatgcatgaaacgtaaggttcggtttaagtatggatgacatgaatctatttggaagagatgagcaacagccatagcacctggcctgatgagtacctaaga

SEQ ID NO: 59006 - DNA, 5954 bp, Oryza sativa
ggcgttgaggggagccagccaggcatcgagggtgaggagctggcgccacttgccaaggaaaacgtggccactccctgaaattctccatgacggtgcctagcttgctggcttgtttaggtgacaggcagcctgataggatcccatggacttctgagctcgccaccggcaaagccactatttgtatccctgcaggcttctgccatttctctcgtctacttcacgtgtaatataatcgcagatgttacttagagatgatgggccagatggcatgcatttgcctgtttctctctcgctccttctgcatgtgtaatagtatatttggctgtgaagttctggaccctgtcagtcgctgtcctcgtactgcatttcttgtaaggaactactccctccgtcccagaataaaccgtcccagaataaagtaacttagcatgggatgagatccatcatagaatataggatagtatatcttgacatagtatgtttttttttaatctatgccagctttgctggttttatattaagaaggggagaaactgtacaaaagcaccgagaaagcagcaggaagaagagaacaacattaggaaggctgcaggagaaaagaagggaatggaaaatgaaaacagagtacagggagcaggcagagaaggactatgggctgctcatggcgctattctcgctaggttttttttgccccacatgctatccatacattgatttcatcaagaattttggtcaactgtggaattgcaagctccttgttctgttcctctcacaccagattttccaactgagaagcatgtggatggagcgcattccttttgtcttgtccttgtcattttgctctgttcttctctcccaccagtcaagaagtgtttcatctgggttgtgttccatggagatgtgatcacagtccagccttgtggataccttatcccaaatgtcccatgtgacattgcaatccttgaaaagatgttgtgtcgtttctaagtttctgtagcacaattgacaaaagtaattgtttggccattgttggagctgtaggcagttggctgtccagattctattttgtagtagcaaccacgtgaagttcttgcatttggatggcgcccatgttttccaaatcaagcaggcagccctcaattcaattctaccgctgaattgcgccaaataagaagatttcgctgaatatttgccgctgctcgttcatctctaaataattgtcttcagtttcctttgatagaaccgttgcattttcccataacagacggaaaacaatgaggaagtcatgtagcagtgccatgctgaggtcatgtctgatgtcctgaatccattgctccccaagcagtgcatcatggactgatctgtacttccccttggagtgattgtagagtgctggtgtgaggtagttgagcggttgatgcccaatccaattagaatcccaaaagtctgctttctgaccatttcaattagaatcacatggcggtggagtcccaacccaaggttttgtttgggcattcccaccgaaaccagagccatcgaagcatcgaagccttagtgctcttgcaaatttgtcaaggtctagaatcccagaccagcaaatcaaacaagaccagcaggggcctgatccaaagggaatcaaacagtaggaaaccaccgtgttgctgctagtcatgtgatgttaagctgaaacaaagaagcaatgcattggcgttttgaggttcaagaataaagtattcatgattttgggttgcacattctgaaattgaattgattcgggagattggagcttgcctaggggttcatttcacccgattagcaccattctgaggactaatgtagcatcgctttcacaaatttgtggagtttgtgcggtggatgaacgagcgtacattggcgcattagaacactttcgcttttttatttaggcgcagggtatagcacagctccacaaaaattttattttatcaattgcttcctccgttcaaaaatatgagtatcagatttaattggaatctaaaccgagaccgatggagtagggttttcgcaagtctgccagtatctaattgtggccatgatgtggatttaactgaagtatgcacgaaataagtctattttgcctcccttagctggtactccggatttcctcaactgcaaaaccaactataacacctcccctaacttcgaaaaccggtataaattgactcttttggtggtttggaaaaaggtttatgctaatatgacaaaatgaccgtggttgactcattgaatcagcaggagagatccacatgtcaatgaaacatgtaatccttctcccctgtcctcccccctatcctcttttccctatttgacgactacaacaacagtcggcgggccgaggtttggtgaaagattcagggcctgatgctggtggcgaaggggagggctcgctaaccaaatgttatcctcacttgcgacttctcgcaaccatccgttaccacctcctctaatgctggcacgcccgcaggggcgcctgcgttgtccgcctgctccaagatgagcatcaagagccaactcccaccgtgtcatgcccagaaattcatgaaccaaaatttcaagcagaatatgcattaaaaccctgtccaggaccgaccagggtacacaaacgacaaagttgatatatagatctgcgtcttatagaacacaataaaaagtcttacaaatgcagcagaaaggtaaaaactagctaaacttgggacaactgatgctagtagcgcacaactccactccacagatggtagcgacgaaacttactcctccgagcagtagtccagctctgaggtggggaagatagagcaagactgagtactacccattaattgtactcaacaagtcataccaagaggatgtatgatgtaaggatttcgaaggaggctaggagttcttttgcataaagcagttgaaagcggtaaaaactattgtagtaaattaagcaatattaatcatcattgtccaatgctaaaccacgttgcgataggcccacacctaaactacaccagttccattaagttaaattattaatgatgagactaatcacggtgaagctagttgatcacccataaccgtaggcacgactattcaaatggttttaccatcactagaggtgtacaactatacccacaagacacaaccccatgacatgtttctgtgcgccgacatgccatcacgacataccataaagaaactgtgataggatccttgtcataactccccataactaagcgcaccacgctgaggattcaccttcaccttaaacaagggtgggcaggcccccgtgcatggcagtaaattcgacaactgattaacccttaagctgggtccaactgttgatatttcttacaacctgttgatgtaaaaacacgggaacctgggagatctgcttaactccagtgcaggtccaagactagtctcgagtgtatcaagggcgtgctagctgatttgatcctgcaatcagtaagaaagacaaaagcaaagttagtcaaccgatagccgattggccgatagcgtatcgttggtggtctcagccgatgtagttagacaagatcggctatggactggatagattagtggataatagatcctaaacatgcctcatcggctataatactgcctatcaagttcgataaagaagcttaagacaatattatgaaaatagccgatggaacaatatttagagcataataggataatgtaccacctaatgccctagtacggacttatataggcaaatcaatctatataaatatatcaaactatgatcggttagtagtttagataacctagccgataccgatttagcttgatatagctatatggagtgatctgtctatataagtggcaaatataaataaaacttagtaaagaaatatgtatattaggtaagatcggctgaaattccgatactatctttcattataattgtttccatgttagtttttagggttcaataaaagactagggatgatgcaccacaaagtagataaagaaacctagagtctaaacaatcaagtaaagaaccacttttcaggatggtagatgccttaactagtctaatctagtaggaagatttagccgataccggcaagaaccctaaagcgagaaccagctgataaaggtaaatctagatactaagtgtgggagttatcgtaccggggtagcccacaacggtactcggaggctagatcttttgcgagatacgggcctaggcccatgtaatctgttactataaatgatggggaataggagaatggaaacctatcccgccatattttgatggatggcaggtacccagattgtgagggataccacatctaccttgccgccgatcaccctgctgctatataaaggggatcggcagcaccctttggaggtgggacactctcttcactcaacacccaatacagagagaatccaccaaacaactggactagggtattacctcatcctgagcgcctgaaccagtataaatcgctaggtcaccatttctttcttgcatctagcgcaccctataaattttattgctgatttttgaaatcgacactaagagtagattagctaagacatatgatagcaaatgacaatgataaaaggactaaaacatctaaagcgacataatagccctgatagcacaagccaccgatacgtgttacctcttgcaaagcgaactcgtcgaaaagtaaaaatgaaaagggtggcgatgcgccgaagttgtatttgtctcccctattacaatgctaaggggttcatatttataccccgagtacaaacttggtccattatggacacgacttaaacctttctaaatataaaatacaaacaaaaccatataccacgttctcttaccaaaatctctaacaaaccgacataactaacctaattaatagatacaattgccttattttagctctatctctaattgtcaatgactgttatctcaatctagacccatgtcgagcccaaatcataccatatgggctggatcagccatcggcttcatcaactcatatcttatttccagccgatacgatgtccagccgatacgtagtccgactccaaattaaacttgatttcacaccaaacccgcttctatcttcttcttccttctccgaatctgatgcaaaattctgctgttaacacatgcccccctaattccgctgtattatataatgcagcagaatttgctctcggcaatcttgtgaaaatttagggtttctgctttgactgttaagcttttaagcaaaggctcactgcttccaaaatcctctttttccagccaagcccttcacaaatccccttgctataaaaaccccttcgtctctggtgatctctccggtgattcaatcttccgatggcgatctccccttgttctcaaccggttctgcttagatttgcggtgtacccagagcgatgccaaccacttccaatgttcacgaagtaagtctgtttttaccatcaattttcccttgtaaaaaccctttcccagttcttaaggtttcccgctttttttctgactttttcaacaccttaaaggccaagtcttgattctcgtccttcatgctaacacccaacattttcttggccccatgagcgatccggatcccacgatgttcattaatgctgagacgaataggatcccttttagagaatcaaaccagaactcagtcattggccaaatgtcttcagatcttggcccccaaaacttcatgagtggaaagattagtttaaaagggtattgactaccaagcaatcgtcatggaggaagacaaaaatagaacagtgccttcaactgtctttagccgatatgccaaagaacaaatctatgttatcggccgcaacatgtttctggtttaacaccattaatgccttcatctttggacatgggttgatgacaccaacccttttggacatcaagatgctca

SEQ ID NO: 59007 - DNA, 1643 bp, Oryza sativa
taaggagaagaactcaacaatttaataccataagattcggtaaaactcttcacttccttagacataaaagaagcaccttggtccgtagttaatgtttgtggaataccgaatctatggataatatgcttcaaaataaaatcaattacctccgtatgagtcatattcttcaaaagcacggcttcggcccacttggtgaagtaatccgtagtaactagcacgaacctatgcccctttgatgacaaaggataaatttgaccaatgaaatccaaagcccatcctcggaatggccatggtttgattatggggttcaacacggcggcgggcgccaattgaacattgccgaaccgttgacaagcctcgcatcctctataatatttgaagcaatcatcaatcatcttcggccaatagaaccccgctctcctaagcaaccaatttatcttgtgggccgattgatgagttccacaaattccttcatgtacctctcccatagccactttagattgatcttcatctaagcaccatctatatttcggcggtataaatctccatcaagcaatgtgtatttgaacgcttgccgccgaattttccgatcaaccttaagtgtgggatccttcaaatattgaatcaaaggaattctccaatcctcttttgcatcctgggcacaaatgtccgaattcacaattaattcggcctccaaattgattgaaacatgccccccagcgctctgtccaaaccggtcagaccggccacacagagccggtcagaccgctcgggatcgccggtcagaccgacggcgtgcggccggtcagaccgcccctggtcaccggtcagaccgcccctggtcaccgatcagaccggccgtgcaatgccggtcagaccacccctggtctccagttttgctaatttcgcacaaagatttaaaatcaagcaccggctcttctaatattaaaaataatcccttcttcacattatagccagatgcttgttgtgccaagtcatttgctctagaattattatgcctagcaatatgtctaatagcaaaattatcaaaattggcaataatatctaaacatgaatcaaggtacctatttagtgatccgtccaagcatttgtagactccggcgacttgttgcaccaccaattccgaatcaccaaaagcctccacatgtttagctccaaccatctccataacttgtaagccgaacaataaagcattgtattcggcttgattatttgtacaataatattccaaacgaaccgatgcttcataacacatgccattaggtgaaaacaaaactacccctatgccttgaccttctttgcaagaagaaccatcaaaataaatcttccaaggtataacttcaactaagcaaacctctccctcatgagcaatatctatatgatggtctactataaaatcacatacaatttggcctttcatagatttcaatggttcataagccaaatcatattctatcaaagcatatgcccacttgccaattctcccacttagaattgacctttgcaacatgtgtttaataacatcggcttgacaagtaactatgcatatactagataacaaataatgcctcaatttggtacaagcatagtataagcatagacaaagtctctctataaaaaca

SEQ ID NO: 59008 - DNA, 1488 bp, Oryza sativa
attcctgcagccctgggacaaaaaatgacttataataaaaaaaattcaactataaagttgtagatcgcgtcgagggctagaagtttgatataaagtttgtttcattagagttcacatgaaaaagttatgaattatttttaaatataaagtctttagaccgtcctatttgacccagataatattcaaatccaagtttagggaccagggtgacacaactgaacaagttggaggacctaaacaagtgatctgcaagtttagggaccggaatgacacagtcaaacaagtttgaggacctaaacggtcgatttgcgagtttagggaccgggatgacacaacggtagaagtttagggaccggtgatggactttactcttgaatttaatctttaagaattatactgcacatccaattacctttaagaatttttgttttcttcaccttcccgaatctcaaccaaaatataataattactacatccattttaattaactttcagttgttagttattaggataaaaatataaatatgcttatatacaaatccacactagtatattgctaaaataagtacatgaaaattgaatatgtataaaaaagtgatccaaataattaagttgtcgtataacttcttaacttattgtaccaaatcgtacgtatcttgcaaattgttgtatttatgcgatcacttataaagctcttgtactaaattgcacccatctgccaagttattgtactggaacgctcatttctcaagttcttgcaccaaattgcacccatctgctaagttgatgcaccgtgggtgcaatttactcaataaattagcttttcatctgcccaaaatgtgaatgcaggatgaatgccattatcccattgcccattattgccctactcaacgattttaatagcgcaatcagtgatcatgcatgaaatatatagttacagttagtcatcactacttttttccaggcagcccaatcatattctcgcaggcgggcaagccttccgcctgcacctcaacacctgtgaaaatagttgattttcgcaggcgcaaaacacgtccgcctgtgaaaatagcttcgggcgctaaaaaaaaaaggcagccaccgccgtttccggcggtagcttcccgttcccaattcagttcccacccattccctatccaatccagtgaatccaaattcaacagagaaatcgccagtttatccagttcatccaaaatcaccaaatcaatactagcaaagaaaaaaaataaaaacattcctaaaataaatcacggccccgccctgccatcatctgccgccgcacgtccgcgccgcgccatagtccgccgccgctgccgccctcccccggtctccctccagccggatctgggagaggaggggaggggaaccgcgccggtcgccgtcgtcgtcaccgccgccgccctcccgggcctccctccggctgaatctgggaggggagtggaggggaaccgcgccggtcgccgtcgt

SEQ ID NO: 59009 - DNA, 22122 bp, Oryza sativa
ggtttgtaacccccctttagtcattgtttcctagccgggagtatcaatccgggactaaagatcgctatctttagtcccgggtgaaataactgggactaaagatagatctgaccttttttttttttttgcatggccctgttgctgcatggtttatatatatatatatatatatatatatatatatatatatatatgtttcaatacatatatatgcatacatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcaccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgttttttgtggatattggtcgagcattgcgatgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgttcatctccatgtacagctgatggaacttgtacatttgtgtgggtagggactgcagcagctcaggcttgacaagcggtttaccgagttcgtacttgtatttcacttccgccttttcgattggtgcgactcctagcaattgatccgtagttagaccggtgtcagtaataaattgttctatcatcatttctttaccggtcaccaacggctcgatctcctggtttggttgctctccaagctgagggactgatttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcaccttcttcgttgcccttgtgtgggcaggcggtggagctggggggccccttgactttgaaggtgccggaagaggagcttgcgggggagtaggtgtaggagcacgaggaggagtcggtgcaggatcctgaggaggagtcgatgctggagccggaggtggagacggtgctggcggagcatgaggaggagacggtgcaggatcctgaggaggagatggcggagccggaggagatggtgcaaaagacgccgcttgtcgcccagggaggatgatgtaccgcctgcgccatagaataatggcatggcatgtgtctcgtagatgcgtctcaccgtctcctccagggtaatccaactcgaggtcctcgtacgcgccttcgaccaactcaacttctaccttcgagtatcctgctggaatcggcctgcagtggtaagtacctgaagggtccgttgggatggccatgcccgacgccaccttcatgttgtgagagattatttattagtaatcaatatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccatccttgccacctcctcttgcatgttgagttcgtagctcgatacccggaactctaggtctgcaatcttcgcctcggtatttctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggttggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacatatctcccttgaacctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacctaaccgctgtgacgtacatagttcttggcggcttcggccggggcagtaagacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttcctcgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaactctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatatatatatattgcatttcacgttaacgttcgtcctcgttcgttcgctcgttctcattcacgttcgttcgcttgttctcattcacgttcgttccctcgttctcgcttgtcttcgttcgatcgttctcgttctcgctctcgttcgttcgatcgttctcgttctcgttcacgttctcccggcaacgtacgttgacgtgttcgttctcgctctcgttcgttcgatcgttctcgttctcgttcgttaacggcggtaacgtacgttgacgtgttcgttctcgctctcgttcgttcgatcgttctcgttctcgttcattaacggcggtgtggcggcaatcggggcggcggttggcgcggaggcgtggcgttgcggggccgtggcggcggcggcgtggcgtgacggtggcggcattgcgcgcgcggtggcgaaggcggcggcggcgtggcgacggcggcggcggcgtggcgttggcatgcggcagcggcgttgcgcggcgcgaaggcgtcgtcgtggcgcgtcgtcgtcgtggcgcggcgtctcgtggcgggcgccccgacggagagagatcgagatcagagaagatcgagatgcatgaagggagatctggcggcggcggctctcaccccagagatgcggcggcagcggaggaggcggaggcggcggcgaggacgacgagctcgagacgacggcgagatacagcggcgtcggcgcggggatttgccctaggcagtggcggcgaaggagagaggccgagagagatcgatcggccgaaaacgtctaagtgttggtgaagaagacgagggcgcaccgggaatatatatacccccggatctttactcccggttgttgagaacaaccgggactaaagatatctttagtcccggttattgagaacaaccgggactaaagaaaagatctttactcccggttgttgagaacaaccgggagtaaatatcttttcccgctatttcgaaattctttttaaacccggttagggttaagaaccgggactaaagattatagcactgcatatgattttcccttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaattatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatgtgaaattgccacctgtgtgatttaaaacttttaaaaattgtaagtatcaaatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacggctccaccaatcaacctaacccattggcaccggaacagaggaaccttgagaggaccatagtcaagttcccatatgtccttgatggcaccgtaatacgtggcagttgttccatcgtgtcccatggcatcgacacgaacagcgctgttttggttcgtgctcttcatgtcttgggctctcgtgtagaatgtgtacccattgatctcatatccctagaatgtcgcgatcgacccagacggtcccctcgccaggaaggcaagttgttggttgatcgactcgttacccatgagatgttgtcgtagccacgcggggaaagcatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccaaaacccttggcgatgcttgcctctggacgagcatggttacgaacatacttcttcagaacgcccatgtacctctcgaaaggaaacatgttgtgtaggtacatagtcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttattccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgtgatgtttaggcttcgtacggtggtcggccttatgttcgaagtgcttgcctttcttccgtaccgggtggtttgctgcaaggaatcgatgatgacccatgtatacaaccttcctacagtgcttaagatacgtactttctgtttcatccatacagtgagtgcaagccttgtaccccttgttggactgtccggataggttgctaagtgcaggccaatcgttgatggttatgaacagcagcgctcgtaggttaaactcctcctgtttgtcctcgtcccacacggggacaccttccttcttccacaactgtttaagatcttcgaccagtggtcttaggtacacgttgatgtcgttaccaggttgcttggggccttgaataataatctgcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcgaaagggtgtctcagcatcccgtcctgttgacgctcttcagcgtgccatcgcaacattctagcattccccttgttcctgaacaaacgccttagtcgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaatatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtagcaccaaccggggctaaagatcaccgggataccaaccgggactaaagttggtaataccaaccgggactaaagttacgatctttagtcccggttggtgttaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagattgtttctccaccagtgcacataaaaatttttatttttccagacgactgcctccagacaggcaaaatccccacacgggaaaatgaatttgaccgtccgaaaaaatagttcatgtagaagtgcgtgttcgaggccgacaaccaggtcaggaactggaataatgatcaggagctcaatcaagtcctagtatgtatatgtataagtgaaacactgaggttgttaaagtgccccagaatatctactgtaactatcacatattagagactagcatattgggcatgcgttgcatcgggattttaattaaagaaaactattattacctcattattactattattttatgcatacattatcttaaatcctttggcccgttctacaatcattttcttttttataaaatgtagagagtttgtgatggggtgtctgttggcccacacgtccttcttctttttcaagatgtggagattatggataccccatatctacatggcatgtatagtccgactgggtacagggtactatgtatagatagaatatcttcaagaggactcgggtgggttaagttttttgtatgtgaaggaaatatccgagattctaatcggttacgattgtattttatctgtaattacatatttcgttagggatatggactgtattttataatacggaccccttcccctatataaggaggggtccgggtccctctagggacacgttttttctcccagatcatacgatcaataatacactcggcggatcaatccccggacaggagtcgggtattacttcttgattaagaaggcctgaacctgtataaaatttcttatctctaaacccatccacttttccagcttggtagccacccccttttagtattgccgaaatcttgtttcgacagttggcgcgccaggtaggggtagcatcaagttcttcgccgattaagtgcgatgggttccgtctccggcatcgacgacttcgtctttctcccgggcaggcgttccggttcggcagtctagacttcatcaccaacgacttcggcaagatttctctcctcgactcggattcgaaccagtcgggaagaggccggatctccgctctgttcggtatcccgaactcggccgagatctaccccaaggtcatctccgacgagtcggtttcaaaccactcggacgagatccaatctacttcaacgccaccagatcaagacgataggtcctacccgccaatcctgatgaaactccccgatgatctggctgccgtctttattacaaggatgtcttctccccgtaggcctaggcaggatccggcttcagcaccgatccggcctagctctagggaagtcggcatcatactccagccactcggcacggtttcgacggatcaattggaaggctacttcagctcccccggtgtcgactcacaaccaacagagatcgtagagtatgatgaattcggctattgttacgacgaccacaacctcgacgacttcgccgaaagctttgaagataactacacccctctctacttcggcgtcttcatggccgacaacgagacggaagaacagcgccaagcccgagaagcagaaggacgacgcgtacaacaggaggccgagcaatgccgactggaagaggagcgccaagcacaagagcaagaatggctgcagcgtgagcaacaggaacgtgaacgggctgcaaaggaggctaaggaccgatgacaaagagccttagacgcagggcgacgagcgcgagaacttatcgggcagcaagacgttgaggggacagcggtcttccgcaccccccaacagaacgcggttgcggcgatcactctcctcgacaccctcctcaaggaagacacactcaaccaagccgatcacgtcgtcaacttcttgaaccagaccaagaccatgattgccgcctcggtcccggttaactccgcaagcgtccgcacaccgactggcagccgagtcccccatcttcgatctcaagattatcaccagccaagccttagcatcgccggcgcgggatccaaccgcaggagcaggggtcacgacgagcgatcggtccactcgcctcccgaacgacacagggagcgccgagttgaacggcctcgctccccacctcgtaggcgccccgtcgatcttcgtgatacaatcaaccagcgccgcgcagcacgaggctacgcccaccgccactcaccggatggctatgacgacgacgtggatggagttgctgcctttactaatgacctgcgtcgagtggattggccagccggcttcaagccaactggaatcgagaagtatgacggcaccactaatccggagtcttggctcaccgtctacggtctcgcaattcgcgcagcaggaggagacagcaaagccatggcaaactacttgcctgtggctctagcggattctgcccgatcctggcttcatgggttaccccgtggcatgatcggatcatgggcggaacttcgcgaccacttcatcgccaacttccagggcacctttgaacgccctggcacacagtttgatctctacaacgtcattcagaagtctggagaatcccttcgagattatatccggcgcttttctgaacaacgcaacaagatctctgacattaccgatgacgtcatcattgccgctttcaccaaggggattcgtcacgaggatctagtcggcaacttcgggcgcaagcctcccaggacggtcaagcagatgttcgagaaagccaacgagtatgccaaagccgaagatgccatcatcgcgtccaagcagtcgggtaccacttggaagccaaagaaagatgcgctgattacgggagggggtggaagtaccaatcacaaggaccgtaagcgtaagcccgaggaacttgttgcgactactacaccctcctcccgacaatgttcacgcgtcaatacttttgacaagatcatgaagtcccaatgtccgcatcatcccaactccaatcattcagccaaagattgcttcgtatacaaacagtttgcagaacaatacgccaaaaatgcacggaaggcctccgacagagatcaaagcacgtcaaaaaagaaggatgacgacgatgatgccccgacaggttttcaagaccattgcaaggagctcaaccacatctttggcggacctctggcttatgagtctagaagaaaacaaaagctgaccgaacgggagattaacgctgttcagcccgatacgccccaatatcttcggtggtcggagacagcaatcaagtttgaccgctcggatcatccagaccgagtggtccacccggggcggtaccccctggtactagacccagtggttcgcaacgtcaagcttcgcagatccctcattgatggcggcagtgcactcaacatcctcttcgccaagaccctggacgacatgcagatacctcgcacggaattgaaactgagtaatgcaccctttcacggagtcatcccagggctgtctgctacgccactcggccagatcactcttccggtcacctttggtactcgggaaaacttccgcacagaaaacgtctgctttgaagttgctgatttcgagacagcgtatcatggcatactcgggcgcccggcgttagccaaatttatggctgtcccgcactatacctacatgatgatgaagatgcctggtcctcgaggagtcatatccctgcggagcgacatcaaacaagccatcacatgcgacaaggaaagctgcgagatggcccaaacccgagagatcgcgatcgcccgagaagacatccgactggctgcaaccacggcaagcgaaggagaagtgcctgcaaccaaggtctcaaagagtggagaaagcgaagccaagaccaagaaaattcctttagatccttctgatcctactaagactgctgtaataggcgctgagttagattgtaaataggaaagcgcgcttatcacctttcttcaaaataataaagatatctttgcgtgtaaaccatccgatatgcctggtattcctagagaggtgattgagcactctttacacgttaaggaagacgctaaacccatcaaacaacgactccgccgctttgcacaagacaggaaggacgcgatcaaggaggaattgaccaagctgttagcagcaggcttcatcaaagaagtccttcatcccgactggctggctaacctagtcctagttcggaagaagaccgggcaatggcgcatgtgtgtcgattatatcgacctcaacaagtcttgccccaaagatccttttgtgttgcctcgcattgaccaggtagttgactcaacggccggctacgagctactcagctttttggattgctactcaggttatcaccagatccgactaaaagaatacgactgcttaaagacttcattcatcacgcccttcggggcatactgctacatcaccatgcctttcggattaaagaacgcaggagcaacttatcaacgcatgatccagagatgtttttcaactcagatcggtcgcaacgttgaagcttatgtggatgatgtagttgtcaagaccaagcagaaagatgatttgatcacggacctagaagaaacctttgcgagcatccgcgctttcaggatgaaattaaaccctgaaaagtgcaccttcggagtaccgtcagggaagctacttggatttatggtgtctcatagaggcatacaagccaacccagagaaaatcaatgccatcctcaacatgaaaccgccgagctcccagaaagatgtccaaaagctgactggttgtatggcggcgctcagtcggttcgtttcacgactcggcgagcgggggatgcccttcttcaagctattaaagaaaacagacaatttccagtggggacccgaagcgcagaaagcctttgaagacttcaagaaactactcaccactccaccagttttggcctcaccacatccgcaagagccgctattgttgtacgtatcggcaacttctcaggttgtgagcacggtcctggttgttgagagtgaagaagaagaccatgttcagaaagtccaacgaccaatctacttcgttagcgaggttttggccgactctaagacgagatatcctcaggtccagaagctattatatggtgttttaattaccgtcaggaaattatctcactacttccaaggtcactcggtcacggtggttacatcgttcccactcggagatatacttcataatcgtgaagcaaatggacgaatcacaaagtgggccttagaactgatgtccttggacatatcgttcaagccatgaacttcgatcaagtcccaagccttagctgactttgtcgccgagtggaccgagtgtcaagaagatatgcccgaggagaagatggagtattggaccatgcactttgatgagtcgaagagactttcgggcactggagctggggttgttttaatttccccgactggagaaagactgagctacgtgctctggatacatttttctgcatctcacaacgtggcggaatacgaggcgctccttcacggactacggattgcaatctctttgggaattaggcgtttgacagttcgtggagattcacagttggttgttaatcaagttatgaaagagtggtcttgccttcatgacaacatgaccgcttatcgacaagaggtaggcaagttggaggataagttcgatggacttgaactcacccatgttcttcggcacaataatgaagcagctgacagactagctaattttggatcaaaacgcgaagcaactccttccgacgtgtttgtcgaacatctttacgaaccaaccgtaccaagaaaagaaacagctgaggccatgtgtcgtgaccgagaaaaatacattttcccgaacgctagtgtattaatccctatcccaggaaaagccggggtacaccacacaaacatgatataaaagacacatctttattatatcgataatatttacattattacaaaggcacttaaggcctgacaataaaaaaataaccagcagcggactagcgggcctacggctccatcttcacagacgctcaactggggtataagccaggactccacctaagacttcttctccaaagcttctcttactgaagggtggggggaaatgattgagcaagaatgagtacaaccacagtactcagcaagccacaccggcagatgcatgattaatgcaagagggtacaaggggtaataatataggggttaagtttgtagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctaggtcccagctcgtcccaagccaacccaggccaaccattccacattttagttgttaagcaaattttaagaattaaaacactaacttgggtacattgctaggcttgcccataaccgagggcacggctattcgaataggttatactctgatcagaggtgtacatctttacccacaagacacatcttcctcacgtgtaaccacgtgccacataccaccacggtatacggatggaagacgtgacatagttcccaacccatcctagccataaacaagagtaccgacccaaccccacctacggccggaacctccgggacaggcaggcaggattgagcccctagcagcaggacaccagccctgtgcaatgacatctcgactaccgggccgcagctcgagtagccttcatttgtcctagagatgtccatcgacccccgacttcgtccatctccatccgtgtacttttgtttataaccagactgagccacaaactaagccttacccactagacatgtggaagtatggtagtgctttgcaacagtggcccgagcttaatccttatagtacccgaggtacgactaacaaaaccgaaccacgcacctcgagcccagctgtcacgcccggaaattcactaataatttccgaactaatttgtgcataaaatcctcgtccaggaatcagccgaggtacacaaactgacaatttaatatacaaatccatcataataataacgttacatacttaaaaaaaaaagaaaaacaacagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacaacaaatatgcaagtgcacaaggataccaaaggatggcataatataggctcatttgcaaaagcagcatttagcaaaacatttaagagaagtaaaacagtggagtaattaatcagaaattttaatcaacactgaatagcacacccatgctgcacaggcccaaccatcctgaacaaccatacccggctgtacagatctaactccaaaccaggagctaagcaaattattaccaggtataacatccataattattgtgagaggtgagactaatcacgaaaaacattgctcaacccgcccataaccgcgggcacggctatttgaatagttttactctggccagaggtgtaccactgtacccacaagacacagcctcaacatcatgtctaccatgcgtcacgatactggaaagtacccaaatagaggctgtgacaataccctctgcacaacacaactcaccacagtgcaccattcctggatcataattacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgtgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatgtaatatctagctgaaccaatatataaagctcaactagtcaagttataataacccaaggtatcaaagaataaagtaatcaatgcaaacaggccataacaaaggaatagattcacaccacccagtgacattcgaaaataaatgcacagttgaaataaatagagaatttaaatataggatcaacatgctcaaaggattgggtttaggatctgtgtgacttgccttgcaataatcggttttcaattaatcttctaaacactcccgacgcactcacgaaccttcacaacgacggaaacgacaagctaacacgcaaaacgaagaaaaagactaataaaaaccaaataaacagtaaaaaacaagcataaacagtacatgtggatatttttaacatgtagatcatgattttagatgaatttagcaacttgaaccactcaaaaccgagttacgatgatttagttatgaatttccgaagatttaatctatttgaaaaacaggaaaaagaaaaacgatgatgacgtcatgatgacctcatcaatggccggaccaagatggcgacctcgccggagatgggatggtcggctgcgactttggaggacatgaacacgtagaggatgacgagacgaacccaacggtactcaccctcgaaccaaacgacgaacgacgacggccggcgacgaggtctagcggcggcgcggcttcggtcgacggcggcgacggggctccggtgactggcgacagcggggagggagcggccgagcttctccactctcccgcgcacctaacggtggtgacggcgaccggcggcgacgacggaggcggcggcgcgacgcggatggagctcggccggcgatgacggcggggtggagcacgtggcggcggcgctacgaggcacgggagatcacaggagagggggcaaacgaaagaggaggactagggcgtcctatatatagccatgggaggccgggatcgagcccacaacgacgggaaaaactcaggaaaatttagatcttcgccggaaaaaggaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcacggctctggctctggctctgtccagagctggaagatgaacagtagctcagggagggaatgtagacttcttgccgggcttgtcttttctcagcctgattagaagagggagcaaaaccagactttggctgagagaaaaagagaggatgcaggctcgggttgggccggcggaagagagaggaaggaaaggaatgggccgattcagcctaagacaagggaggagaattttatttcttttccaattaaaataatcacttaaatgatctttgaattgttaaaaatacttccaatgctcaaataatttcaagaaaaatcttgaaaatacttggacactcaaagtacttaaaaaatttataattagaccatttaattattaatttaatatgtgggtaattactgaaatgctctttgtatgattaaaattaggaattgagctccgaaaaatccgagaatattccagagagtataattaatcatggagaatttaatacaaattaaatccatccatgctttaaattaaggaaattttatttcccacatttaacttcacttgtaaattaatgaacagttaatataaattcgattaataatttattaaataatttataaatcctgaaacggaaattcaggctgtgacaccagcctaaaaccattttgggggttttgaatagagggggaggtgtgtgtccaattccaacataagccaaccattctatagtgtccaaatgatatgagaattcccaaagtctaaagttataaaaccacctaatgttgcctaattaatcagcgaagcatctacctaaattcatactagtggaaccatgaatagagtacccactagttagggttttgtttatcctagggtgaacaaggtaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagataacggccttccgaaccttcggcgacgaccacaaaccacgcttcgggaacctccagaacgacgaagactacgcgaagcacacaagcaaagctacaagcctataaagaagcaataacaatacataaaaagaaagcacagggttctttaggttataacaaacattaggagacttgaacggatcgattcggagctcgtatgaccaagatatgatcatccgaagtttaatgctgttacatggagatttgcggattattataattaggttttgcagctataaaacatgtgtaagcgctagcctggaaaagacaggaaggctgcgccgttgacatgcggaccccacatgtcaacctaaaggaccgcggtagaccgagtacacagagacggtccacgggtcgacagaagcagatcccgtgtgtcaaccgaggcgagtggccgataaacggactccactagacactacacgggctgcacacgtggaaaccacgcggctaccgagcgggcacactaacacggtcaccacacgcacaagcgaatgactaccgacaccggtacacgggtaccggggtcgacaaccgcacaacgggcacgggtgacaccgaaaggacaaggacggggcagcgaaggagagatccttaccaccatgcgacgaggcgagggaacgacaacgacgaacgggcgcgcc

SEQ ID NO: 59010 - DNA, 4726 bp, Oryza sativa
tatcctagtacaagataagatatattgtggggatggtaaacaacaactacgagggtataagctttagggtataagctttattagcactttatgataggtcccatcttttttttaattgtggcatgacttatgttcgaagatgtttttagatgcgtcttactctattacctactctacacatacatacattatggtctctctaacctactattaccacctgacacgagcccaccttattactatacgtagttttgcaataaacattacggatgccctaagagttttgatgcaccgatcatctgatttaaatctgatataggttttaataggcaaacaatattatattgggagtgtcatatggtgacatatttattatgggagtgtcgattttatttggagctagtgctctatgttggtcaatttagcattgtcgtaatggtatagtttttaaccataaaaaatgcctaacatcatacaggttatcttcatgtgttccaattggcttcactcttggtgtatgatgctttcacaggaacaacaggaaactatgcgtaatggtgctacacgcttgaaattgatagccaaggaacttttattccagtttggatgacgtagtacctacaaaatttcacgatagaatctacatgattttaaaaacattattttagtagatcatattattggcagaagttgagggtttgtctcatctcgcctttttaagctcttttcttttcacttctggactttttggctgtgtgcttacggacagaggccagagatgtaacccatttccattatctaaaatatttattatgggattgctaaatcgcattcccaaaaacttgggagggggggatttctttcaggtttcgagccctacaattttctttgcaattcttgctcctacgaccctttctcccccacttccagcgatgccaacttagggttctaggttgcttataggggtaggaggggtgaggagagggggaagagagggagatcgtcatcgccaggcttagagggatgacgatgggaagtgtatacatgtgggcaatggggcgccaacaacggcatcggaaccatgaggatagaggagagtggtaggttagcattggtggtaggggcaaaacgaacttgtagttacaaggtgtcgaccaaggacagtggacccaacaggatagggcacctctctgtcaccggcttgaggaggaggaaggagaagagacggcaagggggcacttgccagcgccattggcaccttctagccagctgccaaggctgggcggtggtgtcctagggtgggaggttgtagaggtggtgacatcgatacccacattgagaagaggacgggaagggggaaataaggttcagttgttgtatagcatgagtctcaaacaaatctgtgacgtccaaaaagtgactgagatcagagaggtttttctatcatatatgatattcactccatcgtaaaaggaactaactgctggatctgaatctgcattattttcagctagaaatttgtttttacagaggatgcagatagtccttatttatttataattttcagtcaattttacactggccattctaaggctatgttcatcacgaactttttccaacttatattctctcgttgcccccacgcacacttctcgaactactaaaaggggtgttttttagaaaaaaaaatatctataaaatagtttctttaaaatcatatcaatatatttttaatgttctttttgttaatacttaattaatccatacgctaagaacataagagaatccacaatatgctaaatagtgttgttgtaattcgatatcgtagaggtaggtagtaaagtggatagtaataatatcaagtagtagtctaccaaacaataattactaaacaaatattaatctctcctctctcttctccatccattcatcatatcttactatataaagttgatgctcactaactactaaagtttaacatgcaagtgggccacatcatcacccatagcaattattatctagattatcttaaatcatatgcaagtatgccacatcatcacccactagcaactattttctagattattttaaagagtaaaataaatggcaggttcttaaacttgagctcacttagtccgtaaacttgaaaattgcacattaaggttcatgatcttgttttaataaaccatagccggtctaaagcgcgtttgaccagagctgaccatctatgtggctctccacataggcagcattttgcatctagccccctccgcatctcgacgtgcccgtaaatttgtacttactccctgttgcaatagtagtcgccgaaatccccccaaatcccttcgtccctttgcattccttatgatcgccatcatcatcctcgccctacttaggcctctccctcagaagtgcttggcggatgcaaagggacgaagggatttggaatattttgggggatttcaatgactactgtagcaatagggggtaatagggggtaaatacaaaattaccaccacgtcaagatgtggagggggctagatacaaaatgttatctacgtggagcaccacgtaggcggcaactatgatcaaacacactttggaccggctatgctttattaaagcaagttcatgggcctcaatgtacaattttcaagcttacggacctccccctcgctatgttaagcctccatgcgtggttacaacatgtccctctatttaagaggaatccgaggatagagtccgagtcttactctattttaaccgactttatacatatattcgatacaaactctaaccgcttgcgtaacatcttcctcatgtgtggatgcaagtccatagtgctgcaaattacatttacacagagaatgttgaagaaacaaacattttcaaacccgaaaagaaaaaatcagaattttgtactactgctactgctagtactgacccaggaattcgtatcgcacggatgagcttggagacgaggccatcggtgacgggaggtggcttgtggaccttgaggcgagtccccatccggacgaggtcaaccttgttgcagaactccctgacgaagtcctgcggcttcttgatgggcattgccgtcgtcctggcaatggcactgcctcctggcggccttctgctcccggctcttgacagcccagtcctcgttcaccttcctcttcctcagcactgtctcctgcacgtacagcagctgatgcgtccccttctctgccatcatcgctgagcgagcgaggaagccgggaagggtcgccggagccgaagtcgcagcgttgggcgtttggttagctcggtggttggagaggaagactgagcgatttaggtcgtgatttcctcttgggtcattggcctcttcacaaggccgcaaaaggcataactcaacccgaggtggggcaggaatctttgggttgctaacagatactgtctccataaagaatatctaatctaatctaatttagcctacttcgataaaatgagtaactttccgatcgtcactcttggctttttttttctctctgttcgcgagtccagccacgtagctggagacacgagagacatcatttttggatttcttaagagcaagatagtatagccaactgctggctgcaaatcatctataatcaacttaacagtcaattcatacaatagttacctataaacatatactacataattaatatctggtcctacctgtcatacatacatataacttgagtgtttagagctgtaaatctataacccgctgcccttctctcttctattttatctcctcgaaatgtgtttagagctggtttatagcctgctattgtacatgctctaatccggatagaaacctcttgatccatgtgtgctcctcagcaccatggcatgtcaaacacccatgcagcctattgttaatggtcgttaagtgcaaaccataaccataaaaaatacaaaatatacgatcaaagttagtggtagagatctagtactaaccatttccactagtattggtaaatattagtatcctaatcaatatcagctttataaaattaacattgcaagttattttatcatcgttcttacgaactagacaatttcgtgtactgtactaaatcgtatccacctaacaaatttgtataccaccaatacaagttactcataaatctgctgctgcgctttaggatcaaggggcaactatggacgaaggcaaggacaagacgaacggaatcaacccggatttatataatcttgccacgaagttaacaaatatcacacatggcatgcaactttgaggtataactatcgtgctaggtctgacttattaaatctactacaataaaattctatgtactccctccaaaatgtttctatgtactccctccaaaatatttaacgctgttaatttttaaaaaatatttgaccattcgtcttattaaaaaagtttaagtaattattaatttttttcctaccatttgatttattgttaaatatacttttatgtttacatatagttttacacatttcacaaaagtttttaaataaaacgaacggttaaatatgtttaaaaaaatcaatggcgtcaaacgtttagtaaatgagggagtattaaggaaatcgactacaatgccaacttttaggaagcaatttaacatattatgccatataaggtttctctttaaccaccacccatgggcatggattacaggtgagctcctgattgcacctgtaa

SEQ ID NO: 59011 - DNA, 621 bp, Oryza sativa
agataacttagtcattgattattatgcttattatgatactaaatagcattacttgcatcagatcattctaatgtagttgtgaacagtataattcagtttgtaaaagtgaatttatgatgtataacaacctgaataccactatcttcagaaaccatggcattggagtttttcctctcattaataggaaaaggatccttgaggatatcaatttgacccaactgaaaatcaccaacacctgacagatggaccttttgagtggcaaaggtgttagaaaataggaacagaaaatcataaaatagctcactagaaataaaaacatagatcacctacaagctggttgacagaaagattgtgggcacgtaaatatccagacataagcaatgtgcacagccctgaactgtcatcaggttttatgcaggcctgaaaacaaacatcttatgtcaatcagttttaaactgaaagaaaaggcaaagccaacatgacttgtaacttgtgaataatcaccactagcactgaataatgtaggttcaaagccaacttaatatatcattacatggaaacctaaggtgatgtgatgcatgtgctcacaatctcgcatatgccttgtcaaagattcaacac

SEQ ID NO: 59012 - DNA, 9366 bp, Oryza sativa
acgatggaccgcgaaggggttcggtcgaaggggaggcgaggccgagggcgaccttgccgctgcgatgccggaggtggagacggcgacgtcggccggtgcactggcacggcgaaaggggctgccggagtgggtgccgacgagaccgagggagaggcggcgcgcgcgacggcgttccgacgaaatacgggcgacgccgtggcttggccggggaagaggatggcgttccgatgccgggagaggtggtggcaacgtcggccggcgcacaggggacgcggcagaggcggccggaggcggaacagtggcggcaacgccactgttgccggcggggatgcacgtccggaggtcttcgcgggaaacagagggcatgccggcgaagaggaggtggctgcgacgctggaggaggcgacggcacggccggccggcgtgctaatacggcggcaggggcggctgaagacggccggcggcacgggagagaggggacgacggcggggaggtggctagggaccacgggagatcgcgggagggggctaaaacgatagaacggagcgagaggattccgttttatagcggagggaagcgagccgagcatgggaggagcggggaacggcggcggaaatggcggccggcggccatggaaagcggccggagttggcgcgtccgttcccggcgattggaggcgccattcaagggggaattaagggggaaatagagaggagggaaaggggattaattccccctaatcaattttggaattcccggtttgaatcgtgcggatttgagggaggaaatggctagggttcacggagtaggaggaggctgggcgggaggaggacgacgacctggcgcgtgggccccacgcgggcgcgcggtcagcgcgtgcacgtgcgcggcacggtcgggagggcgcccctcggcttgggcccggaggcggcccaggaggagaggagggagaggcagcccgggagggagagggaggaggagggagtgggccgggagggggagggaaaaagaaagggaggagggaatgacttcggccgcgggcctggggagagagagggaggctttgggctagacttggcccaaaggaaaaggaggattatttttaggttttctttttattaagctttgataattgtttttgttgcttaataaatatttccggtgctctgaaaattcaagtaaaatttgagggctcattttagaccaaggagaatttaacaaaaattctccgggccacattcgaatttttcttatacgtattttagtgtttgccaatttctttttgaattttaatttattctattattccttttagggaatgatttttatttcgggatgaatttatcaggacgtgacaccatggacactcaagatgtagcaatgattgaagccgactggagagagccccttatacgatttctgaccaaacaagaactccctcaagataaagatgaagccgagcgaatctctaggcgcagtaggctctatattattcatgagaccgagctgtacaagaaaagcccatcaggaatcttgcaatgctgcgtgtccttagaggaggggagacaattgttaaacgatatacattccggcatctgtggcaatcatgctgccgcacggaccattgttggcaaggcttaccggcaaggttttttctggcccacagctgtgtccgatgccgacaaaattgtgcggacatgtgagggttgccaattttttgccagacaaactcatcttccagcttaagagttatagactatcccgttgtcttggccgtttgcggtttgggcccttgacatggtcggcccgtttaaaaaggcaatcggcagttatactcatctctttgtagctgttgacaaattctccaagtggattgaagctaaaccggtcatcacaatcacggcagacaaggctagagatttcttcataaatattgtgcaccggtttggggtacctaatcggatcatcactgataatggcactcaattcactagcggagtatttaaatacttttgtgaagacttcggcattaaaatctgttatgcctacgtagcacaccccatgagcaatggacaggtagaacgagccaatggaatggtactccaaggaataaaggcacgagttttcgaccgactgaatccttatgccggcaagtgggtggaacagctgccgcctgtactttggtccttgcgcactactcccagtcgggccacgggccagtcgccattcttcctagtttacggggcagaagcaatgttgtctagtgaggtggaattcaaatctttacgttttcgcaacttttgcgaggagcactacggagcagaccgagtagatgatctgaaacgactggaagaggcccgcgaagcagccttaattcagttgactcgatatttgcaaggattgcgccgttatcataatcgcaacgttcgatcacgagcattcttagtcggcgacctggttctgagaaaaattcaaactacacgagatcggcacaagttatcccccttatgggaaggtccatttataatctccgaagtcactcggccaggttcctatcgactcaagcgtgaagacggtacttctatcgacaactcctggaatatcgaacatcttcatcgtttttatgcttaagcattacttttgtatttccctattttgactgctaacatcaagctttcccttgaagttatcagtcgggggctactataataataatggagtatgatttttatcaattcaatttgcttacttgatttatcattgccttgattaattttttggcttagtcagtgaggactgaaagttttttaatagcttttgctggttttaggctcaataaggtttgacaaaagcttttaagaaatcagaagctaagttcaaaatattgagcacagcataaattcatcagtattgtacaaattgttcctccatcatcatcatcatcagaatcattgttatgacataacatcaatcggtatcagttttttcatcatcagagttatcagatccagtcggccgaaggtcgttgtcctggaatctttcaactacatcaaatgctatcttatcagcggctttctgcgcatcattgatgaggtcaagagcagcttcttcgctcgtcccatctacaaagccatcaatggcgtcaatgtcgatcttcgggtacaaggacttggtcattgccaacgccaggcttgcccccatacttccagcctctttgatattcttaaaatatgtatccagagtaactctcagcttgtcgaagatttcggaagcatcaaatgtactcggaccattgttattgaagaacatggcttggacgagtggggtagcagcgttggcgacttcatccctggctccttcaagcctcttgattttgttgactaagacatcgaattgggcctgcgacttgattttgcggtctgcataaacagatccatatcaatgagcaagcataaagaggataatggcttttggagtattgattgctggtaccttcaacgtctttcaaagccgagtccctctgccttgccaattcagccttgtcattttccagagtttggatctgcttttccagttgagatatcttggcagcttgcactatattgcctctggttaattgatattacaaagatggcagcataaataagttggacagagattgtgtgtaccttttgaggagccactcagttcgaagttggagtcttgcagctcggcgatccgatctctcagaacatgttcagttttcctagcgagctccctagcttcgtgtagctggtttctggtagcctcaagggttccaaggtggggaactaacctctcaagagttgcagttttcgcttcgttcctgagatggattctctgcaatacaattttatcggcatttgagctgagtggcaaacaggattgttgaggccgtgcatgagggaacttacgtttacaatgcgagtagcctggctgagtgcctttttcagtaggcatacttcctcatcttctttttgcttgtttatcacgattctctaaggttgcatatcgtcatcccaccacttgactagaatgggaaggcgagaatcttcagctgctcgtatccggaggactttttcttcatcaccaatcattggcccttgtatattcatgaataaaggtgagacaatcgaatgaagtctgttagatcaaaatgatttcaaagaatatgtttacctgtgatgatttccggtcggggacgagtagtcttttgtactttaacaggagaactggaccctgggtcattactggtatcatttctcggagggctgtccgtttgagttccaacttcagggatctctcagtttggttctgcgcccgactggtttccagtcgggggcacctgattaaccccgattctagcttcggccgactggtttccagtcaggggctcgtcgctgggttttacattgtcgggatccggctgattattacttgggtgatcttctgcggtcggctcggtctcttttgaaggacccgtctccatgtcagttggttcagaatcttttccagaaggatctatgtcagatggcttcctacaagtttgagttacgccattattattgcttcaatagtgggtgagcagcgctacgagggaggtagtcaaacaatttgtacctagaagatttcctgatctttggtattggacgactagatgttttcttcttagggttggtttgccttggcagttttctggttgcccctttattgctggattttccagcatcatcgccttcatcatcactcaggaccaatttcctcttgcgcgagtccgataggatggttgattttgagatgtttgattgggtttcagaccggatttttggtcctccgcttgcctgaccagtctgctggcgaggtgatcggcgttgggtaatcggagggtttgatttcatcaaggcgaattcctgggtatgatgattcaagctttttatcaaccttgcagataatgaaagaatgcttagaaacgagctgggattttaaatacataccggtggagggggattgaaggcattgtatggcaccacaggcagcaagtgcgaatagctgactacaattgcattggagaagattttatacatcctctccttcatgaccttgaattcaagagattcgggatcttcatggttagggtcatgtttgccgtcgaattcaaaggctgtgcgagatctttctttgataggagctagccggctcttgatgaagtgccgggtgatttgttctccttgcagaccttgctcctttagctttagcatgtgatccatcagggcgagcgcttgggtggcttcttctcccatttgaagtgaattccaggtgtcctgataaactggagggagacaggagtactcggggagtgcaggctcggggttttgtacataaaaccaattcgcatgccagcctttgtttgaagttttaaacggcatggagaaatacttttggctcagagttccccttagttggaatccagctcccccaactacgcatggcttacttttgtttggttggggcttgaggaagaagatgcgacggaatagggcaaagtgtggcctaatgcccaaaaaaccttcgcagacgtgaataaagttggcaatgtgaactatggagttcaggtttaagtgatgcgggctaatcccatagaaattcagaattccccggaagaatcttgaggttggaagagaaaatccgccatagaagaaatgagaaaatatcacaacttcatgtgtgtcgggggtcgggaacgcttcgtcgaatgctggacgccacccaatgatttccttcgccggaagaacgccgtgcgccaccatttccttcaggttttcctctattacatcggagggcgcccattggctctcgaagctttctctctcctccgccatggatgcgaattgggtgatgcgatttgctttggaaatggcagagagtggatgagggatcagtgcggtggttgcgcggaaggttttttgtggagttttggaggatggattggagcagatcgatgaaccctagctttgccggcgcaattttgcactgtagcaggaaatggggaaagtggcgagagtctcggcgaggaagacgaagagacgttttatttctctttggcgttattagggtatcaggagtactaatgggcttgggcctaaaaacagtacttcagcccaattctattttcagcgtggcttgttgtgatccctggggaattaggcattttttgctttggcaatttgtgctcacaatggtgtggcccgatgctgttaaaatcctttttaatgcagttagatgatcctttggaatcactacgatgcgaacaaaaaggtacccaacagaaaagtgttatactatttttgtaagcttttttaggctgcaaaagctgtttgggttgattcgagatgattagttttctcatggtcattctcttagcatgttatatgcttattttgattatggtgagagtcatagcctaagctgtttagactcgttaattgccatgattcttatcatatttggtggatcatcttaagagttttttactcggattcttgtcaaatatgtttatttatggaccttaggagtgtctatcactcgggctttctcatatttccgttcttggtatgttaaagctaaaagcagtcggctggatgttttattgaatgccgcatatgctttgttatatgatgtttggttgtaaaaccacttggttcttgactatatgtttagttttctaactaaccacatagtctggggctacacctaattaggtgcatctagtcgatgcacccggttttttctattttaaaccttcacagtctttggttttggtattcggagatctatacagaagaaattgaagcactgggattattactttatgttccaagagaaggctatttcgtcgactgcaaagatctcgggggctactgtggagattatggataccccatatctacacggcatgtatagtccgactgggtacaaggtaccatgtatagatagaatatcttcaagaggactcgggttaagtttaaacttgtatgtcaaggaaatatccgagattctagttggttacgattgtattttatctgtaattacatattccgttagggatatgggctgtattttgtaatacggaccccttccgctatataaggaggggtccgaatccctctagggacacgttttttctcccagatcatatgatcaataatacactcggcggatcaatccccggacagaagtagggtattacttcttgattaagaaggcctgaacctgtataaaattccttgtctctaaacccatccacttttccagcttaatagccaccccttttagtattgccgaaatcttgtttcgacacaagagtaggtaattggtggccaacacgtcctttttctttttcaaagagtaggtaattcgtgatgagagtggtggtagattcaccttttttttacgtggaaagagtaggggaagccccagggtgattttcatttaataaaaacaaaaattgtacaagagagattatagattgtcaatccatgtttgaagataaggtctggaaactaatctaagcttaggtaaatgtagacttagttcctccttgagagtggtagattcaccattcattcctaaaagagacgtatatttttctcgactataaacttcttatctattgtctatttgtgtcaatattagatatgtgtgcacgtacgtgtgcatatatctgtccgctcagaaaatttatacggaagcgtctaaattttgacggcatgaaattttcattaattccagtccctttgatgataatccaatttttctgatctaacttgctacttattagctatcactcactccagtgattgaacaataaactattatacgtgaactattatgacgtaaacaatttacaaaattacaaggaacaaacttataactcaaaaaaattacaaaattacatgaaaaaagttaaatagataaaaataaaataaagttacaattaaaagaaactaaaaattgtacatttatagcaccataattttaagtgttgtactttttgagtggaagctggtagcaaaatttatccaactacgaaagtagctcgcgcacatgtatggacatcttatttaatattgcttatatttttattacaatggtttatatccgggtgatattttttactaaatattatttgactccttttgaaatatgtatttcttagttatttgtttgggcattgactatgattttctactaattacccttacaacatataaattttaaactataaaattatttagaaccgtctagtattgaatttattaaaaaaaatattatgttacaataaagaagttgattcctatctattttcaaccatgtgtttcttttttaaaaaatatttagtgatgtggactagggttcccaaccttccgaaggttgtgataaacatttgatttggtagagtcacgacacaaatcaatccggcttctgaacgaacacgctcttgagccccgcaatcgcaacaccacgtctcctctaattatcaaccgtgtcgaaacccagttgacctcgccgagaaggctaatccctgcttgcgaatcgaagaacacaaacaagaacaagaaaaaatacaaccaaattgcagaggaatgattaagctcacacgttggagtcttataaaccgaaggatcggcgaaactgttcttgacagattaatctaagcaaaacccaaaacctaaaggtggtggtggctactaatatatagagtttagggtcatgcaaacaacccttgagcaactctaatgagctccaacacgatacacggctcaaaggccataatacggaacaaattctatacgtcaactttttcggttgattcccgattacttggaaagaatttggatatgggacaagaaccattggaaaggctatcttcttagctttccatccatataaagaacgccccaatccgagtacgtatgcgacctagaagcccgttttactgcagactagtcctagactccgagacgtactcgaagtcgatttggcttgggcctccatcttgacttggacgcctttgctgatcctccatgcctctaagtccctctctaagtgtctccttgtcctctccattgttcctaattttaatataataattaggtagcaatctattctcaaaatcatataagaaagaaaataggaatgagctcacctctaaatttaattgtcgcacgcaagctcttgtgattggtccttgaatgaacggtggagaattgttgtgtatatctgaaggagagatatccttatcatttagcatatttttttgagttttcaaacatcaagtaatactttttt

SEQ ID NO: 59013 - DNA, 16168 bp, Oryza sativa
attcctgcagcccagcactttcttttgcatacaacaaatgaaggaaacatctgacctagacaccacggctacgttatcgattagtactctagtcttagccaataattttcttctttatccagagtcttaatactagaacacttactagagcaatcattataaatactaagtgacaaacctacaatgacgagaagctatcttacttaaataagaaaagtaaacaccataaggaaatctcgaatacttactttgttgaagaaagcattcgccgaggtacacaaaatgaagtcaaccactaacctatacaccacgcctaagtgattctagcctcacgcaagaacttccttctttatctagaatattagtactagagcacttaataataatactaagtgatgtacccgcaacgatggcaatatatcacacttaagcaaataaattaaattccaaagggaaatctcgaacacttactttattaaagaagcatccaccgaggtagaagagataagagagtgccgatagctccggcactcctcaggaccttctcctcagtctctacttattttctccacactactaaagtgatgcctaaaatatgaaagtgaattgtactccactttgttgtgtgttgagaatgagagcttctccttgtttgatagggtggttatgactgttgtggaggtagattcatccacaaccatcattagggagcaatcaggagctgccacgtatggggtggagatgagagccggccatggcggttcagctgacccttgggtcccactcttctccaccccctttcaccaggggttgacaagtgggccctatggcggttgaagatgctttggccacacactaggtcggttttgactaacatgtggatcatctaatccttgtgctcgcatatgattggttggaggtacattttttttacggttaaagcaacaggagagctgttggaggtacattttgtcgcatggtagttgtgttttcatccagaattcatcctcacacctcccacgaccgcgtcgctcgccctggatgccgaggcccattcccccactctgcccacattttcccctcggactcaaattcgaatcgagcccacgaccgccactcatccccactaaccccacggtgctagtcgtttctacacttcacggccacacccgagcaccccgaggcttcaaaaccgctccctgagctcctctctttctttttcaacaaccactgccgctccgagccgctcttgcagcatcacacctagcaccgccaccactttactgctaacggttgccgctagccctgctagagtctctgccgggtagcaccgtcgcctccatcggcttcgcgaggtcgaggagcactgatgaggaaactaggtcccgatcttccgataggtattgataactcttgatttagtggaaacttgacacacacgatctagcttccaatcaacacgatccgaatgctgtgatcgcagcaccacgtctcctttggttatcaactgtgccgaaaccggttgaccttgcatagaaggctaatccttgcatgtgaatcaaagaacaaaagcaagaacaagatagattgcaacacaattacatatgaatgattaagctctcaaatttggggttccacaaaccaatctagcggtgaaactgcaatgttgttaacaacagaatttggcatcagatttggagaagaaggaagaaggtcgaagtggatctggtgttgaatctaactgaacttggagtcggattgcgcatcggctggataccgtatcggctgaaaacaaagtatggggttgatctaggttgatgaagctgatggccgatacaaccgatatgacatgacttgggctcggtatgggcctagatcaggataactatcattgccaataagagatagagctcgattaaggcaattgtatctattaattaggatattgagtcggtttgttagagatttggcaagaggctgccatatatggtcttatttgtatcttaattttagaaaggtttgagtcgtgtccatgatggactaagtttgtacttagggaataaatatgaaccccatagcattgtaataagggagccaatccaatacaacttcggcgcatcgccacccttttacttttctcgttttccggtgagttcttcgcaaaaggtaactcgtctcaatggcccgcgctaccgggctaacatgtcgctttagacgtgttaggctcgacatcgcgagtcattgctatcatatgtcttagttaatctattcttagcttctcaatttagctctatcggctgctgctcgctttagggtttatgctggtttcggttaaattgtcttgctagattagattagctaaggcatctaccgtcctaaaagtgcctaattgcttgattgtctagactgcatgtttcctttcatactttgagatgcatcatccctagtcatgcttagaaccatgcaaactagcctgcaattaggcataataaggatagtatcagggtttcagctgatcttacctaatatgcatatttcaccccctgtttcatgtatattcgctacttatatagatagatcattttatataagcatatcaagctttagtcagtatcggctagattcctacacctgcatgcttgatttttgtttaatatgtttatatggatcaatctatttatataagttgttactagagtattagctagtacgttatctttctttctctaaatactgtcacgtcagctactttcataatatcgttttaaatcaatctgttaaactacatagatagtattacatccgattggacgtgtttagggtttattattctttgatatatccagtccatagccgatttggtctaactccatcggctgagaccataaacgatacactatcagtcgactaattctacttttattctttcttgccgattgcaggaccaaatcagctggcacgcccttgacacactcggggctagcctaggacctgcactggagttaagcagatctcccagggcaccgtgttttcacatcaacaaatggcagaaataatctaagcaaaacccgactctaaactataacaactactgaataaatatgatttaggatgtcctagggttgccctagggcacacacccccttgggcttagcccatgacacaattacatggcccaagacccatatcagattcggactggatgagatacgtggtttgtttcgcagattcctgatagcttggtgggaattttgatgtggtaccaaaaccatctgaaactaaacttcataagctttccaacaagtactcatgggtcccgagattccttatagatcagcggctaggtccgtttgaagttgatgctgtcaggaggcctgaatccgaatccaaatccaaaatgtgtagatctttatttcttgtcttctatggaccaaaagtgacgtggtgaagtaggaattgacttggagaaggtcttggtttagtccccaatcaacctctgcaaatgaaaacacacgaaactcattgtgtagcaatgtttgttcaaagatataacaagtaaatataatatagaacatatgcacctttcgttgatgaatacataaggtagtcatggttatatttgagctagttgtatcctcatcaagcacctcggccaccggttggtcgccattcctcaacatgggaacccgcctccctcgttcgccagtgagctccaccattcccctctcctccggccagcaatgctcaccaccatgcaccctcattccctctccttccctaggtgccgccattgctgtccgcctcctcattcgctaggtaaccattgtcatcaccgtcctctcctgtattggccgctgtcaatccccttctagctcccttcccatgcgtgtcgttgcctctctggatgcatcgctgccttttgtgcgcactgccagtcgtcgtcgcgggtggctgcactgccccgtagccattggatcaacctcaggccaatctagattgtcgattcccgtggactatcccagtggtcccggtccatagtggaaaggcccacttgtgtcactgttgggtgggccccgcttgctggtgccggccttcccctcactaatgtcagcccttgggctttaatgtgcaataattcattaaggtttttttattaatagtaaaaacacaatgaatcttctaaaattcatagtaaattcattcgagcttcgtttaagtacatgcaaattacagtaaattcataaaaatgcctagaatcgactaaaaatgttgttgtctctattttagtagacttatagcctatttgctttatgtgctttgtttgttgcttatattcggtctatttcgaagctcccatttacttcgaagtggttgagaggttccaacatcactagagctaggcaagtcatggatcctaattgatcatgttgtacctattttacatatatctcgctttctattaaatactgcattattttacattgtcacgtgggatggtttcctatgcacttagccattgcttgttcaccttgtatcattgataacatgggaattaatatgactagatgttgttcaggaaatgcttaaccatgcttagatcaactagctcaccacgggaatctcacatataccttatatcttggattagtgataatgacattggacatggatcaccatggtattaattcaactaaaatatacctactggagggctatgggcacatagttttgatagacgcacccatgcaattaaggaccggttcgcagaaaatctgtggaagacttaccgtgtgtacaacataccaacgtgggtgatggttgggcttgttgtatagctccaccctctttgacgtacccaggtgagggtgggcgtgatggagttcggttggccctagatataagggttgatcaccttccatattcaccatggcacaagaggaggctacctactttagttttaagggtaggagcaaaacctgctgtgtggtgcacttgtttggggggagttatgtgaagggtcctgtcatagatcctttccggtatgttgtggggctgtgtcttgtgggtacatatgtacacttttggcaagagtaaaactattcgaatagccatgcccacggttatgggcgatcgaccagctttaccgtgattagtctcgtcattaataatttgacttaattgaattggtgtagttcaggtggatggttgggcctatctcaatgtggtttaacgttagacgatgatgattaatatttcttaatatacttcaacagttttaccgctttcgaccactgctttataactgctttatgcaaaagaacccctagcctcctttgaaatccttgcatcatacttcctcttggtatgacttgctgagtacagtgggtagtacttagtcttgctctattttctccacatcagagttggactactactcggatagaggtaactcagtggagtaaacttcgtcactaccgccaaggaaccttgtggagtggagtcaccgctttgctagcatcacttatccaagttttgctagttttaactttccactgcatttgtaagactttttgttatgttttgtaagatgtggatttgtatgtcaactttgtcatctatataccatgggcggtcctgaacaggggtttaatgcacattctgcttataattctggctcgtgaatttctgggcgtgacagttccccgccaaagcaagataccgatgagaaactactattggagaaggagtcggcagacaacgaggacgagaatgccattgaggatggcaacgacgatgaccgtttaagctggagcggtggaagaggaggccgaggtcgctgaggtggaggtggcagcttgcggggacgatgtgctaatgcgggcccaacaccgtctagacaaacattttgtatagtagtgtatgcatgtctggtgaagttgtgatctagaggatttcttggaatatatgccaattgttttgcatgattttttttccacctccgatgaatacaaatgcaatggtaaaacattctagctagcaaatactggatcatttattgtaactatacataaataagagtatttcacaaaactaaagatagttgtataaaattatcataaaactgcatatttagcaccaaattgattatgaaactataggttaagttggggtatagcaaaactacaattctactaatgaagttatctgtagttttttgggtacttatagcaaaactacaaatctaatctacaaatccttttttgcttgagttctgaatattgtacttctgtgattaaattgacataaatctatagctattgtgataccttcattactagatctgtaattatgtgatactccaccttgaatttgtagttttgtgataaatttggtatagaatctacaatttttcatacactgccttaaatatgtattgtttgatagtttatgatgtttcgaccaatttaaataaattatatggatgttttggtaatatgttgcaactaggtataaaaaattctccaatgtacttatttatagattaaattaaactaaaatttctgctaatgattgaaaacagatgaagattcaattccccatagatacagcaatgaacctcccgaaaattttataacttttaaagttcatttggcacctcgattagtttggtcaatgccgtagtcaacatattgagaatccaaaatccaaactggattgaaatgtgaatattcataattaaaatgcactacattggacgaccaaagcttatacaggaaattaattagattaacagtgaattttcataagttgcactactatacatgcgtataaattgttcgaatgatctaaaaattggtttgactcgtttgcactaaattatatttgcaatcaagtttccccctgtcattaaattctacttgcaatcatgcatgctaggataccgtaccatattgtttctctgctccatgccaggctaaaatatgcttagagtaaatttcatataaaactatacgttgttcatactgttaaaaaactatagatttaaggtaaagaatcataataacatatataaatttaacatcaaatttattagaaatcttcatattgaaggcgacgttattttgttcaaaattgaacatttcgatcggttacacgtacttgcgcccatccaatataatttatatatgagcaccgttcatttccttcagtttacattggtgtacaatatatcgatctttaattagttatttacatgcatatgatgtgacacgtagttaagcttaattaccatatcttattattattgaggcgtcctcaattgaaaggccggccatttctgtatagtagtgaagctggtttaaaattttggcccccaccggcaagcacacatctccctgaaattttcgggtttgtttgtcaaatatttgtaaatttggttaaaatttattcaaattcaataagatatgttaaaaattcaaataatttcagtcagaaaagtccagaaataacggaaatttcaaattttcggcaaccaccgaaatttcagtggcaaccgaaattgcaaaccctaatcaagagctcgaacttaatttggttagatgtttacttgttttgctctttaatttctcccccttgaatcttgatcgatccacgacatgaaatagtacaactatacaactgtaaaacatgcgtacagattacagatattaattagtggacgcttcaaatccctagcgtctgcagccactcgcctgcacgaatcgccgccatctgccacctccacgactccaaggtcgtcgtcgtcgccgacgccgccgcgccgccgtcgaggaggtgatttatgtaggcgtcgaggtcgtggacgcacgccgcgtggctggccttgaagaaatcgagggcgacttcgacgccgacgtgggtgtagcacgccttgctccacggcagctcgacccggaaaaccctagcggcggcctcgttgagcaccacgccgggcatcctcgtcaccgggtcgcgggcgttcgcgacgcggagcaccttgacgcggagctcatcgcaccgtctcttgaactcgaggttgccgacgcgcgggccgccgaaggagaagacggtgatcgggatggcgccgccgcggccgccgcggccgccgcggttgaggcccagctcggcgaggtcgtagccgaggaggatcgccagcgagctccccatgctgtgtccggcgagggtgatgctgacgtcgtcgtgcttgtacttgtcgatgaggcgggtcacctcggagaggagctggttccggcagctcccgcaggtgaacttgccggagaggtcgtcggaggtgtagagggagaggaacccggactcgacgcgcacgtcggggcgcgggtcggccgggtcgaaccgcgccggcgacagcgcgctcatgaagttggccagccactccgatccggtcaccgtgccgcggaaggagacgaggatgtcgcggcggccgaggcgggcggcctcgcggttggacgcgacggcgacgtagccgatccaccggctcttgccggcgcaggagcagcggccgccgacgccgaagggcagcgcgacgtcgggggcggcgtagatgtacctggtgaccgtgtacccggcgccggccatgccgaccgccggcagcatctgcttcttgccgtgcttgcagttgaggtagcgcttcgacgccgggtcgaggtcgaacgcccggtagcacgccgcgacgagctccccgtaccggaccacctcgtcccggagcagcgggtggagcggctccaccatgcccctccagtcgccggcgccctgcacctcccgccacgcgctcgccagcgccgccaccgccgccgcctcctccacctcctcctcctccgccgccgtcgccgccgccgctctcttctccaccaccacaggagaaccaccactactcgtcgtcgtcgtcgccgtggcggccgatcgcttctgctgtggcagatcacccagagtgacggtcaccggcgaggcagccgacgtcgtcgcggcagtgaccgggccactgacgcgcatccggcacgtcgtcgccgcagtgagccgcgccaccgccgctgccgccatcggccggcgatcgagcaggccagggttaggtgaggcggacgcggccgcagtggcgtgcgcagctagcgatcgatggatgagtacagtgagtggcggttggcggtaaggtgagcgcgcgtgcgtacatatttatagggaggcgacggcgacgcacgcggttggccacgtaagcaacttgaggagagagagagagaaagagagagatgtatggattatttgactagcgagacgaggaaaacgggtggagatgagatgagcagagcgttttcttaaatggaaaaagtggtcggttgcgggtctgaccgggggtacgggcatgcgcccgaatccggttagggtggagaccacctgtgttggatagacaagtactgcttgttttgtggggcagttagcatagcagatttgcacgtgtagtgtacatccggaatgatgcactgctgataggttatgagtgtctaccaagttgagacgatatcgttctcacgtatcctaatttttaaagtatcttaattttagtattaattttcacacgattctacaaaatcttatatatcatcatgatactaagattcggaggcggaccatggaaagttttcgaataagtaggcgaaattcgctatcatcgtaccaagggcttgtttggtagagctccaactactaaatttagctctagaagtttggtctggagtggagttatggagatgcctaaacccagctctatatctcttgttcattttgtgagagagctccacctaactccgctcctattctaggtagagctgaaattgttcggctgagttccagctccaggagaggtagagctagagctgaagctgtgtcaaacaggccccaaatattattttaacataaggtggattgaaaataatttaaataaatatgctgaagtttacataaaacaattaaatttatttaaatcaatgttatttgctttaatttatacaacatattatgtattttatataaaatatatattttctaaaatttcacaatattctgatcctatgttagtgtcatgatactataatattacaaataaaaaagggttaattggatcgatgccattgtaatttcttcagttttgaaatatgccattacaattcattaaattggaaccatgccattacaatttgtgaggtatttgagacatgccactacttaccctttcaaagcagtggcacatatctaatatatgttaaattgtaatggtatgtttctaacttcgtgaattgtaatggtatatttcaaaacaagcaaatttataatggtatggatccaattaacccaataaaaaagatcttacctaatatctccttgcaaccaactaggtactcagcttagtacaaagaaaaagtcacacatactctccaaggagagcgtaaacacatatctgaacatgcaagtttctaagcatatatctgaacaaatgtcaaatgtttatcctgattcaatccaataaattgatttttgaagtgtgtaataagtgggtatacatatataattacagctaattatgctttcggtagtagcacatcactagcaaaaatactcgtggtgtctttgccaatctcaacgtatgcgccggcgattttatcaatctcaaaatatatcggcttagtctttttgaagtgcttatacatacatggtgtataaatatatggtgtataagcttgagtgatcaagcacgcagacgatatcgtttgtgtttatatgtgttacgacaattaaagtccaccgtttaataatcagtaatgtgataattaagaaaattaatgtggttgttataaagtataaattcatacttgtgttttctaacctttgcaagttgacaacgttctacttactcttttttcatctgcacgcttccgaaacttcttcacaatacattttgaaaaaaaatagaaaagtttctttaaaaaattatataaatccattctcaagttttctctctaataattaattaattaattaattatgcagtgagataacttgttttccatgcgaggagaatgagtagccaatcatactcctgatcagccttttgactaccatataatggtaacatcattgttttccaaatcataacacatatatgtagttatctttcaattataatctctattacaaagctcaaaacattcggccacttcaactaatattagaattaaagtggcaatatatactccccagtcctaaaaatatataatcattttcagactttaacactcttttcaagatgctactttgactatcgatatctatgaaagtaagatgttttaaataaaaaaagttgcatattatgatagtttatttaatgataaatctagtaatattagttttacatgattgatcttttttttttctattaatagtctaaattaaaaatatttgacttgttactatatatgctaaaaatgcttatattttgggatggaggagtatattgcatgcatgtaaactttacatcttgtttatttatttggcaccagtagagctcgtacgttgtgctgtagtatcttgtacctcacgtcgactttggatgatgagtagtcgatgtttctgacccctcgtgattacttccacatttgtcttcgccctacgtggttgtgtgtgctatactccctccataaaaaaaaaaactcaacttctatagtttgaattttatcctataaaaaaccaacttctattatcctatatatccttagcacgtaaaataaaaagttttattccttcaatacctttacgtacctatcactattactactttttttattgattaatggtatttcagtcattctttatctccactaattccacctcaaaatgctaggaatgtatttttttgagatcgagggagtacgtatgtgtattaatttttggtttttattacgtggtatgctgttaagctagtgtggtaccacgaaagcttgcatttttccatgcatgacctacttgcagactacatctccatcgagcatatttataactaatttaacagaattcgtaaccgttgtgtcacagaaattgaaggagatttttctctcgaattttagactacgagagatccacactaagatttctgttggtctctttctcctccaacttggtctggtgagtcatcgcagctcgcggttaggattaattctagtaggttgagttccaggtgggaggggtaggcgagggagagattgggtttccccttgagagatagccgtaggcaacggaaggaccgacgatgtatagtggacttgagtgagtagggaggtggaggcagagccacctgaaactgcgagaataaagaaagacggtgggctggtgtcgccgacaacagcttgatgataaggaaagagaaaaatatgggatgaaacattcatacctcaattgccttgggggctggctaatgggcgatcgctcgagcgatcgatccccattcacccctatacacttctctcctcccttcctccttcccttcttctcttcctactacaccataaatttttaaaaaataaaaaaacaaaattgaaaaaaattatgtctagaaataaaaaatatttgaatttaaattcaaatttgaaatgggtatgtaaacttttgaattataaacttttggtctataaaataatatttgaattcaaatttaaatttgaatcgagtatgtaaactttggacttataaactttgggtcaataactttagatctataaactttagatgtatagaaatactatatataaaaaatatttgaattcaaactcaaatttgaatcatatataattcaaattcaaatttaaatcgggtatataaacttttgacttataaactttgggtctataaactttaggtgtataaactttagatgtatagaaatactatatatgaaaatatctgaattcaaattcaaatttgaatcggatatataaacttttgatttataaactttgggtctgtaaactttagatgtgtaaacttgaggtgtacaaactttaggtacataaatttactaaaataggaaagtaatacggtgccaaaaaaagaatggagggaggggggcattcggatctgatcgctaggggcgatcgatcgccccttagcaatctcgattgccttgtaccgttcatgtgtggtatacgtcttgccacacaaaaaagtttttaaattattaagtcgattggttcgtgtttatttctcaaattatatactactcaaaaaatattttaaaagtaccaaaattctctgtgtggtcaatcgttagcacggtgtgttaaaagtaagtagttcatgggtgcatccaaagatagtgggtatatatataaattattaagtcgatcggttcgtagtttattaatttctcaaattatatactactcaaaagtattttaaaagtaccaaaattatctgtgtggtcaatcgctaccacggtgtgttaaaaacaagtatttcatacgtgcttccaaaatagtgtgtatatatataaattattaagtcgatcggttcgcagcttatttctcaaattatatactactcaaaaatattttaaaagtatcaaaattctctgtatggtcaatcgttagcatggtgtgttaaaagtaagtagttcacaggtgcatccaaagatagtgtgtatatatacagtggcggagttgagtggcggacaactccgggcgcatgtggttgtgctcgttgcggtgaattcattgtaaaatttcatacaatacatgattgaacataaaacttttgtagcaaatacttactgtagatagatctgttcgaacttcaaaaattttctagcttaggcactgctatacatatatatggtgtagatcgtcattggtgtgtttgtactagtctcatcatagtgagaaacaaagcaacaactataaacaaataatgcgcaaaaggaacgctgcttcggttgacaaatactcatcgacacatcatcagtgcatgcaaaaccaatgatcagtgttagcaaattcattgacaaatatatacgactccaaaaatctaattggcacttctgttgttgaaacaatattttccactatcctgtatttttcaggcctcttagggaatccacaatgtaaatcaaaagtgggtgttatacactaaatgcacctatatgggttgcctctatacattgtagatgtggtctttatagcattaatggctaaagtagtccatatggctatgggctgcccacaagagaatacaatatattactttattactttttgagttcactatttggaaatgaatataaaaacaaaagcagttgattcatgactctgcgacaggtatccgttggttgaaggttgaacgttgaagttacttttgccttgagctctatgttggctacaaaacttgctcgatagcttgagctccatgttccctataaaaacaaaatagacagagcttcatattacacctcctcattttcatcacggattcatccaacagaagtttcaaaaacctcctaaatcaagaatctccaagcccagaaaattctaggcaccacaaccctcctccccaacaattccccaacagttttctcccatctcagttttcccaaagcttcaacccaaatttcttacatagtttctacccatttggtgccctaggcaaccacccacaatatggtcattctcctccaatctttcaagctactcaacatcaaggaaattggatgcaagctaactcaccaaatcaagtgtttggagctgcaagcaacaaagtactctttgcgcctcatcatttcacctcagttttttttaagaaccaggaaatatattaagtattataagcatagtacatagttgagcatacaattggaggatctgaaacagtcatttaactgcttggcataacagcttctttccggataggctaagtgagctatgttttgacaaatgtgagctaaacccctcctgggggaggatttagcttcctttgctagtttacctgccattttgttgatttcccttgggatccagcgaacctgtagcaagtcaattaatgggaaaaacattgatgatttgaacaaaaaaagggttttcaactccaatctcctaggtcttccatgaaatttctcttcatagtcgtgtctgcgatggtggcattgtccgttaggaaggtaacccctgcaaaattcagaaatatggcaatttccaaagacaactgaagggcaagcagttcagcttgaagagagctgtgagctttatcagaggtggccttaataaaaataacagtatgattgtgtggaaaatgaaagaagattccaatgccagttctaccattgtcccatgtagcatccaaataacacctgattccatttgggatactatccatctttcttttgcaagcctcagattggacatcatcctgcaacacaggttgagaaaggatttgggaataggaatttatcatagcatctgctagaaagcagacctgagagggttctttgaaaattccataaaacttgagatcatttctagctttccaaagttgccacataactatgaggagcctgctcagattagttttattaggatcgttattaatcacaaaagcaataatcagagccacatgagagttgatagggaatctgtcaaaatcagtcctgcaacctgaaatcatccaagtaagtctaatgaaagggcaagagaaaaacaagtgaaaatcactctcaggcatgccacatctgcaacaactttcagagatatctttaattctatggttgagcctaagcgcagagggaagagcccccctaagaagtctccaagcaaaaattttactttaggaggaatgcttttatctttctaagacactttatttaaagcaatggattgtgagtccacctgttgagtattctgatgctcacttttgtagacttccttgtaagcactttttgtgttgcattcaccattttttgtatgcttccaataaagtttatcttcagtgttagcctgcattactggtacctgcaagattttgtgaacaattttctctacaaacaaagagttcaacttttgaacatcccaattcggctgcaggaatt

SEQ ID NO: 59014 - DNA, 8870 bp, Oryza sativa
agtaccaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaggaaatcggtatggatttcatcactggtttacccagaaagtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctgatcgaggcagtcggtttacttcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaatagttatcaagctagtcttcagatggctccttacgaagcactgtatggtcggaagtgtcgcactctgcttttgtgggatcaaacgggagaacgtcaggttttcgggacggatatcctaagggaagcagaagaaaaggtaaagatcattcaagaaagattgcgtgtggctcagtctcgtcataagagttatgccgacaatcaccgcagagatttgagttttgacgaaggagattatgtgtatcttcgtgtcacgccttttcgaggagttcatcgtttccacaccaaaggaaaattggcaccgcgttttgtgggaccttataagattgtcagtagaagaggagaggttgcttatcagttggagttacctcaatttttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgtttttgcaaggtccaatggagtaatcactcggaagaagaattaacttgggaacgagaagatgaattgaagtcagctcatccgcatttgttcgccagttcttccgaatctcgaggacgagattctgtttaaggggggtaggtttgtcacaccctaaaaattcaaaatatataaattgttgtttaattggaatttttagaaatgattttaaaaagcctagaagagaagatctaattttaattaataaattccaatataaaatggggccagataaaatttcattaaatactttataatttctagatttttctgggatttatttgagttaaggaagtatttttaataaatggaattgcatttcatgaataatttaaattgaaaaaggtttttaaaagtctcttttggctttgggccgaaagtcggcccaaaaccttctctctctccccggcccaagtcggcccagtccgcagccgcccgcgcgcgcgctcgctgtcgctgacaggtgggtcccgcctgtcggagtcgtcgtcttcgtcgcgccgccgccgcccgaaaccctagccgagccgcgccgccgtctgtttccaaattcggccgcgtctttccttctccggtgaaatcaatagaggggaaatgatcttcgggatctcctctaccttttctcttttggaatcaccggctaaaatcgtttggaaattcgtggattcgagttcgattcggatcggcctctttcctccgaaccccgacctttccttctcgtcaccggcagccgtgggcctttgccgccgctctccaacccctttaaaaggatccccggtgtcgccgctacccgtcgccaccctcgcctttgcctctcgtcgtccgtagcgccctagcgccgtgtaacctcgagccgccgtcgtcgccgccgctccagccgtgcgccgccgccgttccagtcgtcgccgtcgctcggggagatcgccatcgttgtcgccatcgcgtcgccgttcttgtccgccccttcgccgtcgctattgaccgccggagcatcgtcgtcgtcgtcaagccgaagatctgcgccgcctttcctcgtcgccgtcgacgtccgttgatcttccgccgcttctttggtcaccggtgagttcgccgcgtcgcgctctacgtcctggtgccctccgttctcgtcgtcgcgccgttgttcgccggcgagcgtgcgccgtccgagccgccgccggtggtgacgtcaccgctgacgtcatcgttgccgtccgtcgtggtccggtcgtggaccgatggatctcggtcgtccgatttggatggatcgatctcggccgttcgttcccgtgaaccgccgccgtgcgctcggtccaccgcaaaccctagccgctgacgcaataaatcctttttccttttcaaaaataattcattattgcgtcataattcaattaaaatctatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagaatttgaagagttccaaggccagcaaggcaactcacacagatcccaaacaaccctttgagcatattgatcccgtttaaagctactgtttctattcaactattgcatttattttcgaatgtcattaggtggaattaacctattgtttgttatagctcttttgttcttgattactttattccttgataccttgggttattataacttgactagttggtctatatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaatatgataatggtgggttgtgagcacatggttttgagagacgtgctcatgacaattaaggaccggttcacgagtttcggttgtgaaacattaaccgtgccaaccacaagccaacgtgggcaacggctttaccttttgtatagcatggttcattgcggggcaccagactgagaagtggcggagataagcccacgggggtcgctagggagtccatgccttgttttataagggggtgattatgatccaggaatggtgcactgtggtgagttgtgttgtgcgaagggtattgtcacgatttccccctttgcagtgccgtggtggtacttcagggcatggcaacatgtgtgaaatcgtgtcttgtgggtacagtggtacatctttggccagagtaaaactattcgaatagccgtgcccacggtcatgggcgggtctaacaatgtctttcatgattagtctcacacctctcatcataataaaagatgctttaattggtaataatttggttagctcctggtttggaatggtatattcctggtttggagatagaactgtacagccgggatggttgttcagtatggttgggcctatgcaacagggtatgttgtatagcgttggattaatattgtttaattattacttaactgttttattaaattctgaaatgtttattaaatgttgtttatgaaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtttatcttattttccgctgcttagatctttattgattgagaggaactatctacctctgtaatgacactttattcgcttattaattagagtaataatgttactctattatcaatttgttattgtgtgcctcggctgattcctgtacgagggtttacacacatgtaagcgtttggaattttggatagaaattccgggcgtgacaagttggtatcagagcccccttgaccctaggttatgccaaatggttacccattgcaaaagtagaactgttctcctctccttctcttttaattaaaccaaactaatggcacatgcatttcatgatattttttagtggttctcattcaaaatttatttcagtgttattagtactgtacatctattactgtactaatggctcattttacccgcaaaagttttacaatattgttttatttaatcttgctgcaataaaataaatttagcatgttaattttataactttcttttatttcttttggaacccgatgttcaaaagtacaaaatttgtaaccttgtttccaactgtttcaacttatcttgcaagcttggtttattttatttacttacctttttactttgattttctaactttattcaaattaatccaaaaacttgtgctattaattggataaatgtcttaactccctcctttcacttgtctttagatgtcgcgctacaagcctgagtacttgtttggtgttgagggatttgttcagaagttgcgtacgatgtcctttgtcataggatttgggactgcccctttttatgcccagattcctcatgatcgtcacgaagagaagtgccgagtcaaagtcaccttgaacagtaatagtgaagatatcccctcagtgatgttcgaggctggaggaagaaactacatccatgcatgtcaggaggtggcaaggatcgccataggagagctccgcgatcgctacagtgatcagttggccgacagtgagtatcgctaccatcctcgccaaccacagggaagtgaccgtggcagctacctagagaccgagggaattgagaatgatgctaccacaaagcatttggttgagatgctgtgggctatggatgaaacccgtgcggagactgtgttagcggctcaagatcgtgaagaccggaatcgtggtaagatttgcaagctagaggacaaagtggatcgtttggagaaggaactagccgcattaaagggagaagcaccgccgcagaaggccaggattcgtcttaccgcaaggaagagagctctatttgtccctcgctaccaattggcgccaaaggtccgtgtggtggagaaagaagttaccccagccctagcggatcctccggtcatcaacataagtgatgatgaagaagaagaatccaagcacactcattccaagattgagtggggagcaactcaagatgatgaagacgagccgaacgagccttcaatcaactccgatccccggaagaattagagtgccatgtcaagtcgttgtcttagatcgttgtgttagtttgcttgttttaagtttggttgcgtgtgtctcgcatgtgatttacatcagtggtgggatgtaagtgcatgcgtttgtttgctttcgagtgttaggtagttggtgagtttagtggtgtgagagtctttagttttgtaataacgaaactcatttaagatcaataaaagttaaattaattccctgtcttaagtagttttccccggtttctcttcttgtgctcctgtccatgccagatggtgctcactcgcagcaacgggaatggccccaacaacaccaataataacaacaacaatggagagaatcccacacttgcccaagtcctggctcaacagacacagcttatgaacatgatgatgcagcaactccagaaccagcagaaccagggaaataaccatgcacctccccagaacaagttagcagaatttcttcgtgtgaggccgcctattttctctagtaccactaatcctgttgaagctggtgattggctgcatgccatagagaagaagttggatatgcttcaatgcacggatcaggagaaggtctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggaattcaggtcgctcactcaggggtctcgctctgttacggagtatctgcacgagttcaatcgtctggctcgttatgctccagaagatgtgcacactgatgaagagcgccaagagaagttcttggaaggacttaatgatgagctttcttacccactcatgactggggattatcctgatttccagaagttggtggataaggctattcgtcaggaggacaagtacaatcgcatggagcagaagaaacgccggattgctcaattcaagacacaacaggggaataatcagaagccgcgtcttactttaggaccccagtctatgccacagggaggtttttcgtctgttgttcgtccgcagcgtcagttcttcaacaataacgcgggcaacaacatccgtaatcaagctccacgccctgttgcagctccaacacaacaacaacctgccaagaaggagcaaggcagcaagctcgtagtgtgtttcaactgtggagacccaggacattatgctgacaagtgtccgaagccccgacgcgtgaaggttgtccctgcccagagcaactctaccgcaccagcatcaaaggctcgtgtcaatcatgtcgctgctgcagaagctcaagatgctccagatgtgattttgggtacatttcttgttaacttagttcctgcaacagtgcttttcgattctggtgctacacattcattcttatctatgagttttgcgggaaatgatgggatggaagtagaagatcttagacgtcatttgatggttagtaccccaagtaatcaagcactctctttgcagcatagtccctctgtcagaatagaaattcaaggagtaccctttctggccaatcttatcctattagaatccaaagaccttgatgtcatcctagggatggactggttagccagacataaaggtgtgatagactgtgctaacagaaaagtaactctcaccagcaatgatggacgagttgtaactattcatgcattgtcatctgagtctttaaggccaagtctgaaccaaataactttggaagagattcctacagtccgggagtatcccgatgtgttcccagacgatttacctggtatgccgactaaaagggatatagagttcagaatagatttggtaccaggaacaactccgatccataagagaccttatagaatggcagccaatgaattagcagaagtcaagaggcaagtagacgatttgcttcagaaagggtacatcagaccgagttcatttccatggggagctccggttatttttgtggaaaagaaagatcatacccagaggatgtgtgtggattatcgtgcactaaatgatgtgactatcaagaataagtatccgctacccagaattgatgatttgtttgatcagcttaaaggtgccaccgttttctccaagatagatcttcgatcaaggtatcaccagttgagaattaaagaggaagatatacctaagacagcttttaccactaggtatggattgttcgaatgtactgttatgtcttttggacttaccattgcccccgctttcttcatgaacttgatgaataaggtgtttatggaatacctagacaagtttgtgttggtctttattgatgacattcttatctactctcgaacaaaagaagagcatgaagaacatcttcgccttgtactagagaagctacgagaacatcaactgtatgctaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgtagtttcctaggcctcgcaggttattatcggaggtttatagagaatttttccaagattgctaagcccaggacacgattgcttcagaaagatgtgaagtacaagtggtcagaagaatgtgagcagagttttcaagagttgaagaatcgcttaatatcagctcctattttgattttgcctgatccaaagaagggtttccaagtgtattgcgatgcatccaaacatgggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatcttttcggtactcgtacagaggtatataccgatcacaagagtttaaagtatatctttactcagccggatctgaacatgagacaacggagatggttggaattaattaaggattatgacatgggaattcattatcacccgggaaaggctaatgttgtagcagacgctcttagcaggaaaggctattgcaatgctacggaaggacgacagttgccattggaattatgcaaggaatttgaaagattaaatttgggaattgtccgaagaggtttcgttgcagccttagaagcgaagcccactctaattgatcaagttagagaagcccaaattaatgatcttgatattcaagaaatcaagaagaatatgagaagaggaaaagctatcggtttcatggaggatgagcaaggaactgtatggttgggtgagagaat

SEQ ID NO: 59015 - DNA, 14004 bp, Oryza sativa
  unsure (1)..(14004): unsure at all n locations
cattccactgctcttaagatcctcgaccggtttcgttgctgcaaccgtggaccttgtggaagccgtcggagcagactttgtgggtagtagacgcctggtcttggggttagagtaagcaatcttcgtgtcctccgactgctgcataattccagctgttcgagcggcagcagatgctgctctgcgaagcgttgttggtttttcatggggcatctgctgctgttgctgttggggcagtgattgcttctgttgctgttggggcagtgattgcttcggttgttggggttgtgcttgctgctgtttttgtggatacgattgctgctataacaatatcaaaagaagaattcaacacgaaaaactttagtgaaaacacaaaaaaaaaataacaagtgttaatgacaaacaaaacctacgtgagaaataacagaggatgctgttagagaatgtgttaaggctactaatgccactatgacatatattaccattagcttcgaaggtttttcacatgtcagataggataatcataaattttctacaatttgtcttcaactgaaacaagcctttttacaatatcataacaatttctgggcaagcgatctagcagtacttgtcagataattactaggcaagtaaagatagcagcaatggggcagaatgtcacaggagtacaggaaaactggggaaattttctgatgtttcgatttgacaagataactacgaagcgagaagtactgccagaaaacaatcagcaatttctatacactatcaaactaacagttaattcccagtttcctcattcatttctcattgttaaatattttaactaaatgatctcatgcctttcgtgtttgctcaagtcagtcctaagtgtctcaaacttacataaggaagtgtaataaataggaaaagatatattactgctgatgagtgatcaacactaatcccacctaaatcttgtgttgagcagattattttctgaaggaagaaagaaaccaccctacagattaggaagttggaaacaaaatacaatatgttttactcaaaaacagtacatgctccttggtgggaaccaatctggtacaatttgtaaaattttcctatcattatgcaatttgtgtaaagtatttaatgaattggaagttggagcattttcaaccaacaaattaaactaaaaattaagtggcatgtccaacagagtacagatatgccaacttgaactgatattttaattattgttgatcttgaaggttattagtgtggtaacaactacatattagtttcaacatcacaaacgaccttcagaggagctaacagctacattagtagtctgctgatcttacattattaatataactaggaaggtaatccacgcgattgcgcgggcatatctttgtttctggtgtttgaatctcctgaagatgaagattaagtgtttcacgcaaaacaaggtggtaataacgtgtgattaattgagttttaattattacaaacttgaaaaatggattaatctgatattttagaacaactttcatatagaaagttttcgtacgaaatgcaccgtttagcagtttgaaaagcgtgccattttaatccaaaagtttatcctcaaatttcataggaaacgaacagggcaatgttaaaatcttttatgatgactgaaaatttctttatatctatatgtaaagttcccgtaaaatgttcaatacaaatagttagttggtcttggtacagttagttggtcttggtacttcaaaatttgattgtaggtaaagaattggatccttggttacacatataaacttagagtaataaaactttaactgagatcttcagataatacggaactgattattctttgaatttctctatttcctttaatgactcaagaggattttatcatgatttatagtagtgccaaattaatcattgacaaattttattgcagctatgataaatttaactaaatgtgttggcacttatcaatatgaagtttagaagttcctgtggtggatatccataggttggttaatcttcagcatgtgactccctagcccgttagcagcctatagaagaggtgaagttgaggtccatatatgctagaagatgttgtaattggtggtttaatacctccttagaattttaggtggatgaaggtctgatttaaatataatacctatgggttaactattttacacgaaaatgagaataaaagtataagtctatgcatatgtatgcccaatccatgaaggacttatgctgatgcaaattttggagctagtgtattacatggtcttattcttgttttcatactcaaatgatatttcgtaatattatttactatactatttagaatactgacattgtaataaatatacagtgcatcattaaggttttcgttagtatcgatctccaaacataacatgaagaagctttttaagtatattttcatcaaatactaccgtagcaaaatctcattaagtgctacatctagtaaactattttgaatatgattgtctacttgcactactcataaatagtataacaatacttcggaataagtagcacccaccttgcaaattggacggtattcacccaacggtttgaaccgttcactctatctatctcctttcaatgcttaaaatttaatattaaaattgaagatagaaatacctacttgagttattccttagtattattttttccagattaaggggcattaattgaatgttttgatatgtagcatctttattgcaaagatttactatgtttttgaattgtacatattcaagctgatgtgacataaataataatgtatagataagggagttcaaggaaggtttagtcatcacaaattaattgttatggtcttcgatcgcttgttgctttgtctttatttttattttttttggaccaggcttgctgctttgtcttggtggctgttgtgacccccactatgttcttttagtgatgcaatggatggctgccaaccttgtggaactgaaggctggtcattctttctacaaccctatgcaccttgtaacgggtcactataacctcatacggcaccttaaacgtcttgctattagataccacacgtggatgtttttttctattacataatgtttgtacaaatatacagagcaatttaaatattgtctcgctttaatttgattagttttgacttttgttaatttaatgcctttatcccaaacatagttgaaggaactgctaaatattgtctttcgtgacattatcttgctttaatttgattagttttgacttttgttaatttaatgcctttatcgcaaacatagttgaaggtgctgttaaatatcgtctttcgtgacattatcttgctaagagtttaggattgaagcaagttattatggaacatctttggttcattctattttcgagtattacaatcatctcaaacatacaaccacaataacaatgtaaacttctatttctcatggaacttaacacaaagttggagtagttgcacagaaagtttggagtactacggcatgacacttatctacgaaactatgatagcaggacacctgcaactcaggtattagcaggcaaaagagattgtgcataaatatgaattgtgaaccaaacgtaggagtgttcaaaaggcattgattgatgaatgctgttccattatcattcaacaaactagaagataaaacattctgcttgcaaacctgtgttgagcgcgaccttgatgaatgagctggtgactgtgcagaagcatacttcaaaatgttaaagaatgtagtctggccaataattgcaaccttctgccagtaaaccacaagcatgtccccagctcttactctcaaatcaagaatactgcagtcgatatcattctcatactgtgaaatgtatggcctaaagaaagtctcatagacataggaggttccctatcataagcacacgcattattcttgaaggcaatcatatattcagtacaagaaaaacatcattattaaagtaaagtacctttgtccttgggcaccataagtatataaagaacatcagctttgcttctgagtacagtggtagccttcaataaaaccagaatcaattaagcattcaaaacagtttgtaatcaacgactgaggaacaaagatctcagaaaaaactaaccatgatattgcaaaatcaccaaatcgttccaaaaccgtcagtagcgcgactaatatcctggacacaaacaacaattcaagtggcacttgcagtgtatggatgtgggcaaaccatgaatccacaagaataaaaatagctccttaccaatattgacaccagaaaataagcttctcaatctcgggcttgttcagctctacggttttatagcattcataagcaggataagcataaccaaaggccaacctgcatcataatcatcccatcagaaccagagtacatcgttttttctacattatgcagttccaaccaaagaaaccaatgtcctcataatccgaatgttatgaagatgcaacgatatagattccactttttcttttggtgcataaaaaaagataggcacagattttagggccgtgtttgaacaactgaactgaatcaagacaggagcaatcgcaagcgcaaatcgcaggaaacttaaaaccatgggcaaacaacagattcctttcagtaacatcgtaagagtatcttttaatactatcacagattcactacacagttttagtgtaccattaatcttcagcggaataaccattgaccttaaacactcaaaacaacaatgactatcctcctccaaagaacggacgaccacagatgtacagattttcacagtgtttgagtggtgtcgatgctattccaaaggaagaagatgccagacaaatcgacgcacacgcattccaaaaaaggcgaaaaatataaacacaaaagatgaaaaaaaaaagaaatcggttcttgaatccatccccacggtcaaacccacaaaaatcgtgaagaaacaccgggagatttcgtcagattggggggacttacagtaggaccctgnnnnnnnnnnnnnnnnnnnnnnnnnnccgatctttctgcacaagaacagatccagtgagatgctgctactccgaaacaaccaagaactgtgtagggcggagcaaggagatgtacagatggaagcgtggatggaagaaggttggtgacggggctgatagatccggaagggatgcaagaaatggggaggaactggaggagtgaagatcccctcgctcaccctctctctccctccagtagtccactcccgtctgactgcgaggagtgaagacggcgacagagctcttcaaactccaccaaacccaacgggcaacacttcactagtgtctctctctctctctcacctctttttctactcggccgtacatgcctcctgttctcagatggataatcatgctgtactccccaactaaatggtgtgttcctttttaaaaaatcactaatctctcttactcaaaatgagggctgatttggtttaaagccaaaactgccatacaaaaatattggtattttaaacagtaattttggcaatgtttggtctactaccaatacttgtcaataccacacaaatgttaccaaaatattggcattggcaaaaatttactcatgatttggcattggcatagttacaaaccaaacaagccctaagttaacataaaatatactaagttgatttattttggaatgaagaaaatagatgaaaccttattcattgttgcatgataattatatatgggttgtaaaattttcttttgtattcctatatatttttctatgcgctttttatatatggtacttgatcgattatctaaatattataaatggtttggaggtatagcgtagccttttttttataagagagtcgatatgcatttttttgatgaattatttaaaggctaaaaccaattaaaatgatatagcatcatgatagaaaaataattaacattaactattaactatatttagtgcagatgaaatttatagatattagatagatagaatttgtacacaagttttcttaaaaggaattgagtaactttatttttttatagtttgtaataatttatacttaattactatcaagtgtccaaacgaactcacccttagtccaaacaagtgtatatttcttttttaaaaaaatctatatagagatatcttagaaaagtttttaaaatctatttttttaactttcttatatttgatttatcctattttgctctagaagagttatcataaaatgaaaaaagctattctctctttctgtaaatataagcacttttggaatagagctcaaacttttaaagtttggctgcaaatagaaaaaaaatcataaaaattgatgatgtgagaattatgtttatcttcataaaaatcttaattcctgtttaacttatgaggttttctgtctttttactcagtatttacttttggaccactaagactaagactagaactaaaagcttcgcactaaattactattattgattatatcagtttcgatttataagccgcacggccgcggctgaaatgtggagattatgggtaccccatatccacacggcatggttatccgactagtaataggggataacatatatgtatggaatatgtaacagatcgtgacttgggtattacgtttccttgtatattacggaacggcctaaagtcctggtttgataatattgtaaaatagatttaggaaaccgatgccgtattggttaaggtttctatcttgtaatcctgccccccaccctatataaggtgggcaggagaccctctagggggcatgagacaacctgatcgtcagatctatactacacccggtggattcaaatccccaaacaggagtagggtattacctctcattgagagggcctgaacctgtctaaatcctgtgtctccacatccatccacttttaggtctcgtgcgctaccccgttttattattgccgaattcatgtttcgacagttggcgcgccaggtaggggtgcgtcgagttcctcgtcgacgagtgcgatggaaccaatcttcaaatcaccgggttggtcgttccaatctactgctgttagattattttttgcgacaaattgattcgctttattgtctttttacatgcatgtaccggtgcctgatgcttttgccgatccaacgaacggcgctatcatctgctctgcgcctatgtgattctcgcgtcggcctcgtgatccatccactttaagatgcatcttgtgtccatgcatgcctgggatcgatcagcagaaaagcgggcatacgtgcattgctatatgcatctaatcttcctgctacatgctaattagattgattttggattatagattattaatcttaattttgctggttatttttgcctgcatgtctgcaccggttgacgaggactgacgaggacctatgtgtttccgcctgcacggctggcctttatgccgccgttgttgggcgtctatgacttcaccgccggcctgcctccgtcgccgccgactggtgcctccgcctacacggctggcctattatgccgccgctgttgggcgtctacgacttcaccgccggcctgcctccgtcgccgccgactggagtccccgcctatacggttggttggtcacaccaccgttcatgggcgtccacgtcttcaccgccggcctgcctccgtcgccgccgattggtgcctccgcctacacggctggcctattatgccgccgctgttgggcgtctatgacttcaccgccggcctgcctccgttgccgccgactggtgcctccgcctacacggctggcctattatgccgccgctgttgggcgtctatgacttcaccgccggcctgcctccgtcgccgccgactggtgcctccgcctacacggctggcctattatgccgccgctgttgggcgtctatgacttcaccgccggcctgcctccgtcgccgccgactggtgcctccgcctacacggctggcctattatgccgccgctgttgggcgtctatgacttcaccgccggcctgcctccgtcgccgccgactggtgcctccgcctacacggctagcctattatgccgctgctgttgggcgtctacgacttcaccgccggcttgcctccgttgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataatcgcaaaagtacccgagtagtaaattttgatccgtgaaactttgttctattaatggtgaactcatgtcactcatatgcatgtttgggaagtgcttaggccgactcccagtgcttggtggctatgactagtcgggcagagtgtttaaacgtaatgagtcatctgctcggggaaatcaaaattaacaagaggagaaatatatatttataaatattttaaaatacttgatttttttctcgagtattatatttatatcagatactactcatcctatatgtttgttctgcaggatccagatccagatatgcacaaaagggattcatggctttaagcttatctcttacgctctaggaatggatcagtcagaacatcaccgaccggccgcctcgtccgccgccgactggtgtttccgcctgcacggctggcctattatgccgccgttgttgggcgtctacgtcttcaccgaccggccgcctcgtccgccgccgactggtgtttccacctgcacggctggcctttatgccgccgttgttgggcgtctacgtcttcaccgaccggcttgccttcgccgctgccgactggtgtttccgcctgcacggctggcctttatgccgccgttgtcgggcgcctacgtcttcaccgaccggcttgccttcgccgccgccgactggtgtttccgcctgcacggctggcctttatgccgccgttgttgggcgtctacgtcttcaccgaccggcttgccttcgccgctgccaactggtgtttccgcctgcacggctggcctttatgccgccgttgttgggcgtctacgtcttcaccgaccggccgcctcgttcgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgttcgccgccgactggtgtttccgcctgcacggctggcctttatgccgccgttgttgggcgtctacgtcttcggccccggcaaacccgaccggccggccgactggtgtttccgcctgcacggctagcctttatgccgccgttgttgggcgtctacgtcttcaccgaccggcttgccttcgccgctgccgactggtgtttccgcctgcacggctggcctattatgacgccaactgatgctatcttcttcacggctggctacatcaccgtcaccgctaataggcatcatcatcttcaacgcaagctgtctacgtctactgctgactagtgccctcacctctacgtctggtttatacagctaccactactgatggacatcatcgtctaccgtcgccgactggttatgccgccgtctactgcaatgcaactttgtcatcatggtggagcgacttcatctttattatcttcggcaccggcaaacccgtttgctgctacttcgcaagtttttctacttcatcaaccatgacgtctcggcatctcggcatgcgatgccgtgttattttactacaacaagtggctctccaatattcagtatttctacttggacatcttcaacgcatatcttcaatcaagcaatgactattcaacgacaagaagctacagtgctcgactctatgttcagttgtttcccaactaaccaaagagtcgggggctacacaaatataagactcttaaaatttgacaaattttatgtcaagctgaagaaattaattcatcaactcacaagtcaactccaggagtcattatcctcgtctttgctttagagcagagttatcaaccaatcagctcagtttcgacgagttggacaacatcatctactttcctccaagtgaagcatctgcaacagctataacaacaatttgatggattattgtcactaacatcatcaccagcacctctgcttcatcggccctaacatcagctctgttgctaatggatgactacgtcttcgccgacttattatttcactttcatggttgctattgactggatcaccgacatcgttatcttcatcaacatcctgtcaagcctcttcaacatagcccactctattgctattgatgggcaacttcgtcattatatttgatcatctatgattgctgcttatcatcattacagtcggttgcgtttgtcgtcgccgactattttcttcatcttcatgattggtggatttcgtcattgtctttgatgcatgtctacatcttcaccgtcggcttgctttcgtcaccaccgactggtatcctcgccttcatggatggcttattatgtcgccactaatgggcatcttcatcttcttcacctgctgcatcgcctgtcaccgactgattatttcgctgccatagctacacaactttatcactgagcgccttcatattcattgctggctgatctgattgctgccgactggtttcttcgcctccatggctgtgcaacttcatcacttctgattggtatcactatcttcactatcaccaatatttttgccacctctgctgggcaatattatctctgtattggtcgtcttgtctctatgccaactgcgtcagctaccatcaatgaacaattgtgactacgtgctcaggggcttactagctcaaatacaagtattatatcttcaatttggacttgctctggatacatgcaacatgaattcatgatcatgggtctattttatatgctcaaagactggactatttattattccccgtaagggttatcaactgaatacttgcgccagttgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcgactttttaggagtcggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaaccatgtgtcttttagggacttaagcacatctgttaaagcagtgtgcgcatggcgtatgcccaatactttggaaatttctttattcacagcattcaagcttctttatagttgtcttgctatgtgaactttcaaagatgttgtcaactttaggttgtatgcatcatattttgccaagcagtcggtatatcacttggatcatattattcggggattcacaccgcatatgctatatattgatatcaagtcacttggttgattacaattatcaaaaccactcggttggttagattatttattccttgactatatgtttggttggttcaattaaccacatagtcgggggctgcacctattaggtgcatctattcgatgtacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttccttgtatattacggaacggcctaaagtcctggtttgataatattgtaaaatagatttaggaaaccgatgccgtattggttaaggtttctatcttgtaatcctgccccccaccctatataaggtgggcaggaggccctctagggggcatgagacaacctgatcgtcagatctatactacacccggtggattcaaatccccaaacaggagtagggtattacctctcattgagagggcctgaacctgtctaaatcctgtgtctccacatccatccacttttaggtctcgtgcgctaccccgttttattattgccgaattcatgtttcgacatgaaaaatgccttccaatcacgtcccatccaaacttttgcatttcatactgttcctgttttgcgttttgccaaatcctttgcataaatgtaataaatgcctattactttagttgaccgtcgatcatcgatatttaaccgttaattctctgcaatgactttctttaaatttatagcacaaagaaaagagcttcctcactaaagaataattcacaattatgcaaaaatattagggtgggccaaaatatacgaattcactaaatttttaatttcccttgaatttgaaaagaaaatgaatcgagtaaattccataaaactagaaacatactaagaaaactatcagaaagccatatttttttaaaacgttataattagtagtgaaaaaactactactccctccgtaataatatgcagctctctttatttaaaacatcatacttttatagatattgttggttaaagtagcattttaaaaaccgtgtcaaggtctaaaaatgtttatattttatgacggaggaagtacataattagttgtgaagttatcacatagaagagaaaatttgattggtagcgcagatcttatcttagtgaaaaaaaaatagcacaacaatcatgctcctccggctaaaggcatgttacaaacaaggatctgaacaccaaaagatattaaaaaaaataaaaagaagtcctcaagtcaactccttcctccttcccaaggacccaatcccgtcaccatggcgaaaagaagcagtggagagacatacatagtgaagagaatccattacatgccactgactttgtcacacgtctatgatttaccactgattttatcacattctaagatataccatcgacttttgcttaac

SEQ ID NO: 59016 - DNA, 1431 bp, Oryza sativa
atggctcaaataatggagaaggaaaagggaaaagacaatgagaaaacactcgtggaggaagaaataactgggggcaatctggaagaggccgaggacaatggtggaattctggcagaggtagaggatgatggttgaataatgatagaagcggaggaaaagagtatcagcctaatcatagcaagttttgtcaagcacatggtctaggtggtcattctacggaagaatgctatagcaagttttgccaaatccatggtctaggaggccattccactgaagaatgtaggcacatggcttacttagtggaaaagcatgtcggtcgatatgagaacaagcattagggggcttgagatcagcgagggaaaaatgccatagaagcaccacaagtcatgaaaatagaagaaattgaagaagctccaaaaagagtgataaatgccataacaggaggctcttctttgggaattgagtcaaaaagacaaagaaaagcatatgtgagacaagtaaatcatgtagggacaagctatcagtcaaatccaccagttcattcgaagacagtaatttcctttgggcctgaagatgcggaaggaatacttttcccccaccaggaccctttggtgatctcagtggaaatagtacaatgcgaagttcaaagagtcttggttgatggaggaagctcagcggatgtgctattctacgatgctttcaaaaagatgcaaatacccgaagacagattgacaaatgcaggagtgcctctacaaggttttggcggacaacaagtacatgcaattgggaaaatacctttgcaagtggtttttggaaaaggcaacaatgcaagaaaagagaaaatagtgtttgatgtggtaggtacgccgtatcagtataatgcaatactcggaagatcagcaattaatatcttcgaggcaataatacatcacaattatatatgtatgaaacttcctggaccacgaggagtgataacagtccgaggtggccagttggcggcgagaaagtttgagcttcagggaacgccaaatgtcaaaggagtccatgccgttgatcaaaaacatggagaatactttaagttgcaggaaccagttcctgaagggaaaagtaggaaagtatagttagatgatgatgatcctagaaaatacattttgctaggagagaatctggaaaagcatgttgaggaggaaatcttgaaagtagtgaaaagcaatatggatgtctttgctggtcaccagaagaactagaagggggtagatagaagcctgatcgaacataacttggcaatcaagcaaggctgcaagccaaaaaagcaaaagttaagaagaatgtcaacagacaggcagcaagcagcaaaagtggagctcgagaagttgctcaaagcaaaagttataagagaggtgatgcatcgtgaatggttggctaatccag

SEQ ID NO: 59017 - DNA, 593 bp, Oryza sativa
aaaagggggacctgacctggtgcttttccttggggttgacgggggcgaggacgacggctctgtcgcggacggtgaggcagtagttctcgttggcgcggcagaagatcttgaagatctggttcgggtccgacggcgccgccggtgcctggttgtggtggtgcccgaacccaaacatcttcgacccttaattcgatcggtgcaactcgcgactcgcgagagaaatgtttttgtgctgcgactgcgagcgatgatgcgaggaggagcgagaggtgccacgttttatagaaggccaaggccggccactctcaccctcacccactgatcgatcggctcggctcgatgacgcgctctcctgtgccaactcccacgttcgctgacagctgggcccaccggtggtcctcgactggctcaaacgcgtgacatgcgtgcgtgtatgttttgcattctagccgtttgatttgaatatttgatatgatatgatatatctttggtgtttaatgtactctcagattcggttccatgaacttgacttggatgctagtaccagtaattcattgtgctgagatttgcattactaaatgtgcgagtaaatg

SEQ ID NO: 59018 - DNA, 7970 bp, Oryza sativa
  unsure (1)..(7970): unsure at all n locations
atctcttacgctccaccggctcgccttgaccgccgccgactggtgtttccgcctgcacggctggcctattatgccgccgttgttgggcgtctacgtcttcaccgaccggcttgccttcgtcgccgccgactggtgtttccgcctgcacggctggcctattatgccgccgttgttgggcgtctacgtcttcaccgaccggcttgcattcgccgccgccgactggtgtttccgcctgcacggctggcctttatgccgccgttgttgggcgtctacgtcttcaccgaccggcttgccttcgccgctgccgactggtgtttccgcctgcacggctggcctttatgccaccgttgttgggcgtctacgtcttcaccgaccggccgcctcgtccgccgccgactggtgcttccgcctgcacggttgacttattatgccgccgttgttgggcgtctacgtcttcaccgaccggccgcctcgaccgccgccgactggtgtttccgcctgcacggctggcctattatgccgccgttgttgggcgtttacgtcttcaccgccggcctgcctccgtcgccgccgattggtgcctccgcctacacggctggcctattatgccgccgctattgggcgtctacgacttcaccgccggcttgcctccgtcgccgccgagtggtgcctccgcctacacggctggcctattatgccgccgctgttgggcgtctacgacttcaccgccggcctgcctccgtcgccgccgactggtgtcttcgcctatatggttggttggtcacaccaccgttgttgggcgtctacgtcttcaccgccggcctgcctctgtcgccgctgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgtcgccgactggtgtcttcgcctatatggttggttggtcacaccaccgttgttgggcgtctacgtcttcaccgtcggcctgcctccgtcgccgccgattggtgcctccgcctacacggctggcctatgatgccgccgctgttaggcgtctacgacttcactgccggcttgcctccgtcgccgccgagtggtgcctccgcctacacggctggcctattatgccgccgctgttgggcgtctatgacttcaccgccggcctgcctccgtcgccgccgactggtgtcctcgcctatacggttggttggtcacaccaccgttcatgggcgtccacgtcttcgccgaccggctggccttcgccgccgccgactggtgtttctgcctacacggctggcctattatgccgccgttgttgggcatctacatcttcatcgccggtcgtctcatctgctgctgactagtgcccttacctctacgtctggtttatacagctaccactactgatggacatcatcgtcttccgccgccgactggtgcttttatcttcaccgccgctgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgttttccaactaatcaaagagtcgggggctacacaaatataaggctcaaaatttgacaaattttatgtcaagctgaagaaatcaattcatcaaccaacgagtcaactccaggagtcattatcttcatctttgattcggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcatcaccgactgctctttcgttgttgttgggcgcctacatcttcactgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagcaattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagttgggattcaattattatatttattttggagtatcccataagggataatcattcagatcagaagctattcatatgagctacacttggtctatattacccggaagatttattactcgggagcatgttacatgcgtcatcctttaaagggtgtcgaatgcatattttttggcctaggcctaatatgtctgcaacccatattttcaggtatggcctgtcacgttcttttagggacttaggcactttttgcttatgccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctaattatatattgtggtcattttctaggcggttggtaaatcctttatgagtttatttactcggattttacaccacatatgccatatatttccaggtgtggtgaaaccatgtgtcttttagggactaaagcacgtctgttaaagcagtatgcgcatggcgtatgcccaatactttggaaatttatttattcacaacatacaagcttctttatagctgttttgctatgtgaattttcaataatgtagccaactttaggttacactcatcatattttacaaagcagtcggtatatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtacttgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctacataaggagggcagggagcccctctaggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctacccctttttattattgccgaaatcatgtttcgacaccaatgaaagccaccaagaatgcgaaaggtggttggggttgtgggattgaacacaaaaatagctttagcttaatgaagttgtttggaactttgtgcattttatcttgtgaagttatatggaactttggcttaataacttctgttctttttttttatggtaatgatttttaatctggaagaaggataaatgcattttatctttgctaatctacctaaaaaatatgggttaaaaagtgcatgtatttgttgtcgtgcgcggcgtgtcgccgcgcatacccttctagtaaactaagaatggattcgctagaattgtgtcgccatgttctccagcggattacagtccgattttcgtttggacagattgtttttagagttaattggatccatgccattgcaaatatgccaaattaagaaaatgccactactattcgtgagcactcttgagtgccactgcaattctgggaaattgaattcatgccactcctttgtgttttccatccactccctattgacgccgtctctcagcggcgcctcttcgcgttttcacgtgcatggacgcgccgccgccgccgccactccactccatcgacgacgccgacagcggaagccacctcacaggcgtcgactcggcgaccatcgtgctgtcggggcgcgcagcgaggaagccgaggcagccaaggaggaggcggcagagtgggccgcggctgcgccgccgcctccggccggcggcgtcggcgtccctagctgaggacgcgcgcgacgaggtccttgcggcagtggatgaccggcggggcgacgaggagcagccacgtcgctcccctgcagcgtcctcaaccgccgtcatggcataggggccgctccgcacgggattccagtcgacactcacacctgtgccgccaccaaaaccctaagccgctgctgccgctcgcgcctgcgttgccacctgaacccggagctccggctgaggatgcgtgcgacgtggtccttgcggcggtggcggcgacgggctgggttgcgtgacgttgtcatcctcgtcctcctcacctctggatcttcgcacacggaggcggcggctagaaggacaagctatggcgctgcacgctgcagccgctgggtgactacgtcttcggcaagcgcagtgtctgggaggacggtgtcgtcctcttcatggtctccaagccacgctgctcgccctcgccctcgccctcgcatggctgaggggcttccagctccgctcgtcacggatcggcgccgcgaacgtgcggtcggagcgagacggcgtcagcaccgagttggaggccgctgtgctcgaccagccccggtgtcggcttctctttctgtaccttcctcgttggcgccaccccgctgcccttttatagccaccgaccaccacctcaccgagcctgacggcggcggcggcttccacgcacaggaacagggaagttggcaccgtggacggggagtggatggaaaatgtgatgaagtagcatgcatccaatttcttaaaatttcagtggcatccagccgatatcccgaatagtagtggcatttttctaatttggcatatttgcagtggcatggatcgaattaacccttgtttttaagattcatgctatattgtgtgggtgcatgactgcgtggtttaaaagtgcgtttgctgcctatcagctttcaatgagtgattaaaatagggtcttttagataaaaaaaacgttaaatataattatagtacaaatctagtgtaattagagcaactccagcagggcccttaaactattttaggggctggataggaaaaaacgaggtccatcagggcctctactccagcccctagaatgggtggcggggggaggggggggctatgggctcttctctcgtccccaaacactgttcacacagggtccacgcctccaacgacctcccttctcgcagcgcctgttcacgcgtgcacggtgccgccgctcaccctcctccacctccagctgtgcttggcgccgccaccaccggccagatccatcgccgccagactcgggtactgccccgccgcctccaccgctcttcccgcgtaggtggcaacaagtgccctcgccccgctgcctgccaaccggatctgagccgccctccctctacctcatctagcgcggtggcggtagtggcttagcagctcgcactcgaggaggcagcagcggctctggcgtcctgcacggaggaggcaacagcggcttcagcatcccttgcggaggcggtggcagcccgcgggtgaggaggcgacgggggcccatgcgatgggggtggtaggggccacgcatgaggaggtggcagcagtggagaggaggaagacgaggaggaaggaggcagcggtggaggcgaggggtggagtttttattttaggaatttttttcttgaagaaaattttagagaaaaagtaggggttgttaaataggggctattgctggagtaggaggctgaatttgggtgctctgacatggtgcttgcccccaaaaggtatatgtaaggtagtgtaattatatagataagtaagactaaaattgtaaatacacaaaaaatatttgggtgtaatttagggagttaaatgtgtaattttggaacttatattgtaaacacactaaaattacatatatgtaatataggcattgtaaaaatacatggtgaggctgtgtttagttccacgccaaaattgaaagtttgaagaaattttaacgatgtgacggaaaagttggaagtttgtgtgtgtagaaaagttttatgtgatgaaaaatttgaaaatttgaaaaaaaaattggaatctaaacagggcctaactactttttcactaaaaatatagcatgatatttataggcagtcccaactaagaatccatgtgtcgatccacgagatcctatggacgtgatatttcacgatactcccacgcacgatccgcgcgaagcctttttcgtggaaaaattgcctccccctttccttcgcccgttccttcggacggcgtcctccgcagagcatatctcgccgagtcgccgaccccctcctgaccgccgcgctcccaccccgcctccaccgctgacaagctcctgctccctgcgcttcgcatcgccgccgttgcgtgctcctgctcctctccgtttttaataccgtcgcctctgctgctgctgctcaacaccatgcaatcatcgtcacatatttaaggtcctcattcttgaatcaacaccaggcagcaaacatatgatcaaaacatcagtataggttgactagtaggcatgtaatgccagcgctccatcggtcttagtggagagaaagatactttgtcccaaaataagtaaccttccaatttatcgtgctaacatcgtgaatagaagcatacaacccattcaccattcaaatgaaggagtctagtgtgacctggtaaaaaaaaaacaatgggatgtcaacatatacgttggccctatattaacccaccaattagtggattgattaactcaacaattgtatgcaaatcaccacccgtttctatctgcagtatggttaatgatgnnctgcttgcngtcgaagnagtcgtatcaacaagccgtg

SEQ ID NO: 59019 - DNA, 688 bp, Oryza sativa
cccacatccacaccacccaccctgccaccccggccttttggttgttgcgttcccgtcacccccttttttcttgccttcgcgtgttgaccaagcagcgcccccctccccctccgcccaacaagaatcgcctcagcaccatcgcgttgtgctcgcgcctcctcctcgcaccacaccgccattgtatagcctacctccgactcccctccagtcctctactcagacctcctttcttgctcatgctggcagtggcgcctcgactccaacgatggcgacatacagctggcctcccctcaacctctctgtccactcctgcacgtaccggcggctactcctcgactccaacaaagacgatacatcaagccgtcatccccttccctctagcagttttcttgatttgggcacaaggtggagatggcggcggagcaggagggcacatgcaatagtcggtggttggttgaggggctatcgacgaagattgcaacctggcctccccagcccccatccactctgatttttttattttggataattttcttgtgattttcttaatttatctcctgattattttaatcatgatcaagatcgagaccaaattgggtggtcttgataaatttctactactgcccagtctcttttcaataaccgaactaaccgaaaaaagacaggatatcaagatatcaagatcaaa

SEQ ID NO: 59020 - DNA, 735 bp, Oryza sativa
atgatgagaagtacctacgtacttcggccagtttgtcttgcattcgtggagcggatctatagtataaggaccgatgactctcaataaaatccagtggcggagccagaaattatataacactggtagagaaaggggctttactcccggttagaaacccccctatagtcccggttatacaaccgggagtacgaatccgggactaaagatacccatctttagtcccgggtgaaataaccgggactaaaaatccatctttattcccggttggtattaccacccgggactaaaaatggtggagcagtcccggtaaattcttttttttttttggttgttgtttcatggttcaatcgatttgctccctaaatatcccaaatcatccacaagcatcacagatttgggaagaaatacatcacatattgcaaagaaatgcatcacagatcacaaatgcatcacatcaccaaatctcaaacgaaaaatacatcacaaatcctaaaagaaatgcatcacaactcaaatacatcccagatcagatccaatatcacatacattacaaatcaaatccaatgaaacacaaaatcaaaaaaaaaaatcggcagcagatgggagggcgccgccggcctcccggtccccgtcctctcggcgtctgcgccagctcggccgccacgcccgcccgccgccgcggctcctgccgggcgccgctgctaccgcccggcttgccgccaggcccgcccgccc

SEQ ID NO: 59021 - DNA, 15559 bp, Oryza sativa
aaaactatccgaatagccgtgcccgcggttatgggcgatttgagcaatgtttttcgtgattagtctcacacctctcacaataaatatggatggggatacttgctaataatttgcttagctcctggtttggagttagatttgttcagccgggtatggttgttcaggatggttgggcctgtgcagcatgggtgtgctgttcagtgttgattaaaatttctgattaattactccactgttttatttctcttaaatgttttgctaaatgctgcttttgcaaatgagcctatattatgccatcctttggtatctttgtgcacttgcatatttgctgtgtggcttgttgagtatgtcatatgctcattcttgcaataatcatcaaacctcagttgaagataaaggatccagaaggagaagacgtttggcttataccccagctgagctgcctgtgggagtagagccggagcttcgctagattttatttttccgttgctgttttcttttcttttgtaagtattaacgatattattatgatagatttgtatattaaattgtcagtttgtgtacctcggctgattcctggacgaggattttatgcacaaataagttcggaaattactagtgaattgctgggcgtgacatcctgctaagggcatcggctacaacatttgctttccccgggtgataatggatttccatatcataatctttaatcaactctaaccatcttcgctgacgcatgttcaaatcaggttgagtgaaaatgtacttcaaacttttatgatccgtatatatctctgtacggttaccgaaaagataatgacgccaaatcttcaatgcatgcaccacagctgccaattccaggtcatgcgttgggtagttattctcatgaggacgtaattgcctagatgcataggcaaccacctttccttcttgcatcaacacacaacccaaaccgagtcgggatgcatcacaatacacttggaaacctttcctcgtatcaggcaaaattaatacaggcgcagtcactagccttttcttcagttcttggaaacttcgttcacaatcctccgtccacttatacttcacttccttctgaagcagacgagtcattggtctggcgatctttgaaaagttctcaataaacctgcggtaataccctgcaagtccaaggaaactacgaatttctgaaaccgtcttgggttgcttccaacttaatactgactccacattgcttggatctactgccactcctccagacgagatgacatgaccaagaaactttacttcggacaaccaaaattcacatttactgaacttggcataaagctgatgctcacgtagtttctctaaagctagacgaagatgctcttcatgttcttccttcgtcttggagtaaataagaatgtcatcaataaacactacgacaaacttatccaaatattccataaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccagaatggagatctatcttggagaaaactgtagcaccttcgagttgatcaaacaggtcatcaattctgggtagaggatatttattcttgatagtaacctcattcaacgctcgataatccacacacattctttgagtatgatctttcttctccacaaagatgactggtgctccccacggcgaagtactgggtctgatgtatcctttctgaagcaaatcatccacctgtttcttcacctcagctaactcgttagctgccattctgtatggtctcttatggatggggttggttccaggtaccaagtctatccgaaactctatgtctctcttaggtggcatacctggcaaatcctcgggaaacacgtctgggtagtcttgcactataggaatctcttgtagagcaacttggtttaagaccacaccatgagatttaggagaggatgcaaagaaagaaactgtttccccattgctattggttaaagtcaccttacgattggcgcaatctataactcctctgtgacgagataaccaatccatccctaagataacatctaggtctttggattctagcaagataagagaggatgggaaaggaacttcttctatttctatagtaacggaaggacaatactgtgtcgaaaatacctgattgcccggggtattaactagtaaaggtctcccaagactaacaacttccatcccatgtttgcttgcaaaacttttagacaaaaaggaatgtgtagcaccggaatcaaaaagcacagttgcgggtatagagttaacaggaaacgtacccaaaacaacatctggtgcattctgagcttctgctgctgcaacatgattaacacgtgccttcggtgctggaacattggggttgttcgggactggagcgttcttcacacgccgaggcttaggacacttatcagcataatgtcctggatcaccacaattaaagcatatcactggcttgcttccctgttccttcctgacaggctggttctgaactggagttgctgcaggacaagcaaccatattgcggttgtcattgccacgattactagtattgttgttgtagaactggcgttggggacgggcaacagatgaagatcctccttgagggtacgatggagcttgaggtccagtaatgagacgcggcctttggttactgccctgttgtgccttaaattgggcagccctgcgcttcttctgctctatacggttatacttgtcttcctgacgaatcgccttgtccaccaattgttggaaatcccggaaatccgtagccatcaaagcataagacaactcatcatttagtccctctaaaaacttctcctgacgctcttcatcggtgcgaacatcctctggagcatagcgagctaaacggttaaaatcatggaggtactcagtgaccgaacgagatccctggttgagtgctctaaattctctcttctttagagctacaacacctgacggtatatgcgtcttcttaaaagcagctgtgaattcctgccaagtaataggttctcctcccgccctgccttggcgaaaatgatcccaccattcagcagcgggtccatgcaactgatgcgaagcaaaagaaactttctcctgctcagtacactggatcaaatccaacttcttctccaccgcatgcaaccaatctcctgcttctactggattggtggtgcttgaaaaggtagggggtctcacacgtaagaaatctgccagcttattttggggaggtgggggtggattctggttctgattatttgcttgctgattctgtgcctgctgcactaacaggttgatcagttgtgtctgttgagccagaatctgagctagcgtgggttctcctccattgttagtagctccacttccacttccacttccacttccggtgcgcgtgttcaccatctgacgataagcagagacaacaggaaagaatgacagagagacacccttagaacggagttatttaattaatttaaattctatattgctcttaactgtgtatgattacatttaagttgcattaacactatctcaccaactatcttacactctgacaagcaaaagaactagactcatgctgttacatcccaccaatgatgtaagcaacaactaaacccacacactcacaagcaaacttaaacaagcaatctaacacaacgaactatggcaacgttctaactaagcgtctacttccgccttgcgtcggaacgaaacgatgaatcttcttcctctggagtagctggctccctttctttatgatcttcctcttcttcctcatcacttatgatgtcgatgacaggttcagcacgattgggcatagcttcacccatcacgcgaatcttcgaagctaactggagacgaggtggcggacaggttctctttcttgcagtgaggcgaagcttggatattggcggcggcgtttctcctttaagttcagctaattccttctgtagacggtgcaccttgctcttcaacttgcaaatcttgccttgattccagttttccctgtcatgagctgctttgtctcgctccacacttactgcatccatagcactaagcatatgcaccacatgcatcagagtggcactctcttcaccatcaggacaggtataggttccatagtcttgaccatgagccttgtgaggatgatactggaaagctgatgaatccaactcttcttcaaagtgttgtcgcaactctccaatggccaccaaagctacttcttgacaagcatggcagtacgatcttcctccaacttcgaacttaaaggacggaaggtcttcactatcactagccaatgtcacacgaacacgacacttctcctcgtcggggtcatgggaaatttggcgatactcgggagcaacttcatagcctacctcaaaagccatcaacctcaactccctgacgaatcctaacacctcgatcaaatttctcggtgaatggggcggcatctaaagaaacatagaagagaagaattaatgcatatttttctaagttagctgcaccaactagacttaactgatttttgacccaaaaggaagaaaaataaaagaaaagacacatacaaagctattttataaatattttttttagaatttaactttttagacaggggcaaatatattattattttttttaacaaatatttaaaataaagctaagataattatgatctattataagcacggtacaatgtcaccataggaaagataagtagtactagtgctaacatgattaattcgataccataataaatgtacagtgccgactaatcaataaaattttgggtaaagagaaaaagaaacattttgaaaagaacaacctttttcttttaaaagaaaagaaattgaattaaataagttttgtgcataacctcgcatgtgctgccaacttaattaatttgtaagagaatagagaagagcagttctatttttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtctaggaatcaaccgaggcacacaatgacaatattgataatagagtacaaatgaataactatttaatattcgcaaataataaattattacagaggtagatagttcctctcaaagaaaaataacattctacgcagcggaaaaataaaactaaaacaatctacggaacagcgatggcgactccactccacaggcaacttaaccgagaacaagcctaatcctccagatcatcaccttcactgagatactcctcttctgatgaatgaatattgcaagaatgagcatataacatactcaacaagccacacaacaaatatgcaagtgcacaaaataacaaaggatggcacaatatagctcatttgcagaaaacagcatttaataaatatttaagagaatagtaaaacagttgtataattaatcaatattaaataaacaccatacaacatacccatgttgcataggcccaaccacatttgaacaaccaaccccggttgaacaaattaaacctccaaaccaggaattaaccattccaaaccaggaactaaattaattaccacataattaccattaatgagtagtgtgagactaatcacgaaaaacattgctcaactcacccataaccgcgggtacggctattcgaatagattaaaactctgatcagaggtgtaccactgtacccacaagacacaaccccacatcatgtcaccatgtgcctcaataccaccacggtacctcggaaaggagtcgtgacaatacccctcgcataacacaattcaccacagtgcaccgtacctggattataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccaagttttaattatcaattaattatcatcacacgatttaccatcgtgagctaccattgaatataaccctaattaataataataattatgtaatataatttatatttaaccccatttagttagctaatgtttctaagcatggctaagcaaacctacatatagcatttagctgaaccaatccaatatataaggttcatgccaatcaaattataacccataggaaaataaagtcatcttcggccattaaataattgggaaaggttcaccacccgatgacattcaaaaacaatgcatagttgaaaataaaataatagctttaaacgggatcaacatgctcaaagggttgtttgggatctgtgtgacttgccttgggcttccacaaatgcttcggaaccttcctcaatggaaacgctctcctccggaatgtcggaaactaaagcaaataaacaaaatcaataaaacagtacaaaaacaagcataaacagtacatgtggatatttttaacatgtagatcttgattttagaaaaatttagaaacttgaaccacctaaaacggatctacggttatttaattatgattttccgaagttttaatctattagaaaatcgggaaaaagaaaaagaaaaggaaacgatgacgtcagccctggagatgacgtcatgctgacgtcggcacggcggccggctcgggttgaggagctcgccggcgctagagcgatcggccgggcgattggagggcatctacgcgtagagggcaacgaggcgaacccgttggtactcaccactacggcaaacggtgcacgacggcggccggcgacgaggaggaaggcggcggcggttcgggtcgacggcggcgagcgggctccggtggtcggcggcgagagaggaggggcggccgggcttcctctcaccacggcgcacctatcggcggcaacggcgagcggcggcgacggcggagacggcgcggcggcgttgccgaagacggccggcggcggcggcgaacttggagcacgtcgcggcggcgctaggaggcacgggagagctcgggaaagggggcaaacggaagagaagaacaaggagaagctttatatggcattggatcgaagagatcgagctccaaacgggaggaatcgattcgggaagaaatcgaactcggtttttagggataaaacaaaacgaattcgattcggagagaatactcaacggatttctttgtttcttgaggggaaagaaagaggagatcgagaggaacaaaacccctcaatcaattggaagaatccgggtcggatttgggcggaaacggcggcgcaagacggcggctcgggctcggtctcggcgtcggccggaggaaggagaagggcctgacatgtgggccccacatgtcagtgtcccgagagagaggggcgcgggcggcggcggcttgggccggcgtgggccgcgcgcggggagagagagaaagagagagttgggccgaaaacggtccaacggttaaagaaggggttttttaaacttttttgaataaaacaatttgtgaaatgttgtttcaattattaaaaatacttcccttgctcaaataattcccagaaaaatctagaaaatagaggagcaagcatagtatttaataaaattttatctagctcacttttatgttgaaaattttcctagaaaattagggtttagcttgtaggcttttaaaataatttctaaaaattccaattaaacaacaatttatatatttaagatttttagggtgtgacaaacctaccccccttaaacggaatctcgtcctcgagattcagaagaactagcgaatagatgaggatgagctgacttcaattcatcttctcgctcccaggtggcttcttcttctgaatgattactccactgaaccttacagaaccgtataacgcgattcctggttttcctctcgctttcttccaaaattcttactggcttctcaacataagttaaatcttcttgaagctctatacgatcaggatcggcttcctccgtaggtacacgtaaacatttcttcagctgagacacgtggaacacgtcatgtattcccgccattgacggaggcaactctaactgataagctacttcacctcttcgactcacaatcttaaaaggtcccacaaaacgcggtgccaatttccctttggtttgaaaacgatgaacacctcgtaacggcgtaacccgaaggtatacataatctccttcttcgaaagccaaatctctgcgacgattgtcagcatagctcttctgacgtgactgagcaacgcgcaacctttcttggataatcttcactttttcttctgcctgtcgcaatatgtctgtcccgaagacttgacgttcaccggtttgatcccaaaggagcggcgtacgacattttcgaccatataatgcttcatacggagccatttgcaaactagcttgataactattgttatatgagaattctgcgtacggcaaattcttatcccaacttccaccaaaatctagaacacaggctctcaacatatcttctaaaatttggtttactctttccgtctgaccatctgtttgagggtgataagcagtactgaaattcaaacgggtacccaattctaattgtaatttctgccaaaacttcgaagtaaactggctacctctatctgacactatctttttaggaacaccatgcaaacataccactctggccatatataactctgcaagcttatgtcccgtataggttgtcttgacaggtatgaaatgagcgacttttgtcaacctatcaaccactacccaaatagaatcatgtcctgccgacgttctgtgtagaccggttataaaatccattcctatttcttcccacttccactctggaatcttcaacggttgtaacagaccagctggcttccgatgttctgccttgacccgctgacatacatcacacagagccacatattctgctatctcacgtcgcatactggcccaccagaattgttgctttaagtcctgatacatcttagtgtttccagggtgaatcgaatacaaagtttcatgagcttctttcatgatggtatccttcaactccttattatctgggacgcaaattctttctcctaaccatacggttccttgctcatcttctacaaaaccgatggctttacctcttctcatgttcttctttatttcctggatatcaggatcattcacttgagcttctctaatttgatcaaacagagtaggtttagcttccaaagtagccactaaaccttggctgactattcccaagttcaactttcaaattcttggcataactcccaaggtaaacgtctaccttctgacatattacagtaacttttcctgtgtcacaccctgattttcgtcttagggtttataaattatttaataaattaataatagattttatattaaatgttctttaatttacaagtgaagttaaatgtgggaaataaaattttctaaatataaagcatggatggatttaatttttattaaattctccatggttaattatactctctggaattttctcggatttttcggagctcaattattaattttaaaaggttaaaagagaagatcttttttttaatttgctaaatctcaatataaaattgagttagataaaattttattaaatactttacttgttcctctattttctagaattttctgggaattatttgagcaagggaaatatttttaataaatgaaacatcatttcacaaattgttttttttaaaaagttccaaaagccctcccttaagttgttgggccgattttggcccaacattccttctctccctagcggccgagccggcccaaaaccggccgagtcggctcaagccgagccggtcacccctctccctcaagccaccgacaggtgggccccacctgtcgggagcttcttcaagctctagcagccggccggccgaagccatgccgtgcccgagccgccctcttctccactccaaatccgctccgatctctcccaatttcttccgattgattgaggggttttgttcctctcaatctcctctatctttcccctcaagttttggaacaaatcgttgagtatcttgttcgaatcaaactcgttttcgagtttatctccaaaaccgagttttaatcttctcggatcaattcctctcgtttggagttcgatctcttcaatccaagcctatataaagcatcccctcatcctactctttagtttgccccctttcccgtgctctcccgtgctccgtagcgccgccgccacgccgagcaagccgccgccgccgccggccatcgtccagccgtgccgccgcgcctcctcagccgtcgccgccgcttcccctcgccgccgttaggtgcgccaagccgtggggaacctcggcagcctctcccccttcgctgccgaccaccgtagctcaccgtccacgtgcaagccgagccgccgcctttgtccgcctcgtcgccggccgtcatccgtcgtcgttcgtcgcgttggtgagtaccaacgggttcgtctcgtcgtcctctttgcataggtgtgctccaaagtcccggccgaggtcccaatctccggcgagcttgccaaccctagccctagccggccggccttgctttgctgatgtcagcatgacgtcgtgatgacgtcatcggtttttctttttcccgtttttctaatagtttaaatctttggaaaatcatatctaaataaccgtagatccgtttcaggtggttcaagttgctaaatttttctaaaataaagatctatatattaaaattgtccataaattgaattaaatttatttaattctttttaaatgggctttaaatagatttaatcttgtaaaattcataataaattcatttgaagtcagattgaggccgttcaagtctcataattcatttaaaattatgatctacatgtttgtttactttttatgtactgtttatttggtttttattagtctttttcttcgttttgcgtgttagcttgtcgtttccgtcgttacgaaggttcgcgagtgcgtcggaagtgttcaagaagattaattgaagactgattattgcaaggcaagtcacacagatcctaaacacaatcctttgagcatgttgattctatatttaaattctctatttatttcaactgtgcatttattttcgaatgtcaccgggtggtgtgaacctattcctttgttatggccaatttgcattgaatatcctattccttgataccttgggtaataaattgattagcttgaaccttatgtattggtttggttcagctaaatgttatatatatatataattgcttagcaatgcttagaaacattagctcactaatgggatgaatcaaatatactacattattatttatgcttatatttaatggtagctcacgatggttaatcgtgttatgataattaattggtaattaaaacctggttaaggtgggttgtgagcatatggttttgatggttgtgctcatgacaattaaggaccggttcgcgagctactgttgtgaaacattaaccgtaccaaccacaagccagcgtgggcaacggctttatctcttgtatagcatgattcattatagtgtgccagactgtgaagtggcgagaagtccatgggggtcgctggggagtccatgcctctggttgtagagggggtgattatgatccaggaatggtgcactgtggtgagttgtgttatgcagggggtaatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataaatatggatgttaatacttgctaataatttgcttagctcctggtttggagttagatttgttcagccgggtatggttgttcaggatggttgggcctgtgcagcatgggtgtgctgttcagtgttgattaaaatttctgattaattactccactgttttatttctcttaaatgttttgctaaatgctgcttttgcaaatgagcctatattatgccatcctttggtatctttgtgcacttgcatatttgctgtgtggcttgttgagtatgtcatatgctcattcttgcaataatcatcaaacctcagttgaagataaaggatccagaaggagaagacgtttggcttataccccagctgagctgcctgtgggagtggagccggagcttcgctagattttatttttccgttgctgttttcttttcttttgtaagtattaacgatattattatgatagatttgtatattaaattgtcagtttgtgtacctcggctgattcctggacgaggattttatgcacaaataagttcggaaattactagtgaattgctgggcgtgacaagttggtatcagagccatctcgactgtaggataagccaaatggtcaaacctgaaggactatttttccgaaaaaaataatttgtgaaaatttctcctttcttccttatctagaattctttgcaaattgtttcattgtctactctcttccctctttcaacttgagtagttgttaaacttgatggagaaactcgaagacgtcgatgttgtcaacttctgcaagtcaagtggatcgaggaataagaagatgatagtcgaatcaaagtgttcagctgtcaagatagagtgaagtttggaacctagtttagaacctatgccgccaaagtgtctttgaagaatagttagtagggtagaacgctgttgtttgctttgtgtgtaggtatggttgcattcccgtcattgatgtagtccagtgatgagcgtgcaactgtactaggttgtttgtttaatcaacttgaacaatataacgaactacacacatcagatcagtggtaacctagttaaggtcttatctttagtgtaacccctctccttctatcctttctaatctgcaatagatggtgaacactcgcgccagtggaagtggaaacaataacaatgaagagaacccaactcttgctcaagtgctggctcaacagacccaattgatcaacatgttagtgcaacaaatgcagaaccagcaagggaacaacaatgtcaatcctccgccgccgcagaacaagttagctgattttcttcgtgtgaggccacctaccttctctagcactaccaacccagtagaagcaggtgattggctgcacgctgttgagaagaagttggaattgctccagtgcacggatcaggagaaagttgttttcgcttcacatcagttgcaaggatctgcttcagaatggtgggatcatttccgaatgaacagagcagaaggacaaccaatcacttgggcggagttcactgaagcattcaagaagacacacatacctgcaggtgttgttgctttgaagaagcgtgagttccgggcgcttaagcaaaaggatcgtaccgtgacggaatatcttcatgagttcaatcgtctagctcgctatgctccagaagatgtgcgtactgacgaggaaaggcaggagaagtttttggaaggcttaaaggatgagctgtcagttatgttgatctctcatgactacgaggattttcaggagttggttgataaagcaattcgactggaagacaagaagaacaggatggacaatcgtaagagaggaaggattgttttccaggaggcacaggatagtagccagaggcagcgtatcaagccactccaaattggtgaaccttcttccgctagtcaagggcagtcgcaacagttgaacatcgctggtgagatcaactcagagactaatgcaagcaataaagacaatgatgagcaagctactcagtcagtgtcagttcagcaggatcagtctcaagtgaataacagtaatggaagggagcagcgggtgtgtttcaattgttatgagccaggtcacttcgtaaaagagtgtccgaagccgaagcgtcaacagccacaaggccaagtcaacaacattgtcttcacaggagcgaatgcagtgccggttgtgtcttcaagtgttacagctcagcgaccagtttcaaagcagtagtagttttctttaaagccttagaataattatcggagttatggaataagatagactgcagtttacctatgcctttttctttctagccgttccgaatctcgggacgagattctttgtaaggggggtagacttgtcacaccctgattttcgtcttagggtttataaattatttaataaattaataatagattttatattaaatgttctttaatttacaagtgaagttaaatgtgggaaataaaattttctaaatataaagcatggatggatttaatttttattaaattctccatggttaattatactctctggaattttctcggatttttcggagctcaattattaattttaaaaggttaaaagagaagatctttttttttaatttgctaaatctcaatataaaattgagttagataaaattttattaaatactttacttgttcctctattttctagaattttctgggaattatttgagcaagggaaatatttttaataaatgaaacatcatttcacaaattgttttttttaaaaagttccaaaagccctcccttaagttgttgggccgattttggcccaacattccttctctccctagcggccgagccggcccaaaaccggccgagtcggctcaagccgagccggtcacccctctccctcaagccaccgacaggtgggccccacctgtcgggagcttcttcaagctctagcagccggccggccgaagccatgccgtgcccgagccgccctcttctccactccaaatccgctccgatctctcccaatttcttccgattgattgaggggttttgttcctctcaatctcctctatctttcccctcaagttttggaacaaatcgttgagtatcttgttcgaatcaaactcgttttcgagtttatctccaaaaccgagttttaatcttctcggatcaattcctctcgtttggagttcgatctcttcaatccaagcctatataaagcatcccctcatcctactctttagtttgccccctttcccgtgctctcccgtgctccgtagcgccgccgccacgccgagcaagccgccgccgccgccggccatcgtccagccgtgccgtcgcgcctcctcaaccgtcgccggcgctttccctcgccgccgttaggtgcgccaagccgtggggaacctcggcagcctttcccccttcgctgccgaccaccgtagctcaccgtccacgtgcaagccgagccgccggctttgtccgcctcgt

SEQ ID NO: 59022 - DNA, 948 bp, Oryza sativa
tcaagtgacaagcatgacttgccttgctctgctgctggaggaacctcggcgactatttcgaagtacaccggatcgtcttaggaaccggaatctagcgacatacaaggcaaacaatgcaaacaggctaaaagactactgaaacagggaacaaaaccatttttaatggattctacacatttttcttgatttactgagacttgaatgggcttaaacggagctcggatgaattagttatgaattttagaagattcactgtgtttattactataacaaaaatccttaaataatttattgcgcaatattttccagggctgacgtcagcacggagggggtgcggcgccggcaagcggggcccactggtcagcggctcaggggagagcggttcaacgtggaccgggaccacgcgggtggtccaccgccggtccacggaaccgacggcccagatcgccctcggggccgatcggacgggcggcgatagaggcggcccgcgggctcggctcggcatcaaagccgaccggccggccagggctagcggcggcggcacgcgcgcgtcgcgttgccggcgacggcattcggcggcggaggcgacggcgcaaaagcgacgcgaaagcggcggcagcggacggcggcaacgaccgaaggcgacggcgagcgcgatcggtggccacgcacggggaattagggaagaaaaggaaaggggagggagtcctcaccggaggggacggcggcgtccggcgacgaggagcgacggagggaggtcgacacgcggcggacggcgaccgggacgacctaaagaacgaaaagaaagaggttaaagaggaagagagggcccataggagacgggaatgccggcagaaagcggcggacatggcgaccctcaccgtcgcacgatgggaatggcgctccggcgacgaacctcgacgaaggaggggtggacggggtggatct

SEQ ID NO: 59023 - DNA, 710 bp, Oryza sativa
tctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccaccgcagcgcaccttcctagatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaa

SEQ ID NO: 59024 - DNA, 2790 bp, Oryza sativa
tccagcaatatagtacgggagtatatataatactctctccgtattttaatgtatcacgccgttgactttttaacgaacatttgatcattcgtcttattcaaaaaatttatgtaactataatttattttattgtgacttgatttatcatcaaatgttctttaagcacgccataagtatttttatatttgcataaaaattttgaataagacgattggtcaaacgttggttaaaaaatcaacagcgtcatacattaaaatacggagggagtactagagtctatagatagcgttgtgcatgcaggatattaacatttggagtatgatgtttaattgttttaagtacagatatttttttcttaaccaagatagatcgggttattagaacataattttaaaaatgaaggaaaaatcatacataataatctagtttagagtttttgtagacctttttaccaatagtttttttactggttcaactaggttgttttttgtacaatcactcttttatttcgctaccctctttgccggatactagattgaagaagatgaatgcaaaagaatcatgagtgatcaatgtgtgcatcactcgtgtacaccactatttacctctgaaaaaaagcatcaaacctcacacgcccacaatcttgcataatactagttagtagttacaacaagttactgcacacatatgcatagccaagagagaaaatataatatataatatatgatctctatatgcagtgaggtgtgaaggatctaagcaagcctcatcacacagacagaggtagagaaaggaaagaacataaatggagcaagaaaagaagaggaccaccaagccaaagcaacacacacatacagtcacagacacccatcaccacacaagaaaagctcataagcatatactctctccgtattttaatatataatgccattaacttttttaaccaatatttaaccactcatcttatttaaaaaattatataattatcatttattttattttgacttgatttatcatccaatgttctttacgtctgacataaatatttttatatttgtacaaaaattttgaataagacgaacggttagacgttgataaaaaatcaacggtgttattcattaaaatacggagggagtatatgctcatgcttccttcacaaagtatgcactgtgctgaatcaatctacgcatctagctcacctcacaggaaacacaaaagaaaccagatatgtgcgcaccacatcagcaagcacacagatcatcacacacacaaagaaactccagcaatttctttctcacttgctagttgctactaccccccagaaagcacagaagttacaacaagacagttaattaactgaagaacatatatgagtaatagaaaagaaggtgagattgatgcacatcaccatatacatgcctcctctttgtcacaagaaaaggtagcaactaactttctccaattaggacaagataacatatatcacatggattaattcaggtttctagaactgaagagaggaagaggaatgcagtacctgttgttggagtactcgtagaggcggccgcggctggagaagacgatgagggcaacctcggcatcgcagagcatggagagctcatacgccttcttgagtagcccgttgcagcgcttgcagaaggtgacctgacggtccgctgtgtcctcgatgcttgagccctctgagctgccggagccgggggaagcagcaggtgctggttctggcatctaaatttgagtcacaaaaaaattccagagatatggatcagtcctctatgcaacaactcaacagcactgcataagccaacataatcaagaaattgcaagaccggaagatggatctatggcaagaaaatcaagaagtgccatagacatcatggccatcatctctcttaaaaattaatatatgcaactacagctcctttcgtgagttgtataattcttgtagatcaaaagaaaaaaggagagatctttggtcctgtggtgatcaatctctttgatcttgtgccttcctttcacctttttttcttctttttcttgttttgcttaaagagtaaagatctctagctatatctccccgtcttcatggccatctagctattctcacacatcagctagcagccatgattctacttttctactttcccaaagctcccatatgcatacaattaaaaaagaaatccaaaccctcttgcaaaatgacactgaaaaagaggaggaaatttaggagtttccaggccaagaaaagcaattaccatcaggccagtggatggttcagcctcctgctctttgtatatgtgcatgtttgctaaatcctctctataatgaggaagagaggggtgtgttcaaggagaagagaaaggttggggaaggatgagatgaaatggagtggtggtcgctgtggatagagtccatctatatattgcccttgttgtttttcttcctccttaacgtactttcctcctttcccctcttggctggcctacctgcacactgtaaccattaattgcatggggtttaataaattctttgaaggatcgaatagcaaaaactaagccaaccagaggggagtgaatggttatagtacttaaaaaccgaaacttttagcggaattacaagttaccattgtatctgatgtaaatcgatctgaccggtgttcatcacccgatttaaccgctgaaagatcacccctgcctcctgtcgccgccgccgccggtttgaccgccgtgtccccgttggtctgaccagtgcgatgccaccggtctgaccacc

SEQ ID NO: 59025 - DNA, 713 bp, Oryza sativa
  unsure (1)..(713): unsure at all n locations
attttttttctttttgcttttggtaaatgtagccaaaagatcattgatacaggagaatattatatttatcttaacgatcttgcgaactctgtcaaacctatgggctcactggacaataacacatgtgaattggcattaattggtctgtctactgatatcaaggacaattcgaagagaatttttcctgccagaataggagtgagtatataaaatttacaaattaaaatctctttttaatgtactattactatcattgcaacaccttatgtttttttttccacatggtgcagggatatttgttggattcgcagttggacaggaatgagctcaagaaacacttcgatcaaacgagagcgaaccatcttgaccataaagaattagtaagaaaatatatattccagctgtcaatgatatgtaaagttactttttcctgtctgcttgtagaagtaacttaaatgtctttgcaaattaactcagcatgtttgtggaagtaactttttctgttatattgacaggaaattgtattttgaatcactttttattatccttttatacttactaaatcatgattatatttactgaaaaaccttctttccactcccctccctcttttcacttgaatgcaggcattntttcccattctccaagaattgggtaatgggaatgataaggctagtcactatttcgtggtgtgccttaatctgaaagctgaa

SEQ ID NO: 59026 - DNA, 2247 bp, Oryza sativa
  unsure (1)..(2247): unsure at all n locations
tcaattattccgagtacatccttgtcggcaagactgttcccaaggattcggcacccattttttttctccataaatatttttactctcgtgcacaatgagcaattaaaaagttatttgaggaataacaattcaataaagtatgtacataagcatttatcattcaaaccacacactagcatcaatattgcatattggcttaattcaagtatagaatataagtgtcattcatcatctctcataaaagcaatatctaaacctcataaaatatcacgcccgggaaacagagcactagattccatttgtgagagcattatttccttgccctaggaggcaaggtacacataaccaagttgataattaacagagtttacaagtggaagcgtaaacatagtacttttattacatgggcgacaagggcctaacactgcaaagataaacgaaaaagaagaggcgacggccaacacgcgggcaaccacaggcaacggccaacacgcgggcaaccacaggcacttgacgtcaggcatgagctagaagtcgaacccaccatcttcaaggtactcctctgctaaagtgggaaagcagagcaagactgagtacaaccaccgtactcagcaaaccatgccgaaacaatacaaaaataatgctaagggtgtacaaaggatcatataagtatgttggggttaacttgcagcaaatgagcattttatttggcaaacagttggaaagcattttattaaaccacgccctatctctagtcaaattgctaccaagttgcgctacgacgtgaacttgcgtaagccacactatgacgcgaacttgcctaaggggcactacgacgcgacctccttaacccaatcccataggctccaaccatgtgttccaacctaatagacagaaaccactaactttgggtctttgctccgcttgcctataaccgagggcgcggctattcgaatagatttaattctggccagaggtgtaccactttaccccacccaacacgtctcccttacgtgtcgccacgtgccacatgccaccacggcatttgggcggaagctgtcatataacctatcgtccaacgttgccccgaacaaggaataccgacatagacttccacgaccaataaactctgggacaggtggacagattatgcccctaggcgcgactgctaggaacatcaacacaaaacttgggcctcatccatccctatccatgcctttcttgatcaaggccacactaagcgatacactacaccttacccactagacaggtggtcggatggaaaatgctttgcagtcgtgccccgaagtccggtccatatgtcggccgaggtgtgacaagcaaaaccaaacacctcaagcccagccgaaaataggttttgaggtatttcgaagagagagctacttttcacggaagaacaaccgctaaccaacattatcaaatgaggggagaggggagcggcggcgcagcgaggggagagagcagccagcccgggtagataatgggagagggagttcccatgctcaccgaggggaacggaggggcatacggagatgacgatcctgtaggcggcctcgtcggcacaagtggagnnnnnnnnnnnnnnnnnnnngcggtggaggcggcggagcggcgcgatggcgagggatgggcggacgggttcgggaggcgaggaaacagggataaggtggatcggggcttccttttataggctgcagaggaggaggaacggctgaggagcactcgtccggcagccatcaatggcgccagcatgctggcaggcatttactccccaccgaccacgaatcgcagggggtaaatagggagggagaggaagaggagggtgtggggagcattttccctagctccaatggagaggggaatgcagttggcaagcaggccgggcgcgccaaggagggagggaggagacgagccggaggagggaggtggccctgataggtggggcctatccgtcagcggtggtggcgagggcgttggctcggcttgggtagagctaggctagcatgtgagagatgggccggggaggcggcctaggtttgagaaggaggagggggaggtgcttgctaggctgggccgcgaggggaaaggtgggagggagtgggccaaaaacaacccaagggggaggaggggatttaaatcaatttattctttttaacaaagctgacaagggttattgtggcattaataatatttccagtgctcttaaaattcaagtaaaaattggtt

SEQ ID NO: 59027 - DNA, 749 bp, Oryza sativa
ttcctgcagcccagatcgatccccagtagaatgactcctgttcagacttcttcatgtagctccctccccggccagaccagtcaatttgacattattcttggagacaaacagatgaacacaacaatggtatatacagtccagtgtttgtacagtatgacactcaatctaactggcatcctgatttttttttgcaaattttattagcaatgactatggaagtcagagtgacatttttttacgaccaaacaatgctttagattaaacattaaataatatcatgccacagttgttctattgtttcggaaatataatgaacaaactgccactaactctcttttttttttggttgatatccttcaggaaaaaaccccatgttattttgaagatttgagcttagaaatatgtataatttgtcaagaaaaactctagaaaaaacttttactgtggtcaacagttcgtagttattcttccttccaatacacgcaattaactatttttgtgtgctacactacgcacaaatgcagcgtggaggaaactattgagaggtacaagaaagccaacagtgacacctccaataccagtacagttgcagagatcaatgcccaggtatactaacatcatctgaattctcaaaaaaaaaagaaatcatctgtcactaaaaatgcagcatgcagtagttttctatgctgtaattaaccaatgcaacattccttgtaattaaccaatggtttctatgctgtaaaaaatga

SEQ ID NO: 59028 - DNA, 749 bp, Oryza sativa
ttcctgcagccctgcgctagtattagagtagtaattaaaaacttaggtgtggtgtctacgttagagattacctttgttggttgggtatctcacggatttgtcagaggtaggcgacaggtgatgacagccctgaatcccgtcctagtgatcctccatgttcggatacattatagagccatagacggaaccacgctggcagactagcaggagtcggtgcccgaagcaataggtaggaaattaccttcaacttagcgtagataattaaaatatatagaaagtcctctctagccttgctagcctactaacggttgttgtccttggatagtcttagccttaggtagattacacacgttccctgagtttgatatccttttggagtcactcgaaggtgaagtgctacaacgtattccatgctcttgcggatttgtctgtggtcgtaagaaataccaacaatggttggaattgatcaaggattatgatgaacaggaagagtgttgacggtccttaaatcataatatctgaccattaatacctgcatataatgaaataaaatatgatatccaacttagtggtaggggttattactaaccaattctactagtgttggtgaaatatgtatatgcagatatttttaaggagaaaacacacccggcatgcaaggaaacacacctccggccaatcagatgcaagcacatggattggagggcccacaagtcaggtgaaaccgcatggaatgggtcataactgtc

SEQ ID NO: 59029 - DNA, 1127 bp, Oryza sativa
cgaatggaggaggggagtgcgcgcgccgcgtggctccatttcgccgatcagaggaagaccgaagctgtggtgcctgagctgctcgttgatctgaattacctgcgtcgggcctcggcaggcagggagaggaggaactcctcatcgccatctctcagcagtgagcgagtggaggaacacagcggcctcctcttcagctccttgatgctgcgtctaggagtgttgctttgttgcttgtctgaccaaaccgaatggcattctgaagatactgaatgttcagttataagaatgatagattgttctttacacgggcagcagaagcagaccacttgttctgaaaaatggggttgcatgtgttctgtaatttgtatagaaagcagaaaaactctataaattgtttgcaatgagaatgacttgtccaacagaatgatgaaatggccatttgtaacttatcactgcaatgaaattatgttccaattctgggcatatggcttgttcaagagaaccaacggttttttttttccaaaatgcacaaacatatatgcatgacccaacctttccatctgatttccttttgtttgagtacctttctctaacctcgaaacctttctgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggggaaaaaagtaacaaccatagcttacagacctgttttcttccatctcaaatatgtagattttgctggaggcttctttgatgaattccaacagtctaatggaggaggtggaagacaatcaaataatttgctaaaaaaaaggaagagaagaggccagaacttcacctgtgcttgatcaatggttgaatccgtggttcgctgtcccagcatgttgtcagatgatcgcctggggcatggcctcgtttggcgccaaaaaggcgagcgcgaccgccaaaacgcgtttgttcgcagtaaaaaagataggagcgatggcgcctggaccgaggcttgttgggacagccttggcccagactcacgacgcggctgac

SEQ ID NO: 59030 - DNA, 14379 bp, Oryza sativa
acatgtttactttaactccatgtacaagcataaacctaacaacatgtatattagttagttgatgtaaattagcacatgtgttttcactctatggttcatattagttgacaaagattggtagtaacttgatcaattttcagcttcaccaactgcagtaaaccctgtctgtctccatcagaagtacatataaaataatctgtttcctgattctatgagatttgtcggagcgtccatggattagaacggatcacattcaacgaacagcctcttgttgataagaaactgacggttcttggcagggagtaactaattaattaaagaaaacaagaaattttcttcaaagttgcagcatggaaggaaactttatggagaggttggacaatctgatttctctcctgcaggaaattaaacagagcaataatttgtcggaaagtttcaaccaaaatgaggtcaatgatgtgtacattccataagaaaggtctttgccatgtcaacatcgatgacaaatgcatgaacaagtatatatcatgatcagtcccgtgaaggggagagcttcacttttctatctattgcagaaaagatgctgctcaatttgttaatccgtataaggcgataagagcttgacaattagatgggacatcatggtgtgctgatgagtcacagttaataatccaaaacatatctggaacaggatttgtcgccgttcgttcgacgaactgataaaattagttcagaaaattcaggttgctttcggaggaaggtttgaatgtctcgcatacaaacgaagaccatgtaataatcaactcatcagccaaccataatccctccttgtgacgcaagttgtttctgattaactcaataatcatatagtgtcagattggcatgttactcaggatgttaattttgtcttgaagattacagtttgactgcttccgaaacaacccccttaaggaaccacaaaaaataaatcagtagatgtgatactatttcagccccttggaatttcacataaaacaattcaatttccgcacgaattgtaaacttttttgttgtaatttggtaaattacaattctgctgtcatatcatttacatgcaattttgcaggctgcgaaagtagattagggctgtgtttagatctaaattttggatctaaacttccaacttcttccatcacatcaacctgtcatacacacacaatttttcagtcacatcgtatcaattttaaccaaacttacaactttgaaagaaactaaatacagcctagaagaagtgggtaggaaacaagaagagacagcaggtaagagcaagtacacaagaataatagcatagaacaagtaaggttttctatattacaaaataagttaaataaccatatctacaaaaacatgtttcctaatgcacaataaataaatagataagaacaccaacagcaatgagatgctggaaagtgcatagttaatggctcaatatctggacacgcatagaattctccaaaatctactccagctgcaagaacaatacttaagcatgattaggaattgaatacaacaccagctacaattattcggagtatccaaacacagcagctgaacccacataaatatatataatccaaagacagcatggacaacagtactcttttcatcagattatacaatcagccaaaaaacaaatctgaaaaacagagaagaaaaaagatatgtacccattctttgtgatcatttaaggaggaaccagcccaatgttctagaacaaaagcttttcgtcaaagcaaaatcaacattggcaacactcagaaaacattaaattattggagattatcatgctctagtatcttggttgcccttatgcccagactttggggcccaatttctgtgttttgtgccaaacccaccacaatgatgataattagttaatcacttggcttgctttaagatgcatggctccttcctttttgttataataataatgctaacactgatcacaattggtgcaccatgcctccatctccactaaactaacctgtgattgctctgcagtttatctcctatggcccaccaaccacttgagagaataatcaattgcaaatatgcaaatggtttataatccactctttagaaggaaaaaaaaataaagaaggcatcaagcaaaggaagatatgatatgctcatggaggaaccaaagaatatatactggtgaatatatctatccattgatgtactgctgataataagcatatgttcctgatgaacaacatgaatcttgcatggttaataacataagacagacagcacatggatcaaaatcttactgatgcccaaagatatatatgaatatatatcgagtaaaataaaaactcttgttggaattcttgtatacaactattttataaaacccaaagagaggggcaaaaattaatagagtaaatatcagctgttcttcatcaatctagagctccctttgggtatacatgcttctttgttgatgaacaatattatttgcgaacagcttaaatatgtactaaaaaaccatctcatttgaatcaaattaagcaaacgaaggggaaaaattaattgaaagaaagaacttctttttttttggttagctaggttgctatgagcctctgatgatcatgccaccatctgctcctgctccggccactgcgcgaatatgtcgccggcggcgtggccgtccttgacaagagagttcacccatgacacgtccggctccgccgccgcggcgtgcgtcgccaccggcatggcggattggccgcggaacgcgaacgacgccgacttgcggagcttgtgcagctcgtcgccctggacgccccagtccagcttgccgtccggcgagccccagtccgagagaatggacggcgcgccggtcgtcgccggcgacatgagcgaacgcgccgccggggcgcggcctccgcggtcgatgaagctctggctgcgcttggcgaacgccgaggcgcgggagctcatgatcgccttcgccatggagtggtccagcccgaacgcggtgttcgcgccgcccaccatcggcgaggtcggcatgtgcatctgcgtggtgtccgccatggagctgtacgcgggcatgtcgccggcctgcttgagggacagcgcgtggagctgggacagcatggccgggtcgacggagccgagcaggtcggtgtagtccggcacggccctcgccggcgacgcggtggcgaggccgttcgccgcggcgccccagctcgccctcggcgacggcgcgccggacaccttgtcgaacagcttctgctggtactggtccagcgcgagcatctcgaggtcgaagtcgagctcccgcgcgccgagcgccgtcttgaggcggctcgctggggacgacggccaggcggggctcatcatcgccgccgccgccgccgccatgtcgagcccgttgggcggcgaggagcgcggcgacgatacggtgggctgcatgccgacggacacggcggaggggttgacggcgcggagctcgtcgggcttgtgggcgaagaagcagatgcggcgcgcgcagccgacctcgtccttgcagaggcgcgtcctgtactgcgccgggtggagccagcactcgaacacgccatgggcgtactcgcacgcgtcgcccttgcggcacgagccgcccttgcggaactccgggcaaggcacgcagctgtaggagtagcggcgagggtcgcggcggcgcgcgttctcgccggggtggacgaaggggcactcggtccagtcatgggagtaggcgcgggagcacggcttcaccttgaagctgtacatgcggaactcgtcggtgctgaacagtccgctcttgaggtcgggcagcgtcaggtcaggcgggtactccttcttcgcctcctgcggcggcggcggcgacggcggcgaggccgacttcttcggcgacgacgacggcgacacggccggcgacttgagcagcagccggatggccttctccgccgcggtggcgcgcgggaggaggtcaccggcgcggagccccgaagccgagagcgcgtcgaccgacgcccccgcggcgagcaacaggcgcgtggccgcgaccgcgttcgccgcgccaccggcagccgccatgtgcagcggcgtggccccatccgtctccgacgcgcgcgcggcctccgccggcgctgccgccacgacatacccaagcacccccgtgctcccgtacagcgccgccaccatcgccgccgtcctccgctccatcccgagcctcgccacgccgctcgccgaaggcccataccacaacccagccacgccaagagacaccttctcctcctccacgaccctcctcaccgccgccacgtcgtccgctgccgccagctcaagaagcaaggacgccgccatcaccgtcgcctccttctgctgctgcggcagcggcggtgtggacggcttgcgcggcccagagcacatgacacacacaaacaaacacgcacgcagagtgttcgaccgagttcttgttagtcaaaacaaacacctagttcttgatttcttgttaaattcagagaggagaagaagaacaagaagagggagaagaggaattctcgatcgatggatggatttggagagtggtgtggttgaaaaaggcagggtagtagctgggtgcgtaacggtatatgtagataggtatagtaacggaggaatgggggttgatagagataagggaagttggagacgaagaagcagctggtctccttctccttcgcgcgttttttttttcccttctctttacacaaaaataaaataatcgttttattgttcgggttttttatttttttggctgctggatgtgtcgcgtggtcaaaaggaagggaagacgcgctgcacaaacgcaaacaaatcagagagcctctttcttcctctcttggtcgctgcatcctcctttcttttcctttccttttcgaccttcctttctacatcgtttttttgtttttcttgtaaaggaaaaaaaaaagatgagagagattttggtttgtgtttttttttggcggggggggggggggggggttggagcgggtaccatgaatgttgccacaggtgtaggcacacatgtgtttctccagtagaaaacatttcgcgagcgtgagggggaaaacttatgaggtatctacaacggtgtttattagcggactctctctgttatcatataagtaaatttggtgacgtggaagatagaggggaggaagagaaaacattgttgctacttatgatatcggcttagagccgactcttagtgtttattaaaagaaattcctctgctcgcagagggagaaaatgaaagaaagctaataaaaaactatttttgtgtattaatggttaagatgtcttttttgtcttgactatcgtaggagtctctgaataatgtgtatcaacaaagagctcatattagactttaccttaatacatgccccatgtaaagtgcatatatgagatttaacaacttgtttctatatactctctatgtcctatgatgatcaatttttggctgtaaatttttaggaattggttaagtttggaacggatggtgtaaagcgagtcaagaacccaccataatgaagctgaatcgagagtgtaaactttgctatgctcattatggaatataactttaatggataatggactataagtccactcaagctaagactaacattggactaaccctcagccacctttataagcattcaggtgataaggagtcgtggcgttgcaactcctaactcgttaatagataacgaaggttcaccatcacagtcctcggtctgtggtgttgaagcagggtagaaggttcaaacattattgcaattataccttttgtttctctagttaacttatgttgttatatataaagatgtacaacttgcatttaatcacacgataataactataatcccaatcacattgatctacaggaagaaaaatcagataaatgttacagtttatataaagagctagtgttgtagcggactaaaactctctaagaatataaagtttagaataaatagctagctttaaagtcattgcccctttataagaaaaaggtcatcacttacatggttggataagaaacaacattgttcaattcattgtacatcgaataaggggaccaaaaacatgttacccactagcatagtggaaagtctttggtatccatcatcataaggtgttagtgtaagctcttaagaactatccctatttcagtcctatgaaatgatcaacatttcaaaactaacacatggacattctttagcctacaaagctccaaatcctagagtaagggtggtgcgattcacacctcaagctcatatgtggtacaattctctgaaaaaattgtgagagtaaaaaaaacaatataatctttgtaaggtgatttaccctaatctatacaacatttaatccttgtaccatgtatcttttattctctaaactcgaataatttacttattagatagtataattagaaaccaatcgagaaagcaataatgcatggaaagactttggtatccataccataaagtgttaatctaagcgctatgaactatttatattttagccctatgacatgataaactttccaaaactaatacgcggacattcactagcctacaaactcttacccctagtgccaatggtggtgtgctttaaacttatacgtggtgcgattctctaaaaattttgagagagaaaaacaacatcatctttgtaaggtagtaattttctcaattctatacattatttaattgtagtacaccatatcgtgtttattcattgaaatcgaataatttacttactacataatacaatttcaaactaatcaagaaagtaatacggagctacttcgacataaaagtaccactctcactctcatcccttgagggttttgtctcctagtaggagtgagtaataaccaagtggtttcttgtgtgcacaagcgtgtgtgcccacaccacacggttgcatttgcatcccatccaaaccaaaaacgcgctgtgccgactggcagatatgccccacggcttgaccactgccaggtgggcccctacccggggtaacattattattctgccgggtggtgggccccactccgagccgaaaggcaaaacgagtttcacgcgtgcccgtgtggctgactccactcgactccgacgcgtgggtgacgccgttaacccgcgccgttaggcttggaccggttcgtcctcctcccaccatgggggccccacgtcggatgccgacgcggcaatcgcgtgcggacacgtcaccctaccccccatgccggcaaatatcggggacacgtggcgcgcgctcgcgtcgccccttgacttttcgcgcgccagggtggtaaatactcctaagtcaatgacatgtggggccagaatgatgtggggacaggatgtcagtgagaggggctcgggtgtgcggtggtagcggggggtttgtgcgtcggggggtgtgggtggtggggcccacgcggtgggtttccgagtcagtgttccactctggttgagttgacggcgtgagctgctttacggttagccgcacgggatttgccagcgagacgaccaggtccacgccttcaccttcacttcactgccagtttttttttaaaatttttttaaaatatttctctgactttccgctgctgctgctgttcatcttatctgaatctgaattttctgaagatttctgaagatgagggcagtgcagggcagcaaatctgaccggaattgctccatggtttcctcgacaccttaaacaactgcactgcactgcacacatatgcagacttgattattctgctcatatggatctgtaaaattattgacctcgtttgtgctctgacggctaccgcagctccagccagcacaaacgatcaaatccattgccttaggcctaatttagtttaaattattttaagaagtaaacttaacaaattatggtcttaacaatgcaacataagaaatcatttctttaagaaaacatattttttaaagggtaaagcagataatatgttttcaataattcagtgaataaactgaaaagaacatggtcttgagttaatcgttttattcttagaccatgttcttttctaattaagatataaattctatcttgatatctgttagcacattttcaaactattaaacggtatgttctgtataatacttagttgctctaaaatatcaaataatctattattcaattatgttatattaaaactcaattaatcatacgctaatgactttcttattttgcgtgcctttacttaaccctaatctttaagattcgaacggagccttaacctcctgtgtttctgtgagcgacaagaacaattttcagctagctgagtgacactctcaagctgccaaaagctctccatgtgttgtcaaatttccagcattatgctgcatgaaaaattaagcgccccaccacccacaaagacaaagcatgaaggaccgatggtaattagcaggtcggtcactcatatccttatctgcagatgcagctaagctgggcaccatgaggaattcagctgacctacaagatgatcggattattaagcatatgctaattatgcatgtgggggaatctaatcgatctgacgcctgcaatgggttagatagatcagatcatgcttgttattgttggtgtcgatctaaatcgcacgtgttccttaacttcgcacgggcagtttttcattataattaattaatcaattcaactttgcatcgatgttgtagataatggagcaagctaaggcatatgcagcatccatcagatcattcagacattcaggtagaatattatgttcggttagcactatagtggcatgacttttcttattcggattccttccctgaacaattatgtttattttcgaatagattattcagcggattgttattgtcgattatctactcaattatattatatggataaattagatactttaataaataaacataactaatactccctccgtactcgtaaaggaagtcgtttagaacaacgacgcggtctccaaaacacaaatttgacttcttgttacttatgtatacttttattaaagtatttttcaagacaaatctattcatataatttttatattttcaaactcaacaacttgagagttattcattatttatattcccaaggtttgacttaaacattgtcctaaacgacttactttacgagtacggaggaagtaactcataacaaatagtctaagtaatataagtaaagtattttttttagaaaatgtatttttttgaagtacagaaaaattaatctgaaaataactactgttgtacaataaagctaattactgctactaattaagctatacatgtatgagaaattgtgtgccctggattcaatgcagccatcagacccatggtcggatggagatggccttcaagcacacgcatataaatatgcgcatcacgcgtgcaagtagctatcagttgattaattaacggcagtttaaaaataagataattgatggcaattagaaggccaagtcagcatttcataaatggtctcgcagcaagactagaccagctcagctcagctgcctttctgcctcggctaagtgaaatctgactgcagctaatctggccctcaagattttcaacgaacaccggccttctcagctgtcatctgttaaccaccaactaaactccagtaatttacacatctactgtattatagaactaactgtccctttcataacggttgtgtgcaaattttggaaccgactgattgatagctagcttgctagctgtaattaactcgcagaaatggggacaggttaatttaattagttacagttgcaaacttgggagttgggatggattcatgcacaattggattgatatctgacagcttaatttgtaagattatagctgtaatttgaaacagtagctcactgaagctggctagctacctgcaggcagcttctgctttacaattctagtccaagttacacgtgcttgcatggtcaattggtcagcagctaagcctctacgttgactggttgaccagtcaacggacaagatgatatggcgccaagtgatgatgagtaaagtacactgttacgtgctacgtacctgagtgggccccacacgtgtacgtatatacggtacgtatacactgaactgaagagtagaaaagttcagagtagcagatgtaaattcagacacaacacaggtagtagtaccatgctccatcataatgaaaggtctggacaaacaaaaattgatgatagatgcaggttggcactcactgattagcttctctaatcaatctgtctgttttaattcatggtcggctcagggtttcagttctttaactattctgaactatgcacctcaattaacacaagcccttgatagatgcaacaatgataataatactattacaatttttcaggctcgagttgatgatgatggtgatgattggttgcatcaaaagcaaagcttttggtggccatatatgtagatatagagccagctagggcaaaaacaagccaagtgatacctaacccaactttggatttgggcaaaaaactgtcgtcaatgttttgctgtgtctccatgtttagccaaccccactactaacatgatgcatgtagtagtagtggactcagcaatcatggtggttcttggtcgtttcctctaattgttttggttgtggctctgcttaatttgtctgaatttgtcccaatgataggtatgcatacatatgaaaacatatgagaagtttcatgatattgcacttgcataactttgtctcaattatgcagaaaaaaaaaacgttattttttctttactggaaagaagtactagtgccagatatctggagaacgagtgtacatccattttctggatgccaataagccaaacaaatggtaataattaaaccagtatatatatattcactgaaaaatttcacatgccatggatgatgaactgttgattttttgtcacaatctctaccatagaaaaaaaaaagaacaggcaagaatatttcaggagcaaaacaacctctggtgaaaacacacatctcgtcatcgtctatcgatcgatcgattgaactcgctagctatcatatattcaggttgcaatttcccaaaggaaaaggaattaaagggaaggggagaaaaattttccatggccatgaaagagacctgcactgtccgtcccagcaagagcgtggtgacaaaccgaattgcaagcacgaactccaccggcatctagctagcgatggcgataatggtggagattatttgcggtgtggagaggaggcttgtcgccatcgccaacaccaccacctccatcatcacagtgaattctgaattgtcatctctctctcactgaaactttctctgaatcttttttggtttttgactcttcagagtagaggccggctggctttaccctggccttagttgtgtggatgattttctaccactcatcgccttgaatgatcttctttctagtggcatctgatgttctggactcctccttaaccacaaaaattaactgtcatcagaaattcagaaacaaaatcggcaggagtgaaagaaaaatgtttcttgcttttatctgtggctgtcaattgactgaatcctgctctctttttctttatcattttgttatgtttttctatcactgtactgtactagaggcagttgtttcgagaaattaatggagagttctggattctgaagcaagcaggaagattttgcagtacctatttctgatcgaaatgggaggagtgatgtgtgggtgtgggtttttttgttctgttgcttcaaagcaagaaatggaatatatctatctatcatccttcatcgatctctgcagcatactttacatatggtttcagttcagttcattgcaagtggttatgcctccatattttggtctcgtcagatattctataagggcatggtaccggacaaattgcgaaattctggaacaacagatttacactctggtggaatctgccatataaaaaaaaatacaaaacaaaagtggctcgccaagttgaatcataaggaattgcagaatatgatttgctcaattgagctattggataaatttctatatgaatttggagagagtattaaagaaagtttgaccttctgttagatttcctgtgtggctgcctattacatgtgaacacatggctatgcagaaaagttcattcttttgtttgagagagccacatggataaaattctccataagattcttagaattccataccctgaaaaaaaattcctcaaataatcctatgtcattcctaatttgttcctaaaaaggcgctaacgaacgattttcacgtattaaaaaatctctctgatccatgaagtgtttttggtgttgattgttgaattgaaccatgaaactgaaacctacacatgctttgcaagttgatgatcctgcctgcccttggtcccttcctacttttgagctgagcatgcctaagctttcccattgatgctgttgtgtgtgatggcaacaacaacaacaacaacaaccagttgatgagatgagaggattttgtggagttcagcccaccacactgataaccgactgatttgcccacttttgcctgctaccacaatacaagccccacctgtttgtaccaatgccctctccacctttcattcttctcccaaaactttattagctagtgctagctgttgttgatacttagtactggctagctaagcatagatgcaaatatgcaatggaataattatctttcaattgaatggctcacagattcagaacatgatgagtacatactatatgtaagccccccccttctgatggagaattaatcttctctttgattataattagcactttagtgtgatctttgactgatgatgctatctattatcatcatgaggggggcaataacatactagcatgcattatattgatgcatgtttgtgtgcactacaccttcatggcagccttcttgttcttctttgtcttcttcaccttgagtctgattttagcttcaggttggccgtcgccggcgaccgacatggttgctgccggtgaagaggcagcttcttctgattcttcagcctttttgggctcctgcaaatccttcatgattaactcaggcaccacccagttggacacgaagtagaagaacagcatcagagcactgcattttgcacacaggcgcaagaacatccatcaacaaaagttaaagaaaaaacagagaggcaaaaatcaatgagtcctgaattttgtggcatttgtcagatgtgaggttatgctgttaattagatgcgtattgatcgcatgtttttgcagctggtgtaaaatacagtaaccatctagactgtcatgttttgagtctgagctcactgaccatacagtgactatcaagtcctggtttttgtcaattgttggagataaaaaatgctaagcacaaaaataaaaaatcatgtgaaactaaggcacttccaacaatgacctggttagcccaagcccaacccaggttctacctagcccaagacacagcaaggcctagtttggcccagttaaagatgagaatttggatgtttcatagcccattggaacacaataaatttacacccactttcatataagatacaatcatacagttatattttgttcatacaaaacattgtctttcctgacattatcttgctgcttcttcgaaggccaaggaataatttgttattttcattggtaatatatatacatgtcttgtaatattatctgatgccatataagcttaaagttagttaacacaatgtattgattagctctgtaatcctaaaattagagtcttaacccttaagcataagttaatcacgtatttcatcctgtacttgcttgattttgctatcaagtattgcaggtaccagtatatactttacttagtactccctccgtttcatattataaatcgttcgaatttttattttatcaaacttttttaagtttgactaagtttagagaaaaatatagtaacattttcaatacaaaacaaacatattatcaaaatatattcaatgctaaatctaatgaaactaatttggtgttataaatgtttgctaattttttctgtaaatttgatcaaacctaaaaaaaattgataaaaaataatttaaacgatttataatatagaacggagcgagtaggataatgctggtgaagtacaatatgtatagagtactttgcctgattgggatgagggaggagacgtcgccggtgtcagccggcgagccggggaccagctgctcggggctgaggaactcgctcacctgcggaggtagcgcccgcagccgccgccccgaccacct

SEQ ID NO: 59031 - DNA, 25131 bp, Oryza sativa
tcatcatatttaagtatgcctgttcctgacttcctatccctgccggttcataggattacattgttgattctaaaagaaccggtagtgatgggacggtttggaaggccatttctacaatagcgtgtcaggtataatatgacataaattagtaatcccttcatcccaaaatataagcaattttagaatagtgataaatcaaatatttttaactttgactattaatagaaaaaaatcaaacatgtaaaaatgatattactagtggatttatcattaaataaactatcataatatgtaacttgtttatttaaaacatcatttttttaaaaaaaatattgttggtcaaagtatcatctcaaagacggtgttgaagtctaaaattacttattttttttttaaattgagcgaggatttgtttgctttctatttgcaactatgaaggccatgtttagttcccacgcaaaaacttttcaccctgtcaaatctaatgtttagacagatgtatggagtattaaatatagacaaaaaaaactaattacatagattgtgtgtaaattgcgagacgaatcttttaaacctaattgctctatgatttgacaatgtggtactacagtaaacatttgctaatgatggattaattaggcttaataaatttgtctcgcagtttacacgtggaatctgtaatttgttttgttattagtttacatttaatacttaaatgtgtgttcgtatatccagtataacacgccaaaacttttcacccctgaaactaaacattgccgaaattatttgcttgtatcgactgttatatggtctcggataatttaaattttgttcatgtaactcgcaggttataacccaagaccacaaaaacataattgctctcgacaatgtggaacaatcgttgtcccatttccttttggccttgaagagggttgtgccgccagggaagtgtttcagctctcgtgcctaggcaagccaaattctgtgctgcagtacaatgacttcatcggtgttcagtatataaatgtcagtgaggggcttgttggcattaaatacaactcatctttcgtggagatcttattcaatatgttttcgcaattcagattttcatctcaaggagtagtatccaacatatttggtaaagggcctaacctgtatgtggatccaacggaatcagcctcggtgcagtgggcagttgccaatctgacctgccaacaggcgcagcaaaacacttcgacatatgcttgtgtaagtaccaatagctcctgctccagggtcatcagcaccatgcaaggttatgttggctacaggtgtacttgtttgcctggttatgatggaaatccatatatcccagatgggtgtaaaggtaattatctctttgaccaacttagaattcaaccagatgggatacatatatatatatatactatatcctcttatagttttctggtgtggaattctgtcttgtacaaatatgaagtctctaattttaatgtttcaaatatttttattgaataaacatttactgaatagttatttgatcaggtattggtacactatacattgacatgctgagatatggttgcagatattgacgaatgcctacaaacaccacggatttgcaaggaactttgccacaatactgaaggaaactacagctgcaccatgtgccctgatcatacagagtatgacgttataagaatgcagtgcactccaagaagaaaccaaagtctcttgttaggtagtctcataataatcaattccacactgacaaaagggtgtatgaagatattacaaatgcgatgttatcattgtaggtattataattggccttaccattggatttggtgtgttgattcttagctcgattgtaatagctatcattagaagatggaaaagagatgtccataaaaaaatacggagaaaatatttccaaaagaaccaaggcctcctcctagaacaattgatatcatcagatgaaagtgctagtgagaagacaaagattttctccatagaagagctaaaaagggcaacaaataactttgattccacacgtatcctagggcatggaggacatggcactatctacaaaggtatcttatcaaaccaacatgtggtagccataaaaaaagccaaagtcataaaggaaggtgagatcaacgatttcatcaacgaggttgccatactttctctaataaatcacagaaatattgttaaactctttggatgttgtcttgaaactgaggtccccttattagtctatgactttatcccaaacggttcattatttgaacttcttcatcatgattcaagtagcacattcccattgtcatggggcgaccgcttaaggattgcagcagaggccgcaggagctctatgctatctacattctgcagcatctatatcgatcttccaccgtgatgtgaagtcctctaatatactgttggatgcaaattataccgctaaagtttcggatttcggcgcttcaagatctgttccagttgaccaaagccatgttgttacaaatgtacagggcacgttcggttacttggatccagaatattaccaaaccgggcagctaaatgagaagagtgatgtctacagctttggtgtggtactcttggagcttcttctaagaatgcaacctatttttacaacaatgtcagggatgaaacaaaatttgtgtacttacttcctttcggagattaagaccagaccaattatagatttggtagatcctccggttcttgacaaggcaaatgaagaagatattagacaagttgcctcccttgctgagatgtgcataaagctaaaaggtgaagaaaggcctacaatgaggcaagtagagataacactgcagcttttacgaacagaaaagatgaccccatcacatgttagtccagacagaaaccaagagatagaatcactactgactcaaggagccattgaccaagtgattcatgctttagtaaatgttgacagagctaatgtagcatctcaacgctctcaaacctcatgctatagcttggagaaagaattcttgtcatctgctagcctaccacggtagaagtgtttatcctttgtcccttgtgtttggcgttctttgtacttaaaacatttcctgtgttcatagcacaaatttacatacatgtgtaccgtttatattgtaatgtttgtatatggtagttgtactcggttcagtataaaccacatcttaatgtatggactcaagaatgtttattgcataatattaatttagaggattaagttagttatatttttagacggtgaagtggcggtgcttcagctctgtggaaaacatgctggtgctagtcttgttatattattttttacaaaaccaatctactgatattgctccagctgcttccagatcacatggcccagccggttctagtgagaaggagatgaaaatactgtaaaacaccaaatatttaaaatgccaatataactatttcctccaagcttcttctttcccttcaagcacctgtttggacgagattctagcagctacaacttctcctagaatcagaatcttcccaaatagtctagcttttgtccagattctaaaaagttgtagtcgtaaaatctaaaaaatgaactagaaaccgaaaatttgaaaacctagtttcttcagattctcagaggatagctacaaccagctttcttggaatcataaggtccttcaaataggctctcaatctctcaaatttttacctgattcctaatgcatcttagtgaaagcctccttctgctatagtgctataagcctagcacttgctctgcataggactcgttttgggtgtcagggcataacattttacagtctataagagaacagtgcagcttcagtagaaatgtcaccacctcaaaagccaaaaaagcataggaaagatgataaatctaccattttgggttttggtagcacaattattgtagctaccattgaatactttgtgacactgaagaatttctttgtggctaactggtttactttacttacaaaagtgaaccagcttttgtgtctcatacaatgaaaccaaacagatgttaggaaacaaagcaactcacacgaatacaggctacactaggcaacggggaagaaacacaaacacaggcaaacacacatgagagctttgtggcaccgaaacaacttgtgcctttttctctttttcttctcataaacacaagctagttatagatatatatactccgtatatagaaacacatgtagtcacgagctggttagcacgtgttccactaactacattctcagccagtatacccggtaactaaccactaactaaacctctaagctaatgcatattcacacaactcagtctccgatcagtgcatgcatgcaaactgaccatttcctactcctaaacttgtgctcttacctcctggctgtttattggcgcactactcactaagccacgcagcaccaacgtacacagctagctctccacgccatgcaacacacacgtatgcatctagataaacatgctgatattaaaaaaacaacagattcgtgtgcagcattacagaggtaatcaagattaatttataataacagattcgtgtccagactactggagaaaccatctttcgtcggtcgtccaaaaaccacaatagtcccggttcgaataggaaccgggactaaaaatgtttgaccaaccgggactaaagatcatttttagtcccggttcaaagaagttaccaaatctagttaggccccaattaactttagtcccggttggtataaacaaccgggactaaaaatatatctttagtcccgtttgtttatcccaacaggtaccaaaaatcctcccaaaccgcgcgcgcgccaagtccaagacttatcgatccccttcccttcctctctccctctttaatatcggcctcatctcgatccaaatccaaccgcgtatgcacttcccctctcctctccccttcctccgcttcacctctccggatcccccctctcctccccctccctaccaagtcctctcctcttgctctctgggtcggcggcggccgctgggtgggcgcgatggcgggtgggtgggagcggtggcgaccgggcgggcgcggcggcggcctcgcgctcccctccgccagatccggagcggaggggatggcggcagcggcggccggtggccggaagcgccctctccagctgtgcgcgcatgcatggaggccggccgggcatccctctgccggagatttgtcttcttttttaaaaaaaaattgtgattcattgtattgattgagatgaagaatttgtgattcgttggatggattgagatgcataatttctttttttgttgagaatatgtaattcattgcatggatatgagatgtataatctgtgatgtatttgatttgtggtatttgggatgttagtttgatttggggatatacatcccactggatttgggagaaaatcactagaaaaaaacaataaaaaaaaagaaactaatcgggactgccgctgtactctttagtcccggttattccacccgggactaaagatatccatcccggatttgtaatcccggttggaaaaccgggactaagggggttcccaaccgggactataaaaggtttatccagtagtgagtagtggcagcattacagaggtaatcaagattaatttctaacaacagattcgtgtgcagcattacagaggtaatacaatcagaatttgggccatattcaggttcatgtaattgtttttttttttttgcctgctgccttcatttcatcaaggactaagtctacgtgtctccctcatcaaatagcatccctcaactataaaactgggtataacacctccctcaacgtaaaaaaaatagatcaaagataatcccaaggtagtactaacccggttttggccacatggcatctacatgacacttctcaatgtgaaaatcgattattgcatgcggccaataactcgctggctgtttgggaagatcgtgtcccctatgtgatataatacttcccgctatttctaatctaaatctgaaatactatgcatagaacctaactgagttattgttcttagcatataataattagaatttttgcattgacaaataaacaaactttccatatataaaacagaaaacatttatatacatatatctgttagtgatatgccctagaggcaatcatagaaatgattgtatcacatactatgtttacatatttatccgacattgttccttgaaatagataactcattattggttaatgaatatgtgattctttcatgagactctttatgttgtttgttactatttctaaaggatccctgatcaaatatcatatgtggaacaaatatgattagatgatcagcacatgtattaattgatgatcgtgtctcatggatcatggtatagagataccaaattaataatgtggacacatgttagtgaacatgttgttggatagacccaacatgagacactgcaagagccatatgtgttgtgtcattagtgatctcatttagtgttggtgttgaatccttagacctgagattatcatggttcccaacatatgtagtagcttacttagggactgctaaacgctacttcgtaatagggtagttataaaagtagttttcggttatgctatgaaacatgtagtgagatatgaataatcaagatgggatttgcccgtcctatggagagatatctctgggcccctcgatgttgtagattatggaagtaaatggccatgccacaggtgattgaggagtcaatcacaagttatataatctatcaacaagttcgagtgaatgattgagctattagaggatggcacatatctagccttgagcttaatctatatcgtgaggcaaaggggttcatacaagtatacactagaggttcagccgatatgatctttatgtatgcccggtgggtcaatacgttctgctaggggccgctgttgacacgtggactgaaaaggagttttcgggttacagccgagtgtacatgaacctacagggtcgcacgattaatgggccagaataaggggattggatggagatccaatatgagtttaattcggacagggatccgaataggagtccaacgggccttggaggcccgagtgatggatcctatatattcgtgagaggtgtgaccggcggaggcattgcatcacgtgagaaactctagccgtcacttccctccccgagcaaaaccctagccgcaggcgggtgctagcacatctgcgcgtggcgttccgtccctgtatgtgtggataccggtagaggcgccactggtttgcggtgctaattggtgtgggagtacggcgaggagaacgcacgagaagaagaaggtcgagtcggtgcgatcgactacttcctctacatcgatgcgcgctacttcgcgagaattccttcgacttcttagcgcccttttccgctgcgcagcgcgtcgagtgctaacgatatatgatctaatacttgcatggttcctggtttatgtgatataaaattttgatttatgctatcgtagcctacgcgtatcccaacaatatctatacatttaaacatttctgtcccaaacattacaaattagcgattgtttcaacacaaacgaaatagtaaatttttactgcatatgttctttccccactctcttaggggcttgaatttatcttctaatgccagctgactctcattgtcgtaagattgccctagtgcgttgcagcaatcacagcggataaagtggcaaatgtcagcgcataccttcataattgttgtgttgtcgaaccggtttgctacataagagatttcaggggtctgaggaaaaaagacaataaatattacaaattgaattgcgatgaaatattctgtatagagaacaatgttaggacttacgtgattgatgtttgttgtgtacctcctgttgaccctaagcatctccaacatgtaatacccacataggttagtgctcgagggttgcttgaagcactgcgaacataataattacaccggtcattataaacaagtaatcattcaaagaatttgtgttcatggaatatgtcagtaccaccgacctatcttgacgtgtagctttgtcctttccggatcctttactgccccgtgatgtttgcggtaaaacctaagtgtgctatgctaataaaatatttgtttgagttacttaaaaattctagagggtaaatttagaattgtgaggaactccatgaaggtttccttgttttagtgtgtcgggtcgagtgctacaaccgattagtccctcgtatatactacgaataagatatagtggtcgctacaaacaagaaagatttattagagacttcatttgttattaatgatgtattactacataaataatgatgaattaagacatttatgtctttgtgcgagagcgtcccaagtatgtcgctacctcggtcatcttatccttgtgcaatttcttaatgtatgcttccttttcctccgatgtcttatccttgtgcaatctccgtctagctctcccctctcttccaggtgatctctaggccaacggccggtgaggagaggaccagcggccggtgagagaagaccaaggaggcagcatctcctgtctcccgggtgtggaataaggagggccaagacacacagatcatgcgcgcatgcgtggattacagctgcatgctccaccaccgcgccccaccatagcaccagcgcctcctctagccctcctgtggccacctgttggtattttctactatcatagataaatacgtaagaccatgaatacttctgtagcacttcaccttagagtatttcaagggtatcgaatcacaggaaacgtgtgtctatatctaacaacaaaatcctctccgagcacaacaacaaatggtaggcttcggctagagggaatgcatatggtttaattaaggaaaaagtacgaattattcccccgccccctgaactatcatggtcaaccgaattacccccataaacccaaaaattagacaacgttcaccctcaactttcaataccggacaaattatccacctcgaaccaatctagagcggttttgtcctatgtggcatacgcgtggcaatctagttatcattttatttattaaaaaaatatgggacccacctgtcgtactcctcttccccctcttcctctctctcttctctctcccctcttctctctctctctctcagaagttgccgagagcaaccggcgatgggcgcggcaggtgatgggcatggcgggggcatggcgtgcggcgagcggcgagcatggcggatctccccaccaccgtttcctgttctcccgctgcccgccaccggatctccctgccaccgactcctccactgccgccgccccccgccagatctccctgccaccgacgcggcgacgcctcttggaagccgtcgccgacaccgcttctccatcgccgacggggttcgcctccacctcagctgggccatcatcgtcgaccaccctacccaagccatcactgcccgctaccggcgtcatccacatcggtgcaccacaccctcctccaattcctgatccaccgccggcctcccttggctgagtcatcaccgcccgccgccggcgccatcctccgcatccctaggtagagggcgggcccgatccaaccggctgtgcccccgccacgcccgctgcccaccgcgcccccgccatgccagccgccggccaccgggtcgcactcacgacgggcgtctgagagagagattgtgaggaagaggggaaagtgataggtgtgagtgcatgacaggtgggccccactatttttaaaaaagaaaaatgctgactggattgccacgcgtacgccacataggacaaaaccactatggattgggtcgaggggggttattcgtctggtatagatagttcagggtttaaaatatccggttttatggttcaggggggataattcatactgttgtcatagttcagggggtacttcgtacttgttcctttaattaacaatacttaagttaaaggtaaaacactataactctatgacataccgaccgtttagggatacaaagaatggacatggctatcaccacctgctgcctccctcacttccaggaagcacacaacaaacgaaggtaaccactaacctagaccaacgtctaagttattgattactactccagcctcacacaagaactttcttcttcatctagaattctagtgctggagcacttaaatactaggcgacaaacctgcaatgatggaaatatatctcactaatatagtaaattaaataccaaaaggaaacctcaaacacttactttattaaaagaagcattcgccgaggtacaaacgagaagagagcgccgacaattcaggcactcctccggaacttctcctcactctctacctaatttcaacactactaaagtgagttctactccactttgttgtgtttttgcgattgaatgagttcctccttttatagcctctaataaaggttggaatgacggttgtggaggtcagtgcacccacaaccgccatcaccatcaaatgtgcagctgccacgtgcaagggggtggccagggtgccatgtttggttcagccgaaccaggccgccaccttcagccatcgaccttcttcaaggaggttggcatgtggggccttatggcgatgcactgtggataagaccctttctggtcgattttgactatcatgtgggccctccaatccatgtgctcgcgtatgattggctggaggtatatttcgttgcatggaggatgtaaattctttgaaaatcacctacatgcatatatttaccaatacaagtggaaacaattagtaataaacccctaccattgagtttaatattaaatttaacaaccattaacaatacccccacaattatcctttacactcgctgagtgaagctcatggatttcaacagtgcaaggacttcctgtataatggtacaaacgtacaatgtattccagaccatacctggacccgtgaactttgaagtgtctaccatatcatcttgggtgcaatggctttgactcaagttgcattcttcccttgttgtcaagaaaatagtgagaatgaggcgatgttctgaagagtgtcggaattgtcggtgttctctgctcgcttgtacctcgacgaatgcttctttaataaagtaactgttcgagaattccttttggtattaatttagtagattaagtgagatatactcccatcgtagcgggttcgtcgcttagaaattatattaactgctctagtactaggactctggatgaagaagaaagttcctgcacgaggctacagtagtaatcaataacttaggcgtggtgtctaggttagcgatacatttgtttgttgtgtgctccacggaaagtgtggtggcggtaggtggtgacagccccgtccgtcctttgtatctctccatgtttgggtacatcataatgctacaaaccagactctgcttggcagactaggggagagccggtgcccaaagcaatcgatagggttttatctttatctttggtatagttaattaatccaaaggaaacctctctttcctaagcctaccattaggtattgtttttggatagaatttagttcctagatatacacacatgttcccgcagattcgatacccttggaatactctaaggtgaaggtatatagcggtattcatgcatttacaaatttatctatcaccgtaacaaataccaacaagcatttcttgtggcgttgccaaggaatggttgttgtatcatcttcaaacttggttcatcctctattttttcatttattttattcctctcttattaccaaccatagagcatcaatctattcaaaacttttctgctccaaagcgcgagtcctgtgaaccacctctttcttcaaaagcaattcattcatctagctatgaactccacctaactttgtagccatggttcggcaacaatccttctcgggtgttgatggttgttaagtaccaattccgatcgccaactagcacaatgagtaaagggaaaattagcatttcgtacatgtataccaataataaataatgtagatgtattaggattggtgaattaaattggttgcagaaattatacacaaaagtggaggagaaatgatgccggcatgcaaagaaacacacttgaggggcccacgagtcagctcaaaccgactcaaattgcggccaaccacttgttatccaccgaccaaagtcggtggagtaaggcggttactctagtgcgaactaggcctggcgtcgctcatctccctcctccacatggacgctccagatgatctcctattgacgattactatataataggtcggtggcctacaaaccaccttaatcaaccgtcactgaagcgtatttaaggagtggagattctcacttcacaacacacacctcaaggagcaattccctcttccactttgtaatctctatagtttctagtagtaataaagtttaggagcttctatcctgtagacttcctggagttctgggtacgtttctagtactttcctcattttataagactatggctgaattaatagaattatcttctttatttatttatgctcatggtttatatatttatttattgagtatgtgttctaagagtagtgtatgctttgtatatctgcttcatcctaggctagtcgatcaatgttacggtaatggtccaatgacctttataggttgctctagcttcaacttgttcatcggtaaggtgaaagtcctgaggagttagtgatattatttactggcataagcatggtttttaggctatataaatgccgttggatgcgagtctgccccacggaaaagtgaggtaggcagcaagtttgacagccatgtccgtcctttgtattcctcctcgttcgggtatgacataagagtgcgtaaatgccataaccacgctggcagaccagcagggagtggtctctcggtagtacctgggtgcatggaactatgtcctatgttgtaactgttgacggtcgttatcgatcagttttgaccgtcaatactaccaaaataggagagaactagtgatgcttgcaatgcataaatatgttagagtaataattttccactagtattaggtttactaaccttttgcagagaatgacaataaagtggaggagaatcgacatcaacttagatgataaatcaataggacgatgtcgagaaccagacttatgaatagatgggccaagaactcagaactaacacgatgaattgggccaaaattcacaagtatgcggactggagcaatagaggaggccaccagccgaaattgggctggattgggccagccccaggatcggccgaggccgaaccaatcttggcgccgttggatctaggttttggagtggacgtccaggattgcatcccaataacgattggagggcactccggagaattccccttccacaaccgtcataactacctttatataaggagctcactctcttcacttcacacacacctcaagcaatagctctctcttacgtcaaaaaaatcaatagccctctcatttctctcaagtttagtttagtagtatttagctggtggaataggaatagagtagaaatcagaatccggaagccttcggaagagttcgagtatggctctagcagcttttctcttctcttttgtaagctttgtacttttattagaatactcttataaatacatttatggtattgaaatactttccaagtatatgagtacctactttacgttatgttcttgttatattgtatgtacggctagcttatttaggagatgctttggtgcgggtataatgtttgcttgtgcaattactctatgtcatgacgatgatattagagtagtatctggtagtttaggcgtggtgtcttagattacgggatatcattatttggggttatatattgcggatgagtggttggccgctgatggtgacaactcagtacggttattcctccgggcctatatataatcctaagttaattccctggggagggtattcctccgtatttagccccggttgtatggtcatgacgggctgtcgtaaggaactcggcagtcaggggtggtttctcgacttactaggagggcatcggaaagagggtattagctagtatatcagttaaataggatgtatgtatactatgtatattagaagtataggaatagattatctttctcttttctttccacctagcctagataatatatatattgagaatgagtagttaatgcttgtatgccactctacccttggattatcttaacccctgcttagaatataattatcacaagcaatgcataaattattagtccagttctctctacatgatcttcccacgagataaaatatgatcttcccacgagataaaataaatacgatacccttggaatactctcgggtgaaatgctacgatggtatatccgtgcgctcgcggatgaactctataaccataatataccagaagtatttctgcgccattgctgggaattatatttctagtaatgtcgttaagaaaatagtaaccatggataagttaagtgtatactagacatgattactataaaagtacatatgaatcatagttacctaaagaaaactccgtactagatatttttatagacgtgaatcccttgtgtgtgtccactaccatatcattatttatcctaacctctgtttagactatggtgaattaattatacattgattaagagatataaaagaaagaacatatctttatactgtcgccttcccagcgaaaatataaatacgatactcctgggaatactcttgcgaatttatctgtgattgtaagaaataccaatatcgggcgcgaaagaaaaaatccctaccatcatccgcatgatcctgagcaattatattcatgcctaacaatagcgggcatgacacaagaaaccttaaagtggaaatcgtttcccttctttcttacagagggggcaaaaaagtggtacacccataccttaaaatattacatggcgaatgagaggaattaaaaagcaggttctgccttggtgtcttcccactaacgcgtgtagtctctctacgtatggaggttctctgcttccgacaaaatgagaaggaatccatcggtgtagcctaggctcggtttttcttcttaactcaagatggctagacttgtctctgcccgatcatgtgttgttacaacatttttggttgggtttaggcaagccatgtatctcgttacatccaccggaagttcgttcgcacacaaaacaacatcaaaaggaaggaaactcttatatcgtatcctggagaacacctctttcgtttgttgcgacaatatccaggaaatcaaggatacaaatgaggagccatcaaccgtcaaatcggaacatacatcctccacatttcaaccgttgaatcctcacccaaaccatggaaacaggacaaagaagaaattcagccttcaaaattacctttcctgtttgtgggtaactttttttttgaagattatggaaatacctcaaactattcttgccaaaagagaccaccagtctcgtgcagttctcctgtaccactcgagaaaattttcctcaaagatatggtgtaggaattaactaccgtcatgagtgatgagtggttaagggaggtggaactttcctctcaagcaattcagatttttgttcccgtccttaactattccttgcctcatgagagaggtcatggcgcaaaccctttataatcccactattggttcaaacattatgtccataacctttgcattaaatttcttaggggatgaaccattagcaccaatggataaaaccttccgagcccatctattcctatcatcaaaggtcatgttactcttcgttgtgccaataagacaaaaagatgtcaaggctatcctggattttcatgcattcaaattctccaaattctatattctcatagaccatcccatagaaaaacttcttacagatgtgccgcaaaccggtgtcatcaacatcaaactcgggataaatgtgtttccatcccgatcttatgatcgtgaaactctttgacagaacctataccccgatttcgagccaatcgaggaagtgttggctgtagattgtggttaagtatcgatttcgactgtcaactatgttaataaataaggggagaactagcatttcttatacgtatatcatttataaataatgtagttccacctgtattgcagaaatactacggatgcaggaattatacactatattaaatgagaaatgagctagcatgcaaagaaacacatgtccggcgaatcatgtgcgagcacacggattaatggtcccacaagtcagaccaaaccgacttaaagtgggaccaaactctcgtgcactgaccaaggggctcacctgtcatccactgaaggcggtttcccttgttcggccaaacttggagtggcacccctcggccccccatcctccacgtgtcaactccataactactcttaatgacggttaggggggtgcactgacctccctaaccatcaagtatcaaagtatgaagaatggacagaggacagtgctctgacatgtaatttttgtgatgtctattatattctttggaattctgtttacatgcaattttttctgtccctttttttatatttagagaggttttttttcaactacaatttgtagttgcagacatgcagctatgctagttgcacttccggatgttgtagttgacgttataaattttatgcaagttcagtgataaatttgtgcaactaatgttttttcatccactctctcccatctgctttttttttatcgatttatcactttcttgtttctcttctccccgtgggatgaatctggtgcttttttcccactagcttcatgtgaatggcaaaagtaaccccaattcgcatgcgtacccaggaaattagtttattgtgtcggcccacaccaaaacatgggccatgaaacaaaacataaccagaaacctatgagataagtttattttgccttcctcatgtcttgatccctcaaccacaaaacgtatattgcctgccccaagtgtaaaactagtgaaaaatgactcccctggtggtttttgacagtggtttcactgatgaggcagccttgtcatctgaaaaaatttaaaaaaatatgtcaaggcccacatataagtggcacttctcttcttccccctccaccactcacctctctcctctcccatctctctccccgcacaaagcacgacctctaccaagggacgtgcaaccaggggaggcaccaaaagcgcaagaggggcgtggaccgcagaaggatgcaggcacggaccgcaggggagaggctcgccggctgcggcgcacgtgtaggtgagggttcgcctaccacggtgtgcacggggggaggagctcgctggccacagcacgcgcgggggaggggctcatgagctaggacagcatggtgcctcctctatggtcagctccgccgacggcgatggctacagctgcttggcggcggcgttgccgacaaccttgccggtgtctggctgcttgagctcgccatgggaggagacctccgaggaatcctccttgagcttcttctccttcctcttggtgattagcttcttcagtcacctcttcttcttcctcttggtgggatgggtcatcaaatcgccgttgcagccgacgatgagatggctcctctcatcgctgtcggtccaaagggaggagatggagacctcgctccccttgtcgagatttgcagagctcaacctggtcattaccaacgccacctcccggatcgacgagaaaacgcgacagccacacaaatccagtagctcagcggtggtctccgccatgggagggcatggttggggccggcaacaggaggagtaggacctagcaggcagcagtgtcttgacatcgatggcagcgataggagccatggtgggagacagcggcacatggggttgttgaggaaaggggaaggggcggtgtcaccacagaacccgcgagcagccggccgacgatctcctccccacacacgtcacagctggctaatgaggtcctctttccacacgtggttgtctcactgcccgacgaggcatcgccgcctagttcctcttccgacaaaggtgccgacaacggccttccgcactcggagccatcaaatgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccataggcaaaactcaactggggtctgagccttggtcctctaactccatcttcagctcagaagcactacacttctgaaagggggaataatagcaagactgagtacaaccaccgtactcagcaagccacaccaacgatgcagatgtgcaaggggatacaaggatggtttgtggctatttgcataaaggcggttgtaaaacattttattgagcaaacagtaaaactgttgagtaattaaagtaacattaaatctccactaatcaacgctacaccacgttgaacaggcccaaccaacccacctgaactacagtgtattgggtcgatttattaattgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcaggcaacgggcagtcccctctcgtgccaaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttctagggcatcccgcgaaccggtccttaattgccatgggtgtgactagcaaaaccatgcacccacagcccaccattcagtcgcattttagttggataattacgaccatgaagcatggccagatgtctcgagcacacagctcaacaagatactagaatgtctaatactgcaattatcccatcgactgagctagtggtaattaagcatggctaagcatatagttctagctaggtcatcaaagtaacaccagctaggcgatttattacccatggttgacaaaggacagatgtcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaacagtacataaaaactaaacaaacatgtagagctcaattttagatgaattttgcaagttgaatggctcaattcggagttcgaatgaattaggtatgaattttagaagttttaagccatttaaatgaatttctagaattaaactcgatttattgcgcaattattatttatttttacaaaggaaaaaggctatgctgacgtcagcaaggggtgaggcgcggaccgcgtcacaaaggggcgggccccacatgtcagcggcaaagcccaccgtggaccgagtccacggcggcagccggccacgtgggcgcgcacccgacgctccggatcggccggggccgatcggacggccgggggcagccgagcggcacgaccaggcaggcacgcccacaggcggcggcgaccgccgagcctagaccaccggcgacgacgccggcggcgagcggcgacggcgcgagagccggcgagagagtggagagggaggcggttctcaccgagcgaatggggcggcgagacgaagacgaggaggtggccggcggcacggattaggcggtggcgggctcaccggggatcgaaaggaatggagcaccggtgggtttccggtggtttggagcggcgaccgatctgtggcttgaagcggccgagccggtgaaggaaacggcacggcttggcggtggccagggcgacggcagaggtgcgactggaggcacaaaagtggttgtggctcgggttcaccgtggagcgggcagctcgggggtggaatggaggagcggcgtggtggccgggcttgccggcggagcagcgaagctagtggtggtggcggcgcggcttgaggtggacgggaacggcggcaagaggctgccgaaggcggcgaaacggcggcggtgctcgggtgagcgatggaatcggtgtattgattgtggtttggggaaacggagttgcggacggtgtgcgacaatgcgtggcgaggccggtggcgcaagcggcgtggcgcggggacggctacggcggctgaggtggccggccggagatggcaaccggcggcggcggagggaggttggtggtggcggagtggtttcgggcatggggaagcttgggaaagagggggaaacggaggaggggagcccgggggtcgtttttatagcctcgagagtcgacgggggggccggttggcgacggatttgaagggggaaaggggcgccggcgacgtgggtgagtgggggcagtttggcgccggttttggaggggagaagtgggggaaatggtggaggaaggggatgacgtggggtggaccacgcccacacgcgcgcgggaatcggaagacgcgcggggaggggcggcgacgtgggcggctcgggcggccatggcagttgccggcccgggctggaggttggggatgacaggtggggcccacgggtcccacctgtcggcctgagtgagaggggaggccgggagggaggaaaagcggacttgcaccaaaaggggaggcaagccgggccgcgggaggggaaggagagaggattttgggccgagcccgaaagggaggaaggggaagtttattttgttttctttttatttaaattagtttaatgaacttggtgactttaaaattatttcttgaactccgaaaattcacggaaaaatccggagagtattttagggcacaaagaatattgcgaaatattcccggccaatgatttttaagggaaaattttaattctcccattatttcacttgattaaattgatttaacttttatttaatttctagaaaatacattatttaatgatttttaaacccgaacgaaaatcggggcgttacaaatctaccccccttacaggaatctcgtcccgagattctgggatggctagaaagaaagctggtgctggcaggcggtctgactgatctgcttacacatgctgcctctttctgattcaactgaccgattgctcgatgaaccaaacctgcataagcttgctattctgttgcttcccataaactgacggaccgactctgattagtctgaccttgaccagaactgctggtgctcatagaacttctatttttttttttggactgaattgctaatgctggcaattagataaactgaggattcactttgctgaccggggatcggtgtagtttttccgaaaccttgaaactgacttccgtaacccacagacaatgactttgctcgacttgctcttgattcaaaccacaagtattttcaggaaactggcttggtctgtcctagtctggattgcggctgttcctgatgctacttctttaagccaaacggttgacctggcctcaccggcgtaccttcgaatttaattagacaacttgggatcagtgttactctgctgacgccttgcagctggctctttcaagtactaaccaacttgctgcactgggttgaatctttaagggaaacggcaacaaggtgaaccaaaactcatctctgcgacctaccccctcttacagagagtagtcatactttcgcgtgaccgggaataattgaactattgtccttgaagaaaaatcgacacttctcgaatttacgaatggccctgactttgaaaatagaaaacttcaacgatcaatcaaaataaagcaatgacgatgcactttcatccaggacaagacttggaacttaacccttagttgctgataggaaattccacataaggaaattctcatttagcatatgatctttctaactcttgactacttccccatcagttctacggctggcataactagcatgcttctggactcgactccatatacttctgacccatgtattggaacaatttctctttcaacttctgggaaacctcatgagaattttttttttctggaacttatagcggttgccttgaactatggaaaccattcttgtttcataatcacaccactagggtgtaattgccgcttaccatcctgtaacagcttccaaggttagagagttcccaagagtctctatatgatgtcaccttcaaatattccatccctcttttcatttgagtaccactgatgttgcctttagagagatctcatcatgtcgagtgttgagggtctaaccattttcactccgttggttaatcctttctttactggctcgcaaacaggttttggagcacaacaaaagtgcgatgagttagaagggaaactcttggtttcttgtaacttgcagatacacaagttaacttgcttttgcatactcaaaggtgaaaaggaaagaaccgcttgactcctactctattcaatattccttttccaactatatcactagattggaacttctatgcgcgaggacggtatttgaacaccaaaggcctgtgcacaattgttgactcttgcttaccgaactgctaatcagtagcacatttacccattgtgattctgacatggttgacttgtccttttgttggttacgagctgaagctcccataagaacaaaactttgactgatgacgttcctaagacaaccatcaatcctcttggtagctgaaaggaacgagaccttctcactgttggtgcaactcttctattaatttcttgccagaccactgagctggagcagcatgaggtgcatggctgatgttgataaccacattgaagtctgatgcttgagacattgactgcagtcgctgttgaagaattgagctgtctctctgtagttaaagtagatcactgattccctgacattgattgccctactaatgctgattctgtagccttgaagcagttgctagcgaaacaatagaatctttatcggtgcccttgaaacccataccttctgtaggtatcacttgttgctcctaggattagtggcggcttggctgtgctggtctgctaagggcttggtggtctactgtttagggttgcgggtgcttgctcttggaaaacaaactggctttagctctgatcctgattccggcttgcatctgagcttgtacctgttgttggagacactgtcgttgcatttgctgcatcggactctgtggttgctgcatcaacatctgacacatccatcatctgaccttggctaaccataatctgaccagagcgaggtgctctgactcagctggtagcttgttgtctcggactgatccactgattctgacctcaacacactgcggctggagttactttcgctacatttgaccttgcatcaagctttgcatctcctgcatcaatacacccatcatctggtcttggacaccaaaagttaatcatgagcgggggttcttctggcattgggataccttgcagctttcaactgaaccatcgatctgtgactttaatacaccgtcgttgctcttctctctaacactgaccatcttctgcagggcggaagagaggtggaagagaggggttgctaaagataagaccttaaaccacttgactaatggtctgttgtgagtagatttttattgattcaagttgcttaagcaaacaacctagtatggtcgcatccccaccaatgacgcaaaccatacccctacacacaagcaaacaacacacgatctagaagctaacgaaactactcttctgggacagattgggtttaggtcatctctggggaaacttcacttgacctttgcggaacgacggctctggactgatcttcttggtccttgctgcatgaagctcgaggctcgacttgacttccgaacaggcatgacgctggcggtttgtcctccaggtttgacaactaaaagaattggagggacagggaagagaactttaaaagctgtttcgcaaagaaatgccgaagggcgagaggagacattttgcaaatagggttttcagaaagcttgtccttaggttttgaccgtttggctcaacctacagtcaagttggctctgataccactttgtcacgcccagaaatttaacccaaatttccagactattttgcgtattaaatccctgtccaggaccagtcagggtacacaaaacgacaagtaatatacagttccaaacgtaaataaagcgtaaaatacttacggaagaggcacttagtcctcacaccgaaacagaacgacagcagcggaaaaactcgatcctagcggggcttcagctccactccacaggcaaaactcaactggggtctgagccttggtcctctaactccatcttcagctcagaagcactacacttctgaaagggggaataatagcaagactgagtacaaccaccatactcagcaagccacaccaacgatgcagatgtgcaaggggatacaaggatggtttgtggctatttgcataaaggcggttgtaaaacattttattgagcaaacagtaaaactgttgagtaattaaaagtacattaaatcttcactaatcaacgctacaccacgttgaacaggccccagcaaccaactgaactacagtgtaattgggtcgaattatttattgtgagactaatca

SEQ ID NO: 59032 - DNA, 629 bp, Oryza sativa
gtgaagcagactctgaattttaactaagttgctaaattcaatttgatctcaggctacaaatcgcaaaaactctcattgactttcagcattcaaatcataaaaactctaattgatttcagcaattcgagtttttaattgttcaatcaatctttggatcttgatggtgctgatcatggaggcacagctagcagaccatggttgtaactaacacatatgcttgactgtactgattaatcaatgagagttttttggttgaactaatgaaatttctactgtagtcgagagaaatgacagctaaaagaacaaagtgaaatgaagaacgggctgctgctcaccgagtcgaggaggatgttagatgccttgaagttgctagatgaccagcgggtgagtgtagtggaggaagtcaagccccttcgccgtgccgcgggcgggctgaatcatccttatccatggcatgggaccatcgagacctgcagaccattacagcgcagatcagcttccccaagtctttttagaattgacacagaggtggcggcaacgaactggtggctagggtgaagcaatcatcaatttctgttggtgaaccttactgtttgtgtagtgctttagctgaaaccatctgaaggtgg

SEQ ID NO: 59033 - DNA, 37818 bp, Oryza sativa
gcatccctaccctccacttctacactcgctcgctgtccaaagagatgcggcaaattgagcttcgattatccctttggcataggacaaggttgtttccgccatgtcgatttcagtctcacatgcgacatggccactcagcctcctaaactcttcctgaacaatggatcgacagaggttcttggtgatattggggtagatggtctgaatatctattttatccacttcaacttaattccgatcacctccacccatgtcatccctataaattccggtggtgatgtctacaacttttcatggaaaaatccaggggattcttttacctttgcacgacagggcatgacatttgttgtcaccagctgtgacttggatgtatacatggtagatcaagaaaaaagcacacctattttgcttggcactatcgcttgtcccagcaaagagattgctgagatggtatacagacaggattctgaaggccctggttggtacactatagattcactaccagctcggacagttcagttacagtttgttcgtcacaagaccggtaatacccaaaagtactttaatctaaccatgttgtgggatagaatcaacattactgtgaaggccaaccttgcttggaatattgtggaccaaacaagatgcttgaataacatggaggatgacaggaagaaccatgcttgtatcagcaatcacagttcatgtgtctcctcgcagtatattgatgttggctatgcatgccggtgcaatgatggctacgttggaaatccctatattatggatggctgcaaactcgatgacggtaatttcttcatcatagcttttttttttttaatgttgtatcatatagtacctgcaaaagtccaaaatcagtgcctttatactcaaaactaagttacgcaaaaatagttttagtatatcatttttatacaaccctacggatataacacttcttctacatgctaactcacttgacttcttgataactcaatgctataaacctatatatttagcactaaataaaaattatcaagaaaaaaaatacaaatttagatttagcacaaaattgtttcatgcacaaagcaacaggtttattctataatatcacaaagctaagagggtcaactactaagagaggtatctgccccatgattaattaaggctctatttggtagtacaacttaaactccaagagagaattggatatcattagcttcaagaaatctagcttggagcttgagttatggctggattagagtttttaggttgagatgacttgttcacatttgagactagttttaaagatcaaactgctttactttaggttacaaacaagattttctccaacaacgtcttgttgttggaggcatagcaaataaaacatgccactatggttgaagttggagaaaaaaactatgaatattttgatatataaatatatatatatatataaatatatatatatataaatatatatatatatatatatatgcttggtacaatctcaagaattatggtattagtacagttaacagaaccacatctagtttatagctactctctccattttatattataagccgtttgactttttcttagtcaaaattatttaggtttgaccacgtttatagaaaaaattagcaacatctactacactaaattagtttcattaaattgaacattgaatatattttgataatatgtttgttttgtataaaaaatattagtatatctttgtataaacttggtcaaattttaagaagtttgactaagaaaaaagtctaatgactgagtagttgtttcttttatgtgggatatgtttctgcaaattttttctttcaaattttatactacatagcagatttttatggggtagaggtattacccacttgcatccctactagtgggctattttaagtggaatgatcgtagcagttggctgatggattccatatgtaaggcccggtttatatggcaaaatttttttgttttggggtgtcacattggatatacggacacatatttgaagtattaaacgttttctaataacaaaacaaattatatattccgccacaaaactgcgagacgaatttattaagtctaattaatccgtcattaacaaatatttactgtagcaccacattgtcaaacatggcgcaattaggcttaaaaatccgtctcacagtttacatgcaaactgtgtaattgtttttttatatttaatactccatacatgcgtccaaacatttgatgtgatgggtgaaaagttttttgttttaggaagtaaacaggcccaaagaattgctaaacttgttaaaagtgtagtcaaatgatactctagtgccacagttgttacataaatttgttaaatgtggattccatatttataagaatagctaaattgggtttcattaaacttactatttttccactatctcccggatcgaagtcttaccatttgatgcatttttcttcaatttagcttagccggtgttttacttgcaaaaaaatatattttgtgggcagtgatactagtgtccgcactacaggagaactcatcttttatccaatgccgcaaactacaattacaccggatgtagtaagaactgttactaaaatcactttattaccagttctaaaagcccaagtcctcaaaaatatctttagtttgctaaagatacatttttagtaccggctggtattacgaaccgggactaaagatatttttttttaaacatgcctctagggttagtttaaaaagaatgtatctctatccaagtcaaatttgtatagtaggtggaatggtaatacttatgagggttgaggttagagattttgagttcaaatcccatatcttcacatattttttgattttaccggaactaaaaattaagaactttagtcacgatttctttgtctcagttgctacaatcgaaattaataggggctgagaagtggtaccaaatatcatctctcctagtgccagatacaacatatgggattcgaacccaaaacctctctccacgtatacatttcttactttgtttcatacagggcacttgtgtaaaaagcatctgatattcttttgactctttaatttggtccaaaatttttaatgcatatttgacactatggatgatttcaaatgaaaaagttatcgactgtaaattaggtcatagatttcgtcaagctctacagcgtactttattatattatatgtgcacgtctagtagatattctccaaattgacttgagcatatctaatgcatactcaggtatataaacaatctcaaatattaaagttgacaagtacgtacaaagtttgttgatacaatattgataataaaatgtgttttgatccagcttcatgtctagttaataatcttttaaaacaagaaccattatttaagtatgcctgttcctgacttcctatccctgccggttcataggattacattgttgattctaaaagaaccggtagtgatgggacggtttggaaggccatttctacaatagcgtgtcaggtataatatgacataaattagtaatcccttcatcccaaaatataagcaattttagaatagtgataaatcaaatatttttaactttgactattaatagaaaaaaatcaaacatgtaaaaatgatattactagtggatttatcattaaataaaccttcctacttggtacctggttaattaaaaacatcttgtttttaagaaagacttgatgggccaagtttccttttaaagacggtgtatgaacctaaaattactatatgttttttaaattgagcgaagattcgcttgctatctatttgcatctatgaaggccatgtttagttcccacgcaaaaacttttcaccctgtcaaatctaatgtttagacagatgtatggagtattaaatatagacaaaaaaaactaattacatagattgtgtgtaaattgcgagacgaatcttttaaacctaattgctctatgatttgacaatgtggtactacagtaaacatttgctaatgatggattaattaggcttaataaatttgtctcgcagtttacacgtggaatctgtaatttgttttgttattagtttacatttaatacttaaatgtgtgttcgtatatccagtataacacgccaaaacttttcacccctgaaactaaacattgccgaaattatttgcttgtatcgactgttatatggtctcggataatttaaattttgttcatgtaactcgcaggttataacccaagaccacaaaaacataattgctctcgacaatgtggaacaatcgttgtcccatttccttttggccttgaagagggttgtgccgccagggaagtgtttcagctctcgtgcctaggcaagccaaattctgtgctgcagtacaatgacttcatcggtgttcagtatataaatgtcagtgaggggcttgttggcattaaatacaactcatctttcgtggagatcttattcaatatgttttcgcaattcagattttcatctcaaggagtagtatccaacatatttggtaaagggcctaacctgtatgtggatccaacggaatcagcctcggtgcagtgggcagttgccaatctgacctgccaacaggcgcagcaaaacacttcgacatatgcttgtgtaagtaccaatagctcctgctccagggtcatcagcaccatgcaaggttatgttggctacaggtgtacttgtttgcctggttatgatggaaatccatatatcccagatgggtgtaaaggtaattatctctttgaccaacttagaattcaaccagatgggatacatatatatatatatactatatcctcttatagttttctggtgtggaattctgtcttgtacaaatatgaagtctctaattttaatgtttcaaatatttttattgaataaacatttactgaatagttatttgatcagttattgttacactatacattgacatgctgagatatggttgcagatattgacgaatgcctacaaacaccacggattgcaaggaactttgccacaatactgaaggaaactacagctgcaccatgtgccctgatcatacagagtatgacgttataagaatgcagtgcactccaagaagaaaccaaagtctcttgttaggtagtctcataataatcaattccacactgacaaaagggtgtatgaagatattacaaatgcgatgttatcattgtaggtattataattggccttaccattggatttggtgtgttgattcttagctcgattgtaatagctatcattagaagatggaaaagagatgtccataaaaaaatacggagaaaatatttccaaaagaaccaaggcctcctcctagaacaattgatatcatcagatgaaagtgctagtgagaagacaaagattttctccatagaagagctaaaaagggcaacaaataactttgattccacacgtatcctagggcatggaggacatggcactatctacaaaggtatcttatcaaaccaacatgtggtagccataaaaaaagccaaagtcataaaggaaggtgagatcaacgatttcatcaacgaggttgccatactttctctaataaatcacagaaatattgttaaactctttggatgttgtcttgaaactgaggtccccttattagtctatgactttatcccaaacggttcattatttgaacttcttcatcatgattcaagtagcacattcccattgtcatggggcgaccgcttaaggattgcagcagaggccgcaggagctctatgctatctacattctgcagcatctatatcgatcttccaccgtgatgtgaagtcctctaatatactgttggatgcaaattataccgctaaagtttcggatttcggcgcttcaagatctgttccagttgaccaaagccatgttgttacaaatgtacagggcacgttcggttacttggatccagaatattaccaaaccgggcagctaaatgagaagagtgatgtctacagctttggtgtggtactcttggagcttcttctaagaatgcaacctatttttacaacaatgtcagggatgaaacaaaatttgtgtacttacttcctttcggagattaagaccagaccaattatagatttggtagatcctccggttcttgacaaggcaaatgaagaagatattagacaagttgcctcccttgctgagatgtgcataaagctaaaaggtgaagaaaggcctacaatgaggcaagtagagataacactgcagcttttacgaacagaaaagatgaccccatcacatgttagtccagacagaaaccaagagatagaatcactactgactcaaggagccattgaccaagtgattcatgctttagtaaatgttgacagagctaatgtagcatctcaacgctctcaaacctcatgctatagcttggagaaagaattcttgtcatctgctagcctaccacggtagaagtgtttatcctttgtcccttgtgtttggcgttctttgtacttaaaacatttcctgtgttcatagcacaaatttacatacatgtgtaccgtttatattgtaatgtttgtatatggtagttgtactcggttcagtataaaccacatcttaatgtatggactcaagaatgtttattgcataatattaatttagaggattaagttagttatatttttagacggtgaagtggcggtgcttcagctctgtggaaaacatgctggtgctagtcttgttatattattttttacaaaaccaatctactgatattgctccagctgcttccagatcacatggcccagccggttctagtgagaaggagatgaaaatactgtaaaacaccaaatatttaaaatgccaatataactatttcctccaagcttcttctttcccttcaagcacctgtttggacgagattctagcagctacaacttctcctagaatcagaatcttcccaaatagtctagcttttgtccagattctaaaaagttgtagtcgtaaaatctaaaaaatgaactagaaaccgaaaatttgaaaacctagtttctccagattctcagaggatagctacaaccagctttcttggaatcataaggtccttcaaataggctctcaatctctcaaatttttacctgattcctaatgcatcttagtgaaagcctccttctgctatagtgctataagcctagcacttgctctgcataggactcgttttgggtgtcagggcataacattttacagtctataagagaacagtgcagcttcagtagaaatgtcaccacctcaaaagccaaaaaagcataggaaagatgataaatctaccattttgggttttggtagcacaattattgtagctaccattgaatactttgtgacactgaagaatttctttgtggctaactggtttactttacttacaaaagtgaaccagcttttgtgtctcatacaatgaaaccaaacagatgttaggaaacaaagcaactcacacgaatacaggctacactaggcaacggggaagaaacacaaacacaggcaaacacacatgagagctttgtggcaccgaaacaacttgtgcctttttctctttttcttctcataaacacaagctagttatagatatatatactccgtatatagaaacacatgtagtcacgagctggttagcacgtgttccactaactacattctcagccagtatacccggtaactaaccactaactaaacctctaagctaatgcatattcacacaactcagtctccgatcagtgcatgcatgcaaactgaccatttcctactcctaaacttgtgctcttacctcctggctgtttattggcgcactactcactaagccacgcagcaccaacgtacacagctagctctccacgccatgcaacacacacgtatgcatctagataaacatgctgatattaaaaaaacaacagattcgtgtgcagcattacagaggtaatcaagattaatttataataacagattcgtgtccagactactggagaaaccatctttcgtcggtcgtccaaaaaccacaatagtcccggttcgaataggaaccgggactaaaaatgtttgaccaaccgggactaaagatcatttttagtcccggttcaaagaagttaccaaatctagttaggccccaattaactttagtcccggttggtataaacaaccgggactaaaaatatatctttagtcccgtttgtttatcccaacaggtaccaaaaatcctcccaaaccgcgcgcgcgccaagtccaagacttatcgatccccttcccttcctctctccctctttaatatcggcctcatctcgatccaaatccaaccgcgtatgcacttcccctctcctctccccttcctccgcttcacctctccggatcccccctctcctccccctccctaccaagtcctctcctcttgctctctgggtcggcggcggccgctgggtgggcgcgatggcgggtgggtgggagcggtggcgaccgggcgggcgcggcggcggcctcgcgctcccctccgccagatccggagcggaggggatggcggcagcggcggccggtggccggaagcgccctctccagctgtgcgcgcatgcatggaggccggccgggcatccctctgccggagatttgtcttcttttttaaaaaaaaattgtgattcattgtattgattgagatgaagaatttgtgattcgttggatggattgagatgcataatttctttttttgttgagaatatgtaattcattgcatggatatgagatgtataatctgtgatgtatttgatttgtggtatttgggatgttagtttgatttggggatatacatcccactggatttgggagaaaatcactagaaaaaaacaataaaaaaaaagaaactaatcgggactgccgctgtactctttagtcccggttattccacccgggactaaagatatccatcccggatttgtaatcccggttggaaaaccgggactaagggggttcccaaccgggactataaaaggtttatccagtagtgagtagtggcagcattacagaggtaatcaagattaatttctaacaacagattcgtgtgcagcattacagaggtaatacaatcagaatttgggccatattcaggttcatgtaattgtttttttttttttgcctgctgccttcatttcatcaaggactaagtctacgtgtctccctcatcaaatagcatccctcaactataaaactgggtataacacctccctcaacgtaaaaaaaatagatcaaagataatcccaaggtagtactaacccggttttggccacatggcatctacatgacacttctcaatgtgaaaatcgattattgcatgcggccaataactcgctggctgtttgggaagatcgtgtcccctatgtgatataatacttcccgctatttctaatctaaatctgaaatactatgcatagaacctaactgagttattgttcttagcatataataattagaatttttgcattgacaaataaacaaactttccatatataaaacagaaaacatttatatacatatatctgttagtgatatgccctagaggcaatcatagaaatgattgtatcacatactatgtttacatatttatccgacattgttccttgaaatagataactcattattggttaatgaatatgtgattctttcatgagactctttatgttgtttgttactatttctaaaggatccctgatcaaatatcatatgtggaacaaatatgattagatgatcagcacatgtattaattgatgatcgtgtctcatggatcatggtatagagataccaaattaataatgtggacacatgttagtgaacatgttgttggatagacccaacatgagacactgcaagagccatatgtgttgtgtcattagtgatctcatttagtgttggtgttgaatccttagacctgagattatcatggttcccaacatatgtagtagcttacttagggactgctaaacgctacttcgtaatagggtagttataaaagtagttttcggttatgctatgaaacatgtagtgagatatgaataatcaagatgggatttgcccgtcctatggagagatatctctgggcccctcgatgttgtagattatggaagtaaatggccatgccacaggtgattgaggagtcaatcacaagttatataatctatcaacaagttcgagtgaatgattgagctattagaggatggcacatatctagccttgagcttaatctatatcgtgaggcaaaggggttcatacaagtatacactagaggttcagccgatatgatctttatgtatgcccggtgggtcaatacgttctgctaggggccgctgttgacacgtggactgaaaaggagttttcgggttacagccgagtgtacatgaacctacagggtcgcacgattaatgggccagaataaggggattggatggagatccaatatgagtttaattcggacagggatccgaataggagtccaacgggccttggaggcccgagtgatggatcctatatattcgtgagaggtgtgaccggcggaggcattgcatcacgtgagaaactctagccgtcacttccctccccgagcaaaaccctagccgcaggcgggtgctagcacatctgcgcgtggcgttccgtccctgtatgtgtggataccggtagaggcgccactggtttgcggtgctaattggtgtgggagtacggcgaggagaacgcacgagaagaagaaggtcgagtcggtgcgatcgactacttcctctacatcgatgcgcgctacttcgcgagaattccttcgacttcttagcgcccttttccgctgcgcagcgcgtcgagtgctaacgatatatgatctaatacttgcatggttcctggtttatgtgatataaaattttgatttatgctatcgtagcctacgcgtatcccaacaatatctatacatttaaacatttctgtcccaaacattacaaattagcgattgtttcaacacaaacgaaatagtaaatttttactgcatatgttctttccccactctcttaggggcttgaatttatcttctaatgccagctgactctcattgtcgtaagattgccctagtgcgttgcagcaatcacagcggataaagtggcaaatgtcagcgcataccttcataattgttgtgttgtcgaaccggtttgctacataagagatttcaggggtctgaggaaaaaagacaataaatattacaaattgaattgcgatgaaatattctgtatagagaacaatgttaggacttacgtgattgatgtttgttgtgtacctcctgttgaccctaagcatctccaacatgtaatacccacataggttagtgctcgagggttgcttgaagcactgcgaacataataattacaccggtcattataaacaagtaatcattcaaagaatttgtgttcatggaatatgtcagtaccaccgacctatcttgacgtgtagctttgtcctttccggatcctttactgccccgtgatgtttgcggtaaaacctaagtgtgctatgctaataaaatatttgtttgagttacttaaaaattctagagggtaaatttagaattgtgaggaactccatgaaggtttccttgttttagtgtgtcgggtcgagtgctacaaccgattagtccctcgtatatactacgaataagatatagtggtcgctacaaacaagaaagatttattagagacttcatttgttattaatgatgtattactacataaataatgatgaattaagacatttatgtctttgtgcgagagcgtcccaagtatgtcgctacctcggtcatcttatccttgtgcaatttcttaatgtatgcttccttttcctccgatgtcttatccttgtgcaatctccgtctagctctcccctctcttccaggtgatctctaggccaacggccggtgaggagaggaccagcggccggtgagagaagaccaaggaggcagcatctcctgtctcccgggtgtggaataaggagggccaagacacacagatcatgcgcgcatgcgtggattacagctgcatgctccaccaccgcgccccaccatagcaccagcgcctcctctagccctcctgtggccacctgttggtattttctactatcatagataaatacgtaagaccatgaatacttctgtagcacttcaccttagagtatttcaagggtatcgaatcacaggaaacgtgtgtctatatctaacaacaaaatcctctccgagcacaacaacaaatggtaggcttcggctagagggaatgcatatggtttaattaaggaaaaagtacgaattattcccccgccccctgaactatcatggtcaaccgaattacccccataaacccaaaaattagacaacgttcaccctcaactttcaataccggacaaattatccacctcgaaccaatctagagcggttttgtcctatgtggcatacgcgtggcaatctagttatcattttatttattaaaaaaatatgggacccacctgtcgtactcctcttccccctcttcctctctctcttctctctcccctcttctctctctctctctcagaagttgccgagagcaaccggcgatgggcgcggcaggtgatgggcatggcgggggcatggcgtgcggcgagcggcgagcatggcggatctccccaccaccgtttcctgttctcccgctgcccgccaccggatctccctgccaccgactcctccactgccgccgccccccgccagatctccctgccaccgacgcggcgacgcctcttggaagccgtcgccgacaccgcttctccatcgccgacggggttcgcctccacctcagctgggccatcatcgtcgaccaccctacccaagccatcactgcccgctaccggcgtcatccacatcggtgcaccacaccctcctccaattcctgatccaccgccggcctcccttggctgagtcatcaccgcccgccgccggcgccatcctccgcatccctaggtagagggcgggcccgatccaaccggctgtgcccccgccacgcccgctgcccaccgcgcccccgccatgccagccgccggccaccgggtcgcactcacgacgggcgtctgagagagagattgtgaggaagaggggaaagtgataggtgtgagtgcatgacaggtgggccccactatttttaaaaaagaaaaatgctgactggattgccacgcgtacgccacataggacaaaaccactatggattgggtcgaggggggttattcgtctggtatagatagttcagggtttaaaatatccggttttatggttcaggggggataattcatactgttgtcatagttcagggggtacttcgtacttgttcctttaattaacaatacttaagttaaaggtaaaacactataactctatgacataccgaccgtttagggatacaaagaatggacatggctatcaccacctgctgcctccctcacttccaggaagcacacaacaaacgaaggtaaccactaacctagaccaacgtctaagttattgattactactccagcctcacacaagaactttcttcttcatctagaattctagtgctggagcacttaaatactaggcgacaaacctgcaatgatggaaatatatctcactaatatagtaaattaaataccaaaaggaaacctcaaacacttactttattaaaagaagcattcgccgaggtacaaacgagaagagagcgccgacaattcaggcactcctccggaacttctcctcactctctacctaatttcaacactactaaagtgagttctactccactttgttgtgtttttgcgattgaatgagttcctccttttatagcctctaataaaggttggaatgacggttgtggaggtcagtgcacccacaaccgccatcaccatcaaatgtgcagctgccacgtgcaagggggtggccagggtgccatgtttggttcagccgaaccaggccgccaccttcagccatcgaccttcttcaaggaggttggcatgtggggccttatggcgatgcactgtggataagaccctttctggtcgattttgactatcatgtgggccctccaatccatgtgctcgcgtatgattggctggaggtatatttcgttgcatggaggatgtaaattctttgaaaatcacctacatgcatatatttaccaatacaagtggaaacaattagtaataaacccctaccattgagtttaatattaaatttaacaaccattaacaatacccccacaattatcctttacactcgctgagtgaagctcatggatttcaacagtgcaaggacttcctgtataatggtacaaacgtacaatgtattccagaccatacctggacccgtgaactttgaagtgtctaccatatcatcttgggtgcaatggctttgactcaagttgcattcttcccttgttgtcaagaaaatagtgagaatgaggcgatgttctgaagagtgtcggaattgtcggtgttctctgctcgcttgtacctcgacgaatgcttctttaataaagtaactgttcgagaattccttttggtattaatttagtagattaagtgagatatactcccatcgtagcgggttcgtcgcttagaaattatattaactgctctagtactaggactctggatgaagaagaaagttcctgcacgaggctacagtagtaatcaataacttaggcgtggtgtctaggttagcgatacatttgtttgttgtgtgctccacggaaagtgtggtggcggtaggtggtgacagccccgtccgtcctttgtatctctccatgtttgggtacatcataatgctacaaaccagactctgcttggcagactaggggagagccggtgcccaaagcaatcgatagggttttatctttatctttggtatagttaattaatccaaaggaaacctctctttcctaagcctaccattaggtattgtttttggatagaatttagttcctagatatacacacatgttcccgcagattcgatacccttggaatactctaaggtgaaggtatatagcggtattcatgcatttacaaatttatctatcaccgtaacaaataccaacaagcatttcttgtggcgttgccaaggaatggttgttgtatcatcttcaaacttggttcatcctctattttttcatttattttattcctctcttattaccaaccatagagcatcaatctattcaaaacttttctgctccaaagcgcgagtcctgtgaaccacctctttcttcaaaagcaattcattcatctagctatgaactccacctaactttgtagccatggttcggcaacaatccttctcgggtgttgatggttgttaagtaccaattccgatcgccaactagcacaatgagtaaagggaaaattagcatttcgtacatgtataccaataataaataatgtagatgtattaggattggtgaattaaattggttgcagaaattatacacaaaagtggaggagaaatgatgccggcatgcaaagaaacacacttgaggggcccacgagtcagctcaaaccgactcaaattgcggccaaccacttgttatccaccgaccaaagtcggtggagtaaggcggttactctagtgcgaactaggcctggcgtcgctcatctccctcctccacatggacgctccagatgatctcctattgacgattactatataataggtcggtggcctacaaaccaccttaatcaaccgtcactgaagcgtatttaaggagtggagattctcacttcacaacacacacctcaaggagcaattccctcttccactttgtaatctctatagtttctagtagtaataaagtttaggagcttctatcctgtagacttcctggagttctgggtacgtttctagtactttcctcattttataagactatggctgaattaatagaattatcttctttatttatttatgctcatggtttatatatttatttattgagtatgtgttctaagagtagtgtatgctttgtatatctgcttcatcctaggctagtcgatcaatgttacggtaatggtccaatgacctttataggttgctctagcttcaacttgttcatcggtaaggtgaaagtcctgaggagttagtgatattatttactggcataagcatggtttttaggctatataaatgccgttggatgcgagtctgccccacggaaaagtgaggtaggcagcaagtttgacagccatgtccgtcctttgtattcctcctcgttcgggtatgacataagagtgcgtaaatgccataaccacgctggcagaccagcagggagtggtctctcggtagtacctgggtgcatggaactatgtcctatgttgtaactgttgacggtcgttatcgatcagttttgaccgtcaatactaccaaaataggagagaactagtgatgcttgcaatgcataaatatgttagagtaataattttccactagtattaggtttactaaccttttgcagagaatgacaataaagtggaggagaatcgacatcaacttagatgataaatcaataggacgatgtcgagaaccagacttatgaatagatgggccaagaactcagaactaacacgatgaattgggccaaaattcacaagtatgcggactggagcaatagaggaggccaccagccgaaattgggctggattgggccagccccaggatcggccgaggccgaaccaatcttggcgccgttggatctaggttttggagtggacgtccaggattgcatcccaataacgattggagggcactccggagaattccccttccacaaccgtcataactacctttatataaggagctcactctcttcacttcacacacacctcaagcaatagctctctcttacgtcaaaaaaatcaatagccctctcatttctctcaagtttagtttagtagtatttagctggtggaataggaatagagtagaaatcagaatccggaagccttcggaagagttcgagtatggctctagcagcttttctcttctcttttgtaagctttgtacttttattagaatactcttataaatacatttatggtattgaaatactttccaagtatatgagtacctactttacgttatgttcttgttatattgtatgtacggctagcttatttaggagatgctttggtgcgggtataatgtttgcttgtgcaattactctatgtcatgacgatgatattagagtagtatctggtagtttaggcgtggtgtcttagattacgggatatcattatttggggttatatattgcggatgagtggttggccgctgatggtgacaactcagtacggttattcctccgggcctatatataatcctaagttaattccctggggagggtattcctccgtatttagccccggttgtatggtcatgacgggctgtcgtaaggaactcggcagtcaggggtggtttctcgacttactaggagggcatcggaaagagggtattagctagtatatcagttaaataggatgtatgtatactatgtatattagaagtataggaatagattatctttctcttttctttccacctagcctagataatatatatattgagaatgagtagttaatgcttgtatgccactctacccttggattatcttaacccctgcttagaatataattatcacaagcaatgcataaattattagtccagttctctctacatgatcttcccacgagataaaatatgatcttcccacgagataaaataaatacgatacccttggaatactctcgggtgaaatgctacgatggtatatccgtgcgctcgcggatgaactctataaccataatataccagaagtatttctgcgccattgctgggaattatatttctagtaatgtcgttaagaaaatagtaaccatggataagttaagtgtatactagacatgattactataaaagtacatatgaatcatagttacctaaagaaaactccgtactagatatttttatagacgtgaatcccttgtgtgtgtccactaccatatcattatttatcctaacctctgtttagactatggtgaattaattatacattgattaagagatataaaagaaagaacatatctttatactgtcgccttcccagcgaaaatataaatacgatactcctgggaatactcttgcgaatttatctgtgattgtaagaaataccaatatcgggcgcgaaagaaaaaatccctaccatcatccgcatgatcctgagcaattatattcatgcctaacaatagcgggcatgacacaagaaaccttaaagtggaaatcgtttcccttctttcttacagagggggcaaaaaagtggtacacccataccttaaaatattacatggcgaatgagaggaattaaaaagcaggttctgccttggtgtcttcccactaacgcgtgtagtctctctacgtatggaggttctctgcttccgacaaaatgagaaggaatccatcggtgtagcctaggctcggtttttcttcttaactcaagatggctagacttgtctctgcccgatcatgtgttgttacaacatttttggttgggtttaggcaagccatgtatctcgttacatccaccggaagttcgttcgcacacaaaacaacatcaaaaggaaggaaactcttatatcgtatcctggagaacacctctttcgtttgttgcgacaatatccaggaaatcaaggatacaaatgaggagccatcaaccgtcaaatcggaacatacatcctccacatttcaaccgttgaatcctcacccaaaccatggaaacaggacaaagaagaaattcagccttcaaaattacctttcctgtttgtgggtaactttttttttgaagattatggaaatacctcaaactattcttgccaaaagagaccaccagtctcgtgcagttctcctgtaccactcgagaaaattttcctcaaagatatggtgtaggaattaactaccgtcatgagtgatgagtggttaagggaggtggaactttcctctcaagcaattcagatttttgttcccgtccttaactattccttgcctcatgagagaggtcatggcgcaaaccctttataatcccactattggttcaaacattatgtccataacctttgcattaaatttcttaggggatgaaccattagcaccaatggataaaaccttccgagcccatctattcctatcatcaaaggtcatgttactcttcgttgtgccaataagacaaaaagatgtcaaggctatcctggattttcatgcattcaaattctccaaattctatattctcatagaccatcccatagaaaaacttcttacagatgtgccgcaaaccggtgtcatcaacatcaaactcgggataaatgtgtttccatcccgatcttatgatcgtgaaactctttgacagaacctataccccgatttcgagccaatcgaggaagtgttggctgtagattgtggttaagtatcgatttcgactgtcaactatgttaataaataaggggagaactagcatttcttatacgtatatcatttataaataatgtagttccacctgtattgcagaaatactacggatgcaggaattatacactatattaaatgagaaatgagctagcatgcaaagaaacacatgtccggcgaatcatgtgcgagcacacggattaatggtcccacaagtcagaccaaaccgacttaaagtgggaccaaactctcgtgcactgaccaaggggctcacctgtcatccactgaaggcggtttcccttgttcggccaaacttggagtggcacccctcggccccccatcctccacgtgtcaactccataactactcttaatgacggttaggggggtgcactgacctccctaaccatcaagtatcaaagtatgaagaatggacagaggacagtgctctgacatgtaatttttgtgatgtctattatattctttggaattctgtttacatgcaattttttctgtccctttttttatatttagagaggttttttttcaactacaatttgtagttgcagacatgcagctatgctagttgcacttccggatgttgtagttgacgttataaattttatgcaagttcagtgataaatttgtgcaactaatgttttttcatccactctctcccatctgctttttttttatcgatttatcactttcttgtttctcttctccccgtgggatgaatctggtgcttttttcccactagcttcatgtgaatggcaaaagtaaccccaattcgcatgcgtacccaggaaattagtttattgtgtcggcccacaccaaaacatgggccatgaaacaaaacataaccagaaacctatgagataagtttattttgccttcctcatgtcttgatccctcaaccacaaaacgtatattgcctgccccaagtgtaaaactagtgaaaaatgactcccctggtggtttttgacagtggtttcactgatgaggcagccttgtcatctgaaaaaatttaaaaaaatatgtcaaggcccacatataagtggcacttctcttcttccccctccaccactcacctctctcctctcccatctctctccccgcacaaagcacgacctctaccaagggacgtgcaaccaggggaggcaccaaaagcgcaagaggggcgtggaccgcagaaggatgcaggcacggaccgcaggggagaggctcgccggctgcggcgcacgtgtaggtgagggttcgcctaccacggtgtgcacggggggaggagctcgctggccacagcacgcgcgggggaggggctcatgagctaggacagcatggtgcctcctctatggtcagctccgccgacggcgatggctacagctgcttggcggcggcgttgccgacaaccttgccggtgtctggctgcttgagctcgccatgggaggagacctccgaggaatcctccttgagcttcttctccttcctcttggtgattagcttcttcagtcacctcttcttcttcctcttggtgggatgggtcatcaaatcgccgttgcagccgacgatgagatggctcctctcatcgctgtcggtccaaagggaggagatggagacctcgctccccttgtcgagatttgcagagctcaacctggtcattaccaacgccacctcccggatcgacgagaaaacgcgacagccacacaaatccagtagctcagcggtggtctccgccatgggagggcatggttggggccggcaacaggaggagtaggacctagcaggcagcagtgtcttgacatcgatggcagcgataggagccatggtgggagacagcggcacatggggttgttgaggaaaggggaaggggcggtgtcaccacagaacccgcgagcagccggccgacgatctcctccccacacacgtcacagctggctaatgaggtcctctttccacacgtggttgtctcactgcccgacgaggcatcgccgcctagttcctcttccgacaaaggtgccgacaacggccttccgcactcggagccatcaaatgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccataggcaaaactcaactggggtctgagccttggtcctctaactccatcttcagctcagaagcactacacttctgaaagggggaataatagcaagactgagtacaaccaccgtactcagcaagccacaccaacgatgcagatgtgcaaggggatacaaggatggtttgtggctatttgcataaaggcggttgtaaaacattttattgagcaaacagtaaaactgttgagtaattaaagtaacattaaatctccactaatcaacgctacaccacgttgaacaggcccaaccaacccacctgaactacagtgtattgggtcgatttattaattgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcaggcaacgggcagtcccctctcgtgccaaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttctagggcatcccgcgaaccggtccttaattgccatgggtgtgactagcaaaaccatgcacccacagcccaccattcagtcgcattttagttggataattacgaccatgaagcatggccagatgtctcgagcacacagctcaacaagatactagaatgtctaatactgcaattatcccatcgactgagctagtggtaattaagcatggctaagcatatagttctagctaggtcatcaaagtaacaccagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgtgatcttccgaaacgacgggaactacacgctggcacgcaaaacgaggaaaaactctaataaaaaccaagaaaacagtacataaaaactaaacaaacatgtagagctcaattttagatgaattttgcaagttgaatggctcaattcggagttcgaatgaattaggtatgaattttagaagttttaagccatttaaatgaatttctagaattaaactcgatttattgcgcaattattatttatttttacaaaggaaaaaggctatgctgacgtcagcaaggggtgaggcgcggaccgcgtcacaaaggggcgggccccacatgtcagcggcaaagcccaccgtggaccgagtccacggcggcagccggccacgtgggcgcgcacccgacgctccggatcggctggggccgatcggacggccgggggcagccgagcggcacgaccaggcaggcacgcccacaggcggcggcgaccgccgagcctagaccaccggcgacgacgccggcggcgagcggcgacggcgcgagagccggcgagagagtggagagggaggcggttctcaccgagcgaatggggcggcgagacgaagacgaggaggtggctggcggcacggaataggcggtggcgggctcaccggggatcgaaaggaatggagcaccggtgggtttccggtggtttggagcggcgaccgatctgtggcttgaagcggccgagccggtgaaggaaacggcacggcttggcggtggccagggcgacggcagaggtgcgactggaggcacaaaagtggctgtggctcgggttcaccgtggagcgggcggctcgggggtggaatggaggagcggcgtggtggccgggcttgccggcggagcagcgaagctagtggtggtggcggcgcggcttgaggtggacgggaacggcggcaagaggctgccgaaggcggcgaaacggcggcggtgctcgggtgagcgatggaatcggtgtattgattgtggtttggggaaacggagttgcggacggtgtgcgacaatgcgtggcgaggccggtggcgcaagcggcgtggcgcggggacggctacggcggcggaggtggccggccggagatggcaaccggcggcggcggagggaggttggtggtggcggagtggtttcgggcatggggaagcttgggaaagagggggaaacggaggaggggagcccgggggtcgtttttatagcctcgagagtcgacgggggggccggttggcgacggatttgaagggggaaaggggcgccggcgacgtgggtgagtgggggcagtttggcgccggttttggaggggagaagtgggggaaatggtggaggaaggggatgacgtggggtggaccgcgcccacacgcgcgcgggaatcggaagacgcgcggggaggggcggcgacgtgggcggctcgggcggccatggcagttgccggcccgggctggaggttggggatgacaggtggggcccacgggtcccacctgtcggcctgagtgagaggggaggccaggagggaggaaaagcggacttgcgccaaaaggggaggcaagccgggccgcgggaggggaaggagagaggattttgggccgagcccgaaagggaggaaggggaagtttattttgttttctttttatttaaattagtttaatgaacttggtgactttaaaattatttcttgaactccgaaaattcatggaaaaatccggagagtattttagggcacaaagaatattgcgaaatattcccggccaatgatttttaagggaaaattttaattctcccattatttcacttgattaaattgatttaacttttatttaatttctagaaaatacattatttaatgatttttaaacccgaacgaaaatcggggcgttacaaacctcccactgcggcggcgcactctgaccccaacctctagttctctgagacaggcgatgacttttagggtttctagtcaaggtcgccatgaggtggcggcgcggccgccaccaccaccctttagtctcgcatggggagaatcggagaagggaggagaggaagaagaaagggagaagtggggttgacaggtgtgtcccaccattttttatttttactcttgtcgtttacatgtgagaccctttttttattatttttttattttttaatgactgagatgccacatcagcatactcggacaagtcaacatgccatgtcagcaaaaaaaaaagctttcaaaaccactaaaggagttaatttgcactggtttctgggagacgtgttatacccggttttacagttgactgatgcaattcgacgatgggcaagacataagggactcaaaatagacttactccaaaacctattggagtggacgggtgaacccgataatgacccaagagcccgtttaagcaggattagtgatccacgggccactttttgctattgttgtatagctattggatgtatatatccaacggttagtagaatcgactaatggatctgactttttacaggcgattgaccaatagactgtcccgtattattacacaggcaaaatatagttccaataaaatcgcgtgaaaatgctactacctgacaggtaaggtgtggaagcgagacacaaacagatttgtctccaccaatcccctctcaggccattcatttcgatatcgttttctcgaactggaaaccgtcgcgaattgggtcttgcttgcaaattgcagtggtcgattattgcctgcccttgtcatcccctagcagaaacgtagtggtaacgctaacgtcgacgacgaacttaattagctgtactccttccatttcatttctgggtttcaatctgtacatataagtggatttttttaatagagagaatcagagagccccgtatgagtgggtccaatcggaagttagtttgtccggtacattacatgtcacgtactcgcatcctatcccttttttttcccatgcgtcaaccggtcaaacttggtgacgacaagttttgtgataatttggcaagttgattgtcaatacaagtatcaaatgtatggatttgatactgatatttgatagtgttgaatgctagagaacatgggattactatataatgtgaattattatatttaatcttaggagcaagtatacatagcagtatattgacagataagggaatggactagcgataagaaattactggaaacaaattaattgtattcttatattcctgtaactatcatatttatactcttaagcgcgagtaacgcgaactattttttttgattggagaagaaacaataaaagtgttcagcacaaatgatagttatttgtgcggtagtcgatatagccaaaacatgtatcatgaaggcaatggcaatgcgtccttcattctgtctgacctgggctaccaagtagacctcaagacataaggcccacaatgcattttggcctcgaatcagatccataaaaatctaaagacagaaattctttatctttgttgcccaggctccaccaacgcagtccgccgcctcgttttcttcttagttcccacggcgccactaacctttgcaaaaccgtcgacacagctcctcctcatctcggccgctccccttcccccatgggcggcgccgctctctccctctcctactggcagcaccgatgtgcctccccccactggcaacgcatctctccctccccatctccgccgcttcccctccccatctccgtagctcgaccgagttggcagcgactcgacgacggccactccataatcctcctcgcaagatccggcctgagagttgccggatctggccttggaaggcggcagtggtggcacaacgacagcaatcccatgcccccttcacggtaggcgtggcctcgatggcagctgctgccgttcaacgacggcggggcggccttgacgaaggtggttgcagctcgatacgatggcggtaaggggaccgtggcttcatgtttgggacacagcctcaccaacgttatttcgcccttcttctcgcgcgtcacggggatacgtcctgacaggttctaacgaggttcaggtggccaaatgaagctccctgatcttcacaagggctcgctgaacgccgacgtggcttggaatctccgaactggcgacgtgagggcgaacgccacctcaccgcactgtgaatggcatgacgtaatcgcgatcgaggtagccgcgtatggaggagtcgtaattaatgtagccaaaatgaaagtatggatatcgagatagcagaattgcatggcacacaagtgataccggccgtggagtgatcatggacgaatgacatggaccagggtgtgcagcagcgacgaggttggagatgtcaggcgagcgtgtgcatgcggctcaatcctctccggagtccgggagaaatcagtgaagataggtacgatatatatgaggcagtgggatagatgttggatccaatccaatgatttaaattttgcactgtaggactttgagtaagaaaatcttgtaaatgtgtagcacaagtagaccttagaatttacttaaagcacaagatactacgtcctccgtttcacaattaattaatataacactttctagcattactcatatatacatatcatatatacatatagatgttaataaatttagacatataaatgtgtctagattcacattaacttctatacagtggctaagccagaaattatataagattagggctaagaaatgacccgactaatggagtattagttttctgaaaaatttacatggtgaatcaacaaaatttaagcaagtttttggtggcaggtctagggctcaagccctagctgccctaggcctacctccacccctgcttctatatgaatatgagcaacaatataatatgaaacggagggagtagtatatttctcatcaaataaaagttactacttcctccgtctcaaaatataacaatttttaagtgggcgggatatatttagtattacgaatttggacaaacgtctatttagattcgtcgtattaggatatgtctcatccagttaaaaattgctatatattttaggacgtatatccagttagattcgaagtatattttaggacggagatagtaggttatattcttttgaggataattgttatacatgttttcgaattcgtgattaattaataatgtaacaacctaaatgtgcgctaattacatcatcatcaatctagtaacctagtaacacactgtattatctacgattgtactgacaaggcaggatctgcttcgaccttgtcgccgctaatatctccgagctccgccggagatggcggcggctgctgggcggtctcgccggcgtccctctcctgccgcttcttcgccgaaaactccgagacgtatccgatcacgtccgtcaggtcggcgtgcgacgacccgccttcctccatcgccgccctcgccttcgcggcgagctccttggcgcgcgccctcctcgccgtcccctcgtctccgccgtccatcagctcggtcaccgccttgaccacgccgtcgctggtgagctgcacgccctcggcctcggcggggaggaacatggggggcaccgtgacgcccgacctgacgccgacgcggagcacgtcgacgagcagctgctcgctgctgaactggtcggagaagttgggccacgtcagcgccggcacgccgtgggagatggcctccagcgtcgcgttccagccgcagtgggtcaggaacccgcccgccgccgggtgggacaggatggtcacctgcggcgcccacccgcgcaccaggaggcccctgtcgctgacgcgctcctcgtacccctcgccgtcgagccactcgctcacggcggcggccgtcgcctccttgatcgcccacacgaacggccaccccgactcctccaggccgcgggcgagctcgatcgcctgcgtcgcccggaggtgcgtgaggctgccgaagctgacgtacagcacggacgccggcggccgggcgtcgagccacgagacgatccgggcggcgtcgacgacggcgcggttgccacggctggcgctggagtcggcgtcgtccagcctggcggcgcacgtcggcccgatggcccacgccctcaggccgagcgccgacgcgtacgcgtccacgaagacgccctcgacgtcgcggaacgtgttgaggagcaggccgtcagcggtggcctcgccgtcgaccacgtcgcgcgccagcttctccgcgccgggccactggaagaagccgcggcacgtggccgtgttgacgacggcgcgcacggggaagcccggcacctcgaacggctcgagctggtcggcgacgcggtcgtacacgccgtgcttggcgaggcagtggatggcgaggaggaagtagacggaggggcagtgcagcacgaggcgcgggatggcgaggcgttcgcacacggccgccgtccacgggttgcaggcgtcggcgacgacgcagtccgggcggcgaggcagcgcgcgcacgtacgcctcgagcgccgcctccatgttccacacggccttgaagaaagccaggtacatggcgatgtccaccaactggtccatgttctccacgccctccggcaggccgaactccgggccggtgaaggtgatctcggcgagctcgacggcgagccctccccgccgcgctccctcgacggccgccctgttgcgcgcggcgttgaccggcgtggtgaccaccgtgacgcgcgcgccgcggccggcgaggaggcgcgccaggtccaccatagggatgatgtggccctgcgccaccagcggcaccagcaagaagtggagctccttcgccgccgacgccgccgccatcgcctccaactctgtttctcctcgcgcgcgcgcagcaagagcaagaaggtgaggaggcgtagggactagctttgcagtctagaggagtgtgtgttatacacgtcgacacgtcgtcgatgacgtcgacggcccgggttgttgcggggcgcggcggcggaagatgagatcgcggcgacgtggaagccggaaatacacatttattgtcacactctaaaaatcttaaatatataaattgttgtttaattggaatttttagaaattattttaaaagcctacaagctaaaccctaattttctaggaaaattttcaacataaaagtgagctagataaaattttattaaatactatgcttgctcctctattttctagatttttctgggaattatttgagcaagggaagtatttttaataattgaaacaacatttcacaaattgttttattcaaaaaagtttaaaaaaccccttctttagccgttggaccgttttcggcccaactctctctttctctctctccccgcgcgcggcccacgccggcccaagccgccgccgcccgtgcccctctctctcgggacactgacatgtggggcccacatgtcaggcccttctccttcctccggccgccgccgagaccgagcccgagccgccgtcttgcgccgccgtttccgcccaaatccgacccggattcttccaattgattgaggggttttgttcctctcgatctcctctttctttcccctcaagaaacaaagaaatccgttgagtattctctccgaatcgaattcgttttgttttatccctaaaaaccgagttcgatttcttcccgaatcgattcctcccgtttggagctcgatctcttcgatccaatgccatataaagcttctccttgttcttctcttccgtttgccccctttcccgagctctcccgtgcctcctagcgccgccgcgacgtgctccaagttcgccgccgccgccggccgtcttcggcaacgccgccgcgccgtctccgccgtcgccgccgctcgccgttgccgccgataggtgcgccgtggtgagaggaagcccggccgcccctcctctctcgccgccgaccaccggagcccgctcgccgccgtcgacccgaaccgccgccgccttcctcctcgtcgccggccgccgtcgtgcaccgtttgccgtagtggtgagtaccaacgggttcgcctcgttgccctctacgcgtagatgccctccaatcgcccggccgatcgctctagcgccggcgagctcctcaacccgagccggccgccgtgccgacgtcagcatgacgtcatctccagggctgacgtcatcgtttccttttctttttctttttcccgattttctaatagattaaaacttcggaaaatcataattaaataaccgtagatccgttttaggtggttcaagtttctaaatttttctaaaatcaagatctacatgttaaaaatatccacatgtactgtttatgcttgtttttgtactgttttattgattttgtttatttgctttagtttccgacgttccggaggagagcgtttccattgaggaaggttccgaagcatttgtggaagcccaaggcaagtcacacagatcccaaacaaccctttgagcatgttgatcccgtttaaagctattattttattttcaactatgcattgtttttgaatgtcatcgggtggtgaacctttcccaattatttaatggccgaagatgactttattttcctatgggttataatttgattggcatgaaccttatatattggattggttcagctaaatgctatatgtaggtttgcttagccatgcttagaaacattagctaactaaatggggttaaatataaattatattacataattattattattaattagggttatattcaatggtagctcacgatggtaaatcgtgtgatgataattaattgataattaaaacttggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattataatccaggtacggtgcactgtggtgaattgtgttatgcgaggggtattgtcacgactcctttccgaggtaccgtggtggtattgaggcacatggtgacatgatgtggggttgtgtcttgtgggtacagtggtacacctctgatcagagttttaatctattcgaatagccgtacccgcggttatgggtgagttgagcaatgtttttcgtgattagtctcacactactcattaatggtaattatgtggtaattaatttagttcctggtttggaatggttaattcctggtttggaggtttaatttgttcaaccggggttggttgttcaaatgtgattgggcctatgcaacatgggtatgttgtatggtgtttaattaatattgattaattatacaactgttttactattctcttaaatatttattaaatgctgttttctgcaaatgagctatattgtgccatcctttgttattttgtgcacttgcatatttgttgtgtggcttgttgagtatgttatatgctcattcttgcaatattcattcatcagaagaggagtatctcagtgaaggtgatgatctggaggattaggcttgttctcggttaagttgcctgtggagtggagtcgccatcgctgttccgtagattgttttagttttatttttccgctgcgtagaatgttatttttctttgagaggaactatctacctctgtaataatttattatttgcgaatattaaatagttattcatttgtactctattatcaatattgtcattgtgtgcctcggttgattcctagacgagggtttaacacacatgtaagcgtttggaattttggatagaaattccgggcgtgacaagttggtatcagagccaccttgaccttaggataagccaaatggtaaaccttaagtagccttcaaaatattttgaaaaaaaaatagaactgctcttctctattctcttacaaattaattaagttggcagcacatgcgaggttatgcacaaaacttatttaattcaatttcttttcttttaaaagaaaaaggttgttcttttcaaaatgtttctttttctctttacccaaaattttattgattagtcggcactgtacatttattatggtatcgaattaatcatgttagcactagtactacttatctttcctatggtgacattgtaccgtgcttataatagatcataattatcttagctttattttaaatatttgttaaaaaaaataataatatatttgcccctgtctaaaaagttaaattctaaaaaaaatatttataaaatagctttgtatgtgtcttttcttttatttttcttccttttgggtcaaaaatcagttaagtctagttggtgcagctaacttagaaaaatatgcattaattcttctcttctatgtttctttagatgccgccccattcaccgagaaatttgatcgaggtgttaggattcgtcagggagttgaggttgatggcttttgaggtaggctatgaagttgctcccgagtatcgccaaatttcccatgaccccgacgaggagaagtgtcgtgttcgtgtgacattggctagtgatagtgaagaccttccgtcctttaagttcgaagttggaggaagatcgtactgccatgcttgtcaagaagtagctttggtggccattggagagttgcgacaacactttgaagaagagttggattcatcagctttccagtatcatcctcacaaggctcatggtcaagactatggaacctatacctgtcctgatggtgaagagagtgccactctgatgcatgtggtgcatatgcttagtgctatggatgcagtaagtgtggagcgagacaaagcagctcatgacagggaaaactggaatcaaggcaagatttgcaagttgaagagcaaggtgcaccgtctacagaaggaattagctgaacttaaaggagaaacgccgccgccaatatccaagcttcgcctcactgcaagaaagagaacctgtccgccacctcgtctccagttagcttcgaagattcgcgtgatgggtgaagctatgcccaatcgtgctgaacctgtcatcgacatcataagtgatgaggaagaagaggaagatcataaagaaagggagccagctactccagaggaagaagattcatcgtttcgttccgacgcaaggcggaagtagacgcttagttagaacgttgccatagttcgttgtgttagattgcttgtttaagtttgcttgtgagtgtgtgggtttagttgttgcttacatcattggtgggatgtaacagcatgagtctagttcttttgcttgtcagagtgtaagatagttggtgagatagtgttaatgcaacttaaatgtaatcatacacagttaagagcaatatagaatttaaattaattaaataactccgttctaagggtgtctctctgtcattctttcctgttgtctctgcttatcgtcagatggtgaacacgcgcaccggaagtggaagtggaagtggaagtggagctactaacaatggaggagaacccacgctagctcagattctggctcaacagacacaactgatcaacctgttagtgcagcaggcacagaatcagcaagcaaataatcagaaccagaatccacccccacctccccaaaataagctggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcagttgcatggacccgctgctgaatggtgggatcattttcgccaaggcagggcgggaggagaacctattacttggcaggaattcacagctgcttttaagaagacgcatataccgtcaggtgttgtagctctaaagaagagagaatttagagcactcaaccagggatctcgttcggtcactgagtacctccatgattttaaccgtttagctcgctatgctccagaggatgttcgcaccgatgaagagcgtcaggagaagtttttagagggactaaatgatgagttgtcttatgctttgatggctacggatttccgggatttccaacaattggtggacaaggcgattcgtcaggaagacaagtataaccgtatagagcagaagaagcgcagggctgcccaatttaaggcacaacagggcagtaaccaaaggccgcgtctcattactggacctcaagctccatcgtaccctcaaggaggatcttcatctgttgcccgtccccaacgccagttctacaacaacaatactagtaatcgtggcaatgacaaccgcaatatggttgcttgtcctgcagcaactccagttcagaaccagcctgtcaggaaggaacagggaagcaagccagtgatatgctttaattgtggtgatccaggacattatgctgataagtgtcctaagcctcggcgtgtgaagaacgctccagtcccgaacaaccccaatgttccagcaccgaaggcacgtgttaatcatgttgcagcagcagaagctcagaatgcaccagatgttgttttgggtacgtttcctgttaactctatacccgcaactgtgctttttgattccggtgctacacattcctttttgtctaaaagttttgcaagcaaacatgggatggaagttgttagtcttgggagacctttactagttaataccccgggcaatcaggtattttcgacacagtattgtccttccgttactatagaaatagaagaagttcctttcccatcctctcttatcttgctagaatccaaagacctagatgttatcttagggatggattggttatctcgtcacagaggagttatagattgcgccaatcgtaaggtgactttaaccaatagcaatggggaaacagtttctttctttgcatcctctcctaaatctcatggtgtggtcttaaaccaagttgctctacaagagattcctatagtgcaagactacccagacgtgtttcccgaggatttgccaggtatgccacctaagagagacatagagtttcggatagacttggtacctggaaccaaccccatccataagagaccatacagaatggcagctaacgagttagctgaggtgaagaaacaggtggatgatttgcttcagaaaggatacatcagacccagtacttcgccgtggggagcaccagtcatctttgtggagaagaaagatcatactcaaagaatgtgtgtggattatcgagcgttgaatgaggttactatcaagaataaatatcctctacccagaattgatgacctgtttgatcaactcgaaggtgctacagttttctccaagatagatctccattctggatatcatcaacttcgaatccgtgaggaagatataccaaagaccgccttcacaactcggtatggtttgttcgaatgtaccgttatgtcgtttggactcactaatgccccagcctttttcatgaatctgatgaacaaggtgtttatggaatatttggataagtttgtcgtagtgtttattgatgacattcttatttactccaagacgaaggaagaacatgaagagcatcttcgtctagctttagagaaactacgtgagcatcagctttatgccaagttcagtaaatgtgaattttggttgtccgaagtaaagtttcttggtcatgtcatctcgtctggaggagtggcagtagatccaagcaatgtggagtcagtattaagttggaagcaacccaagacggtttcagaaattcgtagtttccttggacttgcagggtattaccgcaggtttattgagaacttttcaaagatcgccagaccaatgactcgtctgcttcagaaggaagtgaagtataagtggacggaggattgtgaacgaagtttccaagaactgaagaaaaggctagtgactgcgcctgtattaattttgcctgatacgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctggaattggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagattatgatatggaaatccattatcacccggggaaagcaaatgttgtagccgatgcccttagcaggatgtcacgcccagcaattcactagtaatttccgaacttatttgtgcataaaatcctcgtccaggaatcagccgaggtacacaaactgacaatttaatatacaaatctatcataataatatcggtaatacttacaaaagaaaagaaaacagcaacggaaaaataaaatctagcgaagcttcggctctactcccacaggcagctcagctggggtataagccaaacgtcttctccttctggatcctttatcttcaactgaggtttgatgattattgcaagaatgagcatatgacatactcaacaagccacacagtagatatgcaagtgcacaaagataccaaaggatggcataatataggctcatttgcaaaagcagcatttagcaaaacatttaagagaaataaaacagcggagtaataatcagaaattttaattaacactgaacaagacacccatgctggacaggccccaccattctggg

SEQ ID NO: 59034 - DNA, 576 bp, Oryza sativa
attattttgtgtgtaatcgatatgtgggtcccacagtttttaaaattattttttatccgattgccacgtaagcgccacctgggaccagacctagtcataccaagcatgtaagcgccaggtcatctcaaaccgggcacaatactaccaacggacctcgtctgcacagttttggtaagttgggggatgcgatgtatctggttttgtagacggagagatgaaaatcagactgggcgacgaattaagagacctaaagtgaacttattcctctcatcctccatccccgctgcttccggcggctgccgccattccatctcccacttccccgtccattgccatcaatcctcacgccaagctagctatagctacgatggaacgcccttccactccggactccggttgggtcatcctcagcaccatcgcggtcgcggcccgccggcacagcaataatggtagcaccgccattaatggccacaccaggaacggaaacaccatccatcgagggtatgtatccctctagatctttcgcccacccaccaccaaatccctccatcgtcttcgtgcacagctcagacatga

SEQ ID NO: 59035 - DNA, 711 bp, Oryza sativa
tgccgcatgtccttgtaccagtgctgcatgccatggtccggattagagagaagctagtaattaagagatgagcaccgagccacatagcatagcagaagaagaaaatattatggtggtggtgcctgcagtcgtcgcgggggttggttggcgcgaggacgacggcgtcgtggcggacggtaaggcagtacccctcgtcggcgcggcaaaagatcttgaacgtcggctcgtgctggggaccagtcgccggaggctggtattggccgtggccgtgcccatggtggctgaacatgctagctagcttccaagggccggcgtctggttgtctcgctggtattcgatcgttgcaaatggcacctcccgggttatatagaacaaattaagctggaggccggccggcgagacgttcgttcgttgagaccgaggccgcgtacgtggtgccgatcgatgagaccacacccaccgtgtcgtgtcatgtcatcttctggagtacatagggcctgtttagttcgcgaaaagaaattttttagtgttacatccgatgtttgaccgaataacggaagggttttttggatacgaatgaaaaaactaatttcataactcgcctggaaaccgcgagacgaatcttttgagcctaataacccgtcattaacttatgtgggttactgtagcacttatggctaatcatggactaattagacttaaaagatttgt

SEQ ID NO: 59036 - DNA, 23202 bp, Oryza sativa
  unsure (1)..(23202): unsure at all n locations
caatttttttgaaaatttttcataaccatttagatgacatgcaagaaatgggtggacgtccacccgagtgtttaaaacagtttccctcgaggtcccaggtagtcgtagcgaaccaacaacaatgacgcgatgtagaaagtgagcggcctctgcatgcttctcccctctccgtcatcgcaccagtaggcagtagtcaaggccacagtcgcggccctcgtctcatcagaatctagaggaggctgcttcaccctcctgggagggcctcctcactgcctctccggtccagcttaataatatttgctcccttagcttaataatttttggactccaatacttcggctccaatacttcggtcagcctggttaaagaaaatgggtcaacatagttgaaaatcatttacatattccgaagcacttttagaaaagtaacatgacaaggtgaaacttatacctaagtatgagcaaaactttctccattgtataaaggaaggctacatgattcaattttttagcagcattttgttgatgcggttctatatgtttaccatggtacgtgcatatcaattttcatttcagcaggttgtccatggtagtcaaaccttagaacttcatctgattgttcctaatggggtaaaaaaggaacctgatattgcgcaattcagccagatgagaaaataagattccctaatggggtagaaaggtataaaaatcaatatattgccacccaccctgataatgatgttattggcagttttcggaacactggaaaaaggattcatgatagcagtattctgaacatactgcacaaaactaattcatgactgaacggatgtgaattcagatgagtgcgtgaaaatgaggagcttaatgccttgtaaaaactgaatgttgtcagaagaacaatgaaccaagaaccaccaaattaagtcaagtactaattggataatatcagaaactactagcatgtttacttatttcactaaatattctactccctccgcttcaaaatgtttgacaccgttgactttttagcacatgtttgatcattcgtcttattcaaaaaaaatttatgaaatatgtaaaattatatgtgtacatgaaagtatatttaacaatgaatcaaatgatatgaaaagaataaataattacttaaatttttgaataagacgaatggtcaaacatgtacttaaaaaaatcaacggtgtcaaacattttgatacagagggagtaataaataatccattacagcaatataatgacagatgaggacatgaacatgagactttatacaagaacagtggggtaaaccggggatgaacagcttcagaaaaagacggattggaaaataagaaaaaaaaaactatgaagcaggcatgcagctacgaatcatccccaaacatcacatataacaaatgttcatccggcattctgatcgttaccatgcaggcacacagcagctgctcacctctctgtctggtacatcgacgtcgcaccaaactgcagccagatacccgccatcgtcgaatccacgacgcagcaagcaggcacgtagctgctgtatgctcgcctccccacctgaccacctcgactgccatgaagcaggcacaccacgtacgtcttcgctccttcctctccccttgcatcccggcgtccctcgggctctagccggcgagtggatctagcgagacgcaaaccttcaataatggtcacagcattaactggtcgcgatctgacgcaactgggcgtggggaggctcgatctggcaccggggatagatgcgccagggccaggaagagtgtggcctcctgatccggcgacgatcgaggagacggacagccacgacgcgacgacaatcccgggcggcgcccccgaacggcggctaccaagcgacgggagagaggtcggtggcggtggtgcatatccatgggggcggagtataggacggcggcgagtagcgtgcgccgcacacggaggatgaccggggctcctctccatcgccgcctggctcgagcacgaacctcgcctgccatgctagatccgaaattcagaggatgagaggcgacaagtcgagaacacaccaatttgttgacagtgtatgtattccctttcgattttgctaaaggttatttgacgtttttctggccgtccgatcgtgaaggatatggttttgtatctttaagtaacacgaagtgcttagctaacctgctgctaccgtcggccttggcttgtcgtaagctttgtgcagctcgctgggtagctggcacattacatatcgtatatcgattttgctcgtgatttttttctgacatttaacccttttttttcagctcgtcagccggccggcacgtcctatataactaaatttaaaatatagaaaatataaaattacagtctatataactaaatttacatttgtaaattcagttgatatgacatgtaagcgcactgtaatttcgataaaaataatatgtaagtaaatatgtatttggtattttctttaaattataaaattacagtcctatgtaactaaatttacatttataacttcagttgatatgacatgtaagtgcactgtaattttggtaaaaataatatataagtaaatatgtatttgttattttattttgtagtccgttggatgtaaatctaggggtagaaaaaatctaggtgattttttattagaaatcacccgacaaatggatagatgctccccctttagggcacgtataacggtctttattagtggtctctctctattgctatgcatgacaacggcttagagtcgactcttagcattttttagagcaaattttgttgcatggtgatgaaagaaaggaaaaaatattaagatttttttgattcattaatgtttagagaccatattgtctctaactattgtagggtgctagtctctagataacgtagagctcatatctgacaaaaattttcacaatttgaccctttttaaaaactatttttacaaatgaaccgtcaccaaaacttatttaaaaaataacccttggcactgaatttagacacctcagcgccaaatagcgtagcgctgaatatgcgttggcacgctgacttagtctcccatccgcggtggcacggcattcagcgccagttgacatagcgctgaggtgtctaagttcagcgccaggtgatttggcgctgaccaaaagagtcatttttgaaataagttttggcagcggttcatttgtgaaaaaagtttttgcaaagggtcaaattgtgaaaatttcagcatatctgactctacctttgtacatgcccttagtaactacattactgacccttaaatacgttatcatatactccagtaactacattactagtaacaaccaatcattataacaagtgcggatcataaaggaaggtaggtgggtggggtgggtcgccccggttggaggggggagggtagggggttgtgttttaatacagcacaacccatctgtaatatagtatatgtatgtatgtatgaatgaatgtatatgtccttggtattggaaaaaagaactgcatgagcaaaatgataccacaaaaagtctaaatacaagcacaccaattaagttatatatcagtatactccatatatatgacagcacaggtacatcatcacatcacaggacacgtacatacatatagacacacaaaggtgcaggtgatgactcacatgatagcaagtcacatggcacacatacgcaacacgaaacattatttagcatgcatgcatgcatatgcatatatatgcacgcatgggcgcataacggatgacacactggattgtggggccaggttgcagaggatagctttgttcatcacttgccgcagttgcagccggcgcaggagcagccggtggtgcacttgcacttgccgtcgttctcctcgtagccgacctcctcagccatctcgaagtggctgcatgtgttgcacagaaatatatcacttacatctaaatttatcgttcaatatttatttatatgattcttaattaagtggaagcgaccgcgatttgttcgagttatgatgtttgcacgactttaattactttcacagaagtgtaagattcatgtattggggtccgttttagtttattcactatattatagaaacggatatattatttgctttgagcttcgaaaaatatgttttctccgaaacttggttagatcacatgttttaaaatatttgtagttataatattataattagcggtgataataacccctcagaatctaaatcaatcatcaggctagtagtatggctaaagctgttgagattataggcatataatgatttaatttattccataaataaattatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatattttgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattccattcgacgcgtacgtcgtgcacgcgcgccgcctgccctgccctgccaggcgagcgagcgcgcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaaagctgtactccctaaaaaaaactgaacagatcaagatatatatggtataatatagtacaacgaatttgggattatgtcacatctccatttaatttgggttttcttagatataggagttgttgtagagttaattaagaggtattggggatgggaaggggaggagaagccagtatgtatgtacctcttctcggcgtcaactatgacgacgccatagctggttcctttcttcctgcaaattaatcaacatgtcaattatattaatagattcgatcagttgattcagttcgcatgcaggactgaaaaattagtaaatcttaaagagggaatcgaattcaggagtggcagctagctagctagctggggtgtgtacttacacgcactggctcttgtcagcgcagtcgcagttgccgcacttgtccgacatgttgatcgatcgatcgatctgcgatgaactgagcttgattaatttggtgtggttgatctcgattagctttggaaggcgaggcttgtgatgaagagcaatggccgtggcttccccccgctatatatagccgcgccaggatacggacgaactgttttttctatatatttttttctcatcaaggtgtccaattgtaggtggtagaattttctaaagtatttttaaacaatattcctaaaatgatttttttttaaaatctgaagagccaagttagctaggaaaagtagtgccattcatataaaccatatatcgctacaaaatggcattgcctcagtttcaaattatttttcattttagctttgttgttactaaaacattctaaactttgaccattaatttttgaaattttatatagtttaaaatcgtaaggttcatgtatttagatttaccacaagaaatgctttcatatgtaatatataattcatatgttgttaaaatatatttatttctaaaaattgattattaaagttacatataattgatttacgacaaaaccaaaacgacatgttgctgcaccaattaatttgctttgcatgcatgcacagaggggatgtgacaccgttttggctggtgtggcaatgctgatctaattagcaactgttatccctaggatttggatattttccatggccttagtcgccacaatgaatctcaaatatatgcactataggttttaacccaacaaatgaataatatatttatgcttgatactactttctacgaataagattcccataaaagagatttcgttgttatattaagagcatgtgtagtactaccttcaatctaaaatataagatactgtacgttctaattaaacgtcatgtaatcatgactggagggaggatatatataagataggttctcaactggttttatataacttttctaaaatatataagcatttttaggtatatatatgtatgatttatttgcatattactttatatatatgagatttgttgtactcttctgtcccattttaaatgtagttgtgggtttctatatccaatgtttgatcatccgtcttatttaaaaaatttatgaaaaaataaaaaaataactcacgtataaaatactattcatgttttatcatatgatagtaataaaaatactaatcataaaaaacattcaaataaaacggacaaacaaatattggatatgttaaatttacaactccacttaaaattggacagaggaagttttaacgtaaggatatatagggggtgtttagatccaggggtgtaaagttttaacgtgtcacatcggatactatatagggtattgtatggggtgttcaggtactaataaataataattacagaattcgtcagtaaaccgcgagacgaattgattaagcataattaatccgtcattagcaaatgtttactgtaacaccacgttatcaaatcatgtagcaattaggcttaaaagattcgtctcacaaattagtcgtaatcagcctatatttaatacttaatataggtgttcaaacactggatgtgacaggtgcaaaattttgggtgggatatatacatgcccataatatatatggttgtgcattgaaatgtgtgaatcagataccatgttactccaggacgagcgatagcaaaagaaaagctaatttctggcttaggtggttcccacggttgcacagctcgcacacgcttcccactgaaggcacacgcttaattggaggagccttatctccacccataactcaaacgaatctatctcttatcactaatcaattatatcgatcattgatctctttttatctccatctcaaaaaagaagaaaaatgaaagaaagattcaaaggaaaaaaaagataataataaaggaatcttacaacagtaaactcagataactttgccatgtctttcacttgtggaacctgctatagttatagctgcactctcgatcaaagctttttttttccgttttggcgccacgctgaaatttatttgttcgatgtaggacacacgctaagtcgctacctagcctagcctgctagcctgtgtgtgaacttcaattctacccccaattaaggcttactcattttccgttaacacgttttccaaactgttatataatactttttataaaaaaaatctatataaaggttatttaaaaattttaataaatctgtttttttaatttataattattaatacttaattaatcatgtgctaatgaaatttctcattttatgtgcatcaaaagatctctctcaaaatagagagattgaatgcagccttagctggatatgttttttatccctcgagggatgtacctgtatttcttgcatttcatataattagtaattgaaaattttaatacaagataataagatagattaatatgagatagcatgtaaggttaaatttgacttttacaagttgtagaaaaagagaaattaaactaaaactagttaatataaatttatagttatatttgttatttttattacaacttgtagaaatataatttgaacttaaatatttgcatagtgatatatcaaactttaatcgaactagtcaatttttttagttaaactttttaatgactatttaggtgacaaataagaaacaagaggatatcacataactggtaaaaaaattagtgaaatcgtacttcaagaacaaactcaattttatataaaatctttaaataattctcagcaaaaaaaaaagctctcacatattagagcatgaaggcgatccgagaccaccacataaaatttcaggaaaaaacttaatttaatttgtggaatattacattaagtttaggcgaagaaatgagaatcatatgtggtaatgatggggagttaaatatatatggatattaattgcgctcttgagtgttgattctatgattgtgctctatgatattagatcgatctcgggggtgatgggatgatagaatctgagagttgaaggggagttgtttggtgcattagctcgattcgagccgatgcatatcaagccaagttttttttcattcctggaaccttaaaggtgtctgctcctaaatcggcacccttaaatcctcaaaggtgccggttaggaaacccagcacgtatagccagttcctaactagcataatcgccttttgttgtatcagtgaatggtttctcaaagcaaattacttatctagcctttcacaaaacaatacttgacccatagtttaaacacctttttgtttatacctttcatcttaagtcgttagattaagaaccatccctatatagaggcactttgcaaactataaaatgaggccttacatgtactcgcgacacttagagcaatagcaaagaagctcggccacctatgatgatctagctaggtagaagaagaattgttacagtttttcttactaaataagtaggaaaatgaaactattattgtttggaacacacgttcatatcatcgtcacgaagtatagttctttgtagctataattgtcatcgaacacttgttgaagctcagaaaaaaaaatcttgttctagtaaaaaatcaatgaagcataaagagataaactaaaaaatggagtgaagagatccaaaacatattagaacgcattggtataaattaaatatataatattaggactatttttcatatacggtcgcgcatctcgcatatgcccaaagatggccctggttagattataagtgattaacggccttcttatatcccaagcatcttagaaaatcctgaataaaattacatttatctattgcaattcaccgatatttttttcaagtaatatttaaatatcgatgtgtcccttcatatatttatcttagtccgggacactaatgttgacagattctcaggtgtttcaatcttcgaaaagaacataaaatatttcaatatgaactacacaatttcgttacaaattaaagcagaggtaaatagagggtaattaactatactacagatacttgctagggccacaataatttctgtaaaactatggccatacatgtcgctagtagacagaccgtaccttatcgcctaatttggtcgcttctcaagattttacctttgccgtagcaatcgccgtcattggcatcgtgtcaaatctgtccctaattaattcgccacttacgaaaagtgaagaacatattaaattggaggaatattaataatgaagtcaaacgtcagcaaacttgtttttccatgcatgtacaatcaaacttattctttggacctgctcaacttcacctgaactaaaaggggattggctattttttatgtgatggaaattgctacgaattttagtaatcttcagcataacaattaatcccctgttgtagtggtaggagagaggagggaggacgagacaaaggagaggtagcttgctggcgatagtgacgatggtcttctttcgatgacagcgagcttcttctcttctccagtgagggcaacaccataactccggtggagatacggattagggtttgaagttagctagggttaggatgggagggggtttagaggaggggaaaaaggggcttatacctaggcttggagggcattgggtgatggccggaccagtagtggctagggttggtggtgggggtgacaccaacaagtggtttggagacggggatggcgaagatgggtccgggggtggcttgccccggagaagaggaacgaccagcttgacgggagcttcacatcattggacttggagaagaaaaagagagggaggtaggggcttcgtgttcatgttttctggctagccagtgaagccagggcagcaaggtcgagcgggcaaagaacggtgccggtgaacgtggtgatgttgccgagataactacgcgtcggacgttcgaggaatagcgaaaaatcggacgcccatgcactagtctttctgtctttacggtctatgccacatgcaaatgcgctttctagctgtctctagttatagctctctgctctctctgtagcatgcagtcatgcatacacactatcacagttgctctctcttccctcatgcagtatgaaaatctactaactctaaactattttttatcctaaaatatttatccgatgcatgatccgattatatcactatatttatcgcaattaaatctttaaaacaagaccacacatagatatattccaacgaattctttttagcttattattgattttttttgaaatgttgcacaacgttccaccaagtatttcgggattgtttcactaagtagatcgaaaatgtttcaatcgtttaaatcgggtgttgtttcaccttatatgaaaacaatgtttcagcaaatagagaaagaatgtttcagttcactgcaacattagatctatacatagtgaaacattatgagtacactaggtgaaacattttttgtgaaataaaaaatgaaacgaattcccttaatagagggtttccaaaatatgtgggtaatttgttgcaaaagaatgtttcggttctctgcaatattagatctatacacagtgaaacattgtgagtaccactaggtgaaatattttttggtgaaacaaaaaataaaatgaattcccttaatagtgagcttccaaaatatgtgggtgatttgttgcaacggagtatgtggtagagacacgtagcaggtagacagtgacacatcgtggggcccagggcgcacgtgtgcgcgcgcgcgtgtcgtggggggaggggggagtgaccaatttttaccctaccccgggcgaccgaggcgtaggacaatcgaatacttattaaaatatataaataaaataatgtgaaacactgaaaaaacatttattgcaataaaaaaataaaaataaaatatttcgatcagaatatagtcatgtgatatcttattatgaagatttaattaaaatgaatataatggtataatcgaatcacaaatttgatagttgattattggaaaaaaaacatttgaaacttattaaaagaatgcatgcatgcgtaggggagagagggcaagagtagtacgtgggctatctgatgtgagagagaaaggttttggtattgaaaaagagacggtatgcatgctggctcataatatgagaaaagtgttatacggtgcatccgccgtccgagtatccgatagttttcgctggatcggacgtccgatcgtaagcattttcgtgatgccgcccgtgcgtgaggtcgcccgtttggaggtgaaaaaggaaatgagtggatagctgtactgctgttgcaccaatctcgagataattctagccatccaaaactttgactgaattcttttattttagtcaccttagaattaattagactgtcctaaaaaacttgaaaaatctgcttgtttacactatcgacatggaaaccagacaaatatacagccgtaacgtgtcaaggcacaaaatagtcatctagctattgacgtgaaaactactaccactgaaaaccagtcgaaggtgatacttttatcgtgtctgaaaatttaggaatgacaaatagccggaattaattcaaggcgaaaatttggatccatagagttttatggccatttttttctttttgttttttacattctcactcatatttttgtctctctaaaacgacctgtgcatgtttccccttctcgccaaatgtttttcgttggccccgctttcactatcatctttttgtataactttgtgttctagctatcctttgccctgtttccggaaagtccaaaccgttccaattcaaatttctgtaaaattcgtcacaaaaaagttgctgcaaattttctacaaagttcagaaaatccacttttcagtcaactcccctatgttgggccaaccttcttatcttgatccatccagtgtgagccgctaactagaagggcccactcagcctatccatcttggaataagttcatctgacgcccctcaattgtacgccaagtctatctaagccgtaataccagaaatgtgtacccctgaagtatgtaaaaccgtccaaataaaatctcggggttgtggagcgccggcgacggcagcggcggatgagcggagtcgtcagcgcctgcctctccccatccggagccacgacagacacgttgcccacggcgttggggatgaagctcctccaagtttacgtacctgatcgatggagcacacgttgtcatcagctactctagttcagttttaattttgttcatcactttcttgtactgcctcatctcattcggactagagctagctttgatctaatctagggccccgtttggcacagctccagctcccaactccaacttacctaaagccggaggtgtgccaaacggttcagatcctttattttatagagcggagttggcagagctactccacaaatttgtactacgggggtggagctaggtttttgttgctccacagctccactccactccaaaagacccactaccctttaaaattttagtgtatttacatgaaaatgccactgaactacctgtaccaacctccccctcccgttctctctccttctccgtctccctcccgagccctaatagatgcagtaggcggcattggcgtcggcgtcaggcggcggcgttggcggcagctgtggtgggcggcggcaccgtcggcggcggcgtcgtcggcggtggcgatggcaggcgccacggcggcggggcgcggcaagcacgcgggaggaagatgggcggcacgaggccggcggcgggtggcgcgtgcggcgacgacgcgcaaccgacgggggacggcgcgcgcggccaccgggatgtgcactaccgaggcgacgaagctcggcgggcggagggcggcgcgcggccggcggagggcagggggaggtgggcgggcggcggagtgcggggggaggtgggcggcgcgcgcaggggacggggacggccggcggagggcagcgcgcgcaagggatggggacggccggcggctgggatttttgtttttttttctttttcttttttttttgcagatctggagctaaaatatagccaaacacttttgatgagtgtccaactctaactggagctagctcccactagagtaggagtttggagttaggagttggagtatggagccctaccaaacggggcctagagtagcgagcagcaagtgtctgttgcgacgtcccgatagatccggccaaatcttaattgctgttcattggtcagatttgacaattaagctgcggatggggggaggcgggtgctgacgacttccgctcgcctgctgccacgcccccagcacccctcgcccatctgctccgcgtgggagccgccgccgacgaggccgagcggtgcggagtcggcgccagcctctcatgtcaggaacccacactctaacctcaataggtagtatccaatacaaaacattggtgaatcggtgtgtaattgatggtggagaaattatagaatacaaactgaatagaaggttatagtagtttctagacaagtagagaaagaggaagggtagagaagaagatcaagaagggtgccaagcccggccacccaagtagccgccgccgtcgtggccgaagccgcctttgccgattccaaatgtttgatgcctccaagtgcttgctgttgctgctcatatatatatgctgctagttgtgcttgtttgggccaggattgaaacatgactaacttagcccatctgcagcccaactgtgttcctaacaatcccctctccttaatattcgacttgtcctcgagtcgatgcaaattattgccagtgccaccaggatcccaatgtgtctgaagttcttgcatataattagcaaccctctaaacaacaagtgattgtagattattaccagcaacacttcttaatttcatcttctggttatgatccatcaaccaatgcaccaaaagttctacctcccccaatgtgtcattatctttacctggatcgaatacaagtataaagatattccaatgaaccaccagcttattagtctcaattttcttctttgttgactctagtatcattgtcctttcgtcataaaccatggccttgatagacaacttaacagccacccttcccattgcattcttaatcaagctgagcttaggtacaactagattgacaagtatcagacctacttaatggttcatgacatgcaaagccctcatttccctcattattatagtagcccagtgtagccagtgaggcaattgactgctaaaatttcttccatgaaaatcaaatatctagccaacttcaatataacatgttggcactctgacttctttcaatcaataagcccaataaagagaacaacggacatgttgacagcccatgcattctataccttctttatcatgtagaccaagaattttccaattgaaatcaacatcttccaatcttattttgtccttcagcccagcaacccatttctcttctataggggagatcctagtgatgagtgtcctttgatttgtctctagcagtagcttttgttgtgccacaatggaaggtgtctttgttgagataaactgtggccatttcatacatattaaatactgaaggacatcgtaaattccaaggtggacaatagcatgaattgcacgactcaagttcagcacacatagcgcagtgactaagattgatccatctgcagttgatacaatccaaattgttctccataaatttgcacttcgtccttgattcactaggatgtgtgtgatttcagtttcatggggtgggggccaagggttcagctcagcccaatgcaagtccatagccctcatctcagtaggaagtactttgataattcgaaattgcaattcaaggcaacttactttagttggtggcggccgaggtgcctttagttctacaaaaatctgtaatgcacccagatttccagaactagccagaacttcaagatcagcattaagacttctaaacaagcactgacaccatataacaggcggtggccatggcaatggcttcactagcatgggcaattgaccatatctaaatgcatgccatattagaagattcagcacacctttgtttcatcggcttactagtgaatcagcccgctgttttagctccaccttggcacacagatcatgaagggtatcttctgtttcctcctcaacctgagtcatgtcgccttcggcttcctcggtctcaatcgaaggcaatgttgttgccctagcagctgagataattgagggcgcgaacaaacttgtggtacccgggaacacacgttctggtttagtaggagtgccattgagcactgccttggtggtagcgtancttggtcccggcgtcgaacactgggtgggcactaaagtaggcaaggtcgaaggtggtggttgccctgatgctggcagaggactcctcttctctcttcacaaaggcctcactcctttcttccttacaccaaacattgtagtaaccgatcaagtttatcatcaaatctgcgctgggattccatcagctcaaagtcctctagtaaccaatggattgcctcatccctggttaacatctcctcgttcatgacgtgaagaacatctccctcggacaccccatatcggctagacatttcattgaacaggtgatgggcactgctctgatgaacatcttccctaccaaaattttcctccctcttgcaatgctgagtgatacaagtgctccccaaacgcctccatactgtgaatcccacggatcgtgaggctctgataccaaattgtcagaaacccacactctaacctcagtaggtagtatccaatacaaaacaatggtagatcggtgtggaattgatggtggagaaattatggaatacaaacggaatagaaggttatagtagtttctagacaggtagagaaagaggaagggtagagaagatcaacaagggtgccaagcccggccacccaagtcgctgccatcaccgattccaaatgtttgatgcttccaagtgcttccagttgctgctcatatatgctgctagttgtgcttgtttgggccaggattgaaacatgactaacttagcccatctgcagcccaactgtgttccaccgctgccgctccccctctgcaggaagaacgaaagaagaagggaaaaaagaaatgagaagaaagaaaagagaaaggaaaaaaaatgatgctaacatatgggccccacatttcttccttctcacgtacatgtgggtcccacatatttatttttttattttttgctgactaggatgccatgtcagcgaaactatgcatctatactgtcatcgtacttttttttggacaattttatatagcacaggggtacacatttatggtattgcggttaggggacctcacacacactcatcatacaactgagggacgtgaagtgaacttattccatccatcttcctcatcgcgggccagtcacccagtaattaactcctatggcccagacagcatggaaacgctaatgcgcgcggctcatcacgcgattaatttccttacgagttcgtgtatatataattgtatatgtatatgcaaatgtttatacgcatatgttataatatatacgtacataatttatatacgcaggggcagaattaagcatgggacagttaggcgcgcttgagctccattaaatcctaactccatgattcccattgattatagtcgtgtttagatccagggtgaaaagttttggcgtgtcacatcagatatacatacacatttaaagtattaatcgtagtataataacaaaacaaattatagaatccgtctgtaatctacgagaagaatttgttaagcctaattaatccgttattagcaaatgtttactgtaacactacattgtcaaatcatgaagcaattaaacttaatagattcgtctcgcaatttacacgcaatctgtgtaatcaattttttcgtttatatttaattccctatgcatgtgtctgaacatatgatgtgacaaggtgaaaaattttaccagataatctaaacatgcccataggctgtgttcttaccccaagtttcccaactcatctccctcgttttccacgtgcacacttttcaaactgttaaacggtgcgttttttgtaaaagtttctatgcgaaagttgcttaaaaattcatattgatccatttttgaaaaaaaaaactaatacttaattaatcacgcgctaatggaccattccgttttccgtgcgcactatttcggttgggaacatgctggagcgaacagagcctatagtcttgaaaagtaccacaatttttaaaactacttgagatcccattaattcagccctatgtatgtatgtagtttttttttctccgccagtatatgctatgcaatgaacttatttttggatggactttgcacaccacagcgtgtttgtaacccagcaaccgccaattattagatagacataggcaagagttgagtacagattcagaaacacttatttacaaaacatcatgcacctatcatcattacatatgtactctactacagaagctaattaaatgacctgtaaatatctgaaagaggaatgaaatgaaataatacaccataagatattcctggtactacaaacatgtggatatatagtactagaaagtgtcttattctatactatgttctatactaggttgcacagattaagtaaactatatcaagcatatgcataatatacgacctatctaaacattacaaaatgtacagtacgggaagatactattcccttttttctgaatgtttgacgctgttgatttttttaaacacgtttgaccattcgtcttattgaaaaatttatgtgaaatatgtaaaactatatattaacgtaaaagtatatttaacaatgaatcaaatgataagaaaatgataaataattactgaataagacgaacagtcaaatatgtttaaaaaaatcaacggcgtcaaatatttagggacggagggagtacaaattaatactcatggcgccgtgggtataaaatgacaatcacgctaagaacctttgctggcagctgagtgtcctcgccatcgtcttcgccgcccggagctggtcgtggcacgtcgccgccgccgacgtcgacgccgtcgtccgccggttgaagctcctcctggcgatgtccctcatggagccggcgagggacagcttcgggttcagcctcgtcgtcgagttgaagtccctgcacacctccatgtgccaccgcagcgccgcctccacgccgccgccgccgccgccgccgcgcatccgctcgcgcacggcctccgcgcagaggccgcacacccagtctccgtagtgcgccgcccggatgtggcggatgtaggccgccgtgcactcctccgtcacgctgcagcacgcgcaccgcaccgtcgtctccacgtccgagccgctgccgccgccgccgccgccggaggcaccgccggaggaagccactgccactactccggcgccggcgacgagatgatccgccgctctggtggtgttcgagtattccgagtacgatcgccgcagctcagtttgatccttgttctgaaatagagacacagatttgcatcaatatttcaccatctttcatatacttcaaatttattgtttcttgaataagaaatactctaaatatatatattagcttaactttataaatttcatgtagctttgcatatatatttatttttaaaattttaaaagattgacttcatattaactctgacaaatttttacaagacgcaaaacaagttggtactaattatagtgtgacgactataccttggacagcagcaggaagcaatttgttggttccaagcttgtgtttactgccatgatctgcatgcctgtctctgatctctctcgtgtcaattaagctaaatttcgatatgattttggacacccaactggctaattaatcaaagcagctaccactacatatgcctactgcatcaagtactgatccaatttataggcatatctaaaggtgcatggtaagtactgcaacttggatgtcgctctgcaaccgaacgaaaatgacagatttaagtgcagattagggcttgttgcaacttgttctctgaaagacaaacgtgtgtgtgagtgacagttagagagagtgtgagatcgaaacgcacttaattactcgagaggcattcagacatatatccatgaatttaattaggtttgctcgatcttgtgacggttagaccgttacatgtcctgttcaatcaggatcgatcaatgatgatcttttcgtgcaaaatcattgcatgatgtgaactccaacttaaacctcctacactgcattcgggacagtacatatattggtttacttaaacgtcataggatcgctgagaaattaggcacgccacgtcatatgttttttcaaaaaaaacccgtcatattttgtgaaataacacacacacccaaattcgcgtgtgccatccgatctcggtgaggcagggatccaactgtacacgtgtcccagcgtggcggctgtttcatcaccgtaggatcggggagacagaaatgaacggctcagatctcctcaaccgatgctcccacataaaccctagctagcgtcgctcctcccttcccctcgcgcgacctggcggcggatgcgccgtcctgttgcgctacctccgtccctcccggtgcgcctgctccaccgtccctcctcccctcccggtgcaccgcttccgctgctccccctcccctccacgctgtgcttccttccttcctcctctgcacctcttcttttccatcgttcaaagtcagcgagtcatggtggaatcgatacgacctgatggtgtttgtcctgcatcccagcccttgcctcggcatggatttgggccttgctgccgccgcaagttgcatgcattcgattcaaaaaaaaaaagttgccagcgttgattcattaccagcatgagggcctgtgctgcgctggtttactgctccttcgtcatcatcgtccaaagcaccatcagcgactaggtaggcagcctaatttcctcccattcaatttatctttggctaatagactcctgtgtgtcttggttgtaagaagaggaataaataattggggtgtcgccagtaaaattattagaagcaaatctaagttcattctcaaaatacatttgttcctgcaactttgttaattataatgtcctatatatttcttttatgtcagttaacttcagcgtagataacttctcactaataatgacagaatattgtcagggatgtacaggttaaagattcttacatggtccttagcttcataatgaaatcctgatgtacatcggttcatgtacatgccaattttttctggaatcctaacaaatttggtctacaagaacatatgcttcgaaaaaattctgattttttgttattctcagttacactgattcaagattgtagatatgagtatatggcatggtactacatggcagttatggtttactttcccaagatatgcacttcataacatacaaagttattggagagtacaagttttgatgttcttggctccgctgcccttttcctgtaggagtagatgctaatgagtgaattgtgtagtaatgtcaatattccttcattgtttaccagggagtaacatttggtgaatatgtcagcgagttttcttgcagcaatggaactttcctgaagccacctttctgtgcttctgtttggaggtatgaatgttttcttattgtcttctcttggtgatatatgtggccttcagatttcttatcacatatttttagtttttgtttcatgatagcatataatgtttatactatgagtaggttttgcctcaatttccttcccaatgcaacaaatcatattttatttttgaatttgttgagctcgatatttttacacacagtagaaataaacatgcattgatgatatcctttgtagacaatattatattggtaatagtgatgcatacatcataaaaaattatctgtagacctggcaacttggcatatgacccctaaatttggatcgtgcagttctttttctaagacacaaaccaaaaggtctttaggactcagtatagactgatgattgtgccaatactaaggtaatgatatgatttcatggcgcaagtcttttatcctcatatctggagactccattattctacgagtcatatcttaatgtataaagtgggctgatgttggctctataagtcaagacagtaatcacaaagtatgttgcacatctagcagaaaaaatctctctccgttgaagatttcagtattggtaagaaatttactaaaccacagtaactacatttttaaatcagttcaggctctattgtaacaagctaacaccttttcttccactataaccatttctaagctactaatattgaatatttaatggaacattaattccatagattagcgttgtttgcagggtgtttcaacgacactctactatttacccgaaaggattaaagccataggtacttctaagttctaacctacatagtaccatcctcgcttgatttgttagtccatacagaatgacaatacatatgtgccaccccaaaggtccaagcctccatatctctagctatgtgtactcttttcttctttgatcataaatttttattttaatttattggtgtgataaagctatatgcacttcaaacaattttagatgagacatgccatatgttctaataaggacgcagtgggatgttatttctatacaaacattattcctgcttttgttttttccagctctgtatggtgttggaattttctaatgacccatccttcaagattgattatttgttttgaaaatattcttatagagttgacttcaagatatgatttcattaatctttttttatttaattgattaaatgttctgtttgcccccttctaggaagacagatatttcaatatggtttctttgatgagtgttttgttctacctgccatatatactcatcacgtagcaatatatggatgacatccaagcatgcctgcccttagacatgattatgtaggggctaccttagtattcagtggcactatgcaaaggaggtatcacttcctgtactaaactgttgcaagtacgtaatgtgatgcattgttgtttttacagaactaagcactaaaattttatttgcggtgaagtgctatatatatatgtgaaagattcaattagttaatgatgaagatctctatgataaaaaagttgaaattctctgatcacctaataatttccttttgtcacactgtttcttctctaatctataccctcacattatgtaagcaccattgtcctctgtgattgttatttttctgtaaatgagcatgtttgtacaaacaattatctgagcaaacggattatattcatatttaaatcttggtgatatatagttgtaatgtgtattcatatgtaagtatgcttctgacataatgcttttttagataatgtttggatatataatgcttaaaagttgcaactatatacacgttgttttgattatgatatcacagcttcaaacatt

SEQ ID NO: 59037 - DNA, 3881 bp, Oryza sativa
attttattaaagtactttttatgactaatctatacatatagtcatcatatttaacagaaaaatattttaaaaatgatttataatcaaatattctaaagtttgacttcacccttatctaaaatgacataagtcccgtgagagtagctagataaccacacaacggcaatcacgtgtgcgatagggaaatcacttttagtttgacatgcatgctgttcaagttagggggtgaatgacttgacataacagaatttaagtctcgattgattggcgccttacacacgtgtgggtgcactttaggagtttaattaagcagtaaaaattaaacttagagtgagctcacagatattactggtctccatttcatgagtatgcgtgattctgataaacatgtaggggctcctttggatggaggaattatatactattaaaatgctacatacatagattttttttcttttctatttggttatttggaagaaaagattgggctttcaaaatccgatgaaattgattcggaatgcctcatttcataaagattttaagaaaagtcaacatgagttctaacatcttgaatatgtttctatgtctatctctcaaatccaaatttatatattttaatttctttcagtctatccaaatcgttattcacagtggcaaagctatattatctttggggggggggggggggggcacctattcatatatttttttcatgtattttacaattatccattttacgtgcacatttctataaaatttctctcttttcactgggtatatattaactgttttccattcctgcattcggaagtcggaagaaagctgtagtgtgtgtatcttctctaatcggaaaaaggctacacatatgcgccgtgcgccgccggaagtagcacgcaaataacccgtgcataggagcaaaagaaggtggacgttgagttttagctagctggggaccatgctattcctaggacggaaattaaaaggcgatttttgtgtatgtgacggcacaagtgattcactaatccgtttcaccttttaattaaatcgcaaagcagagagcaattagagatccacaccatccataacccgtgatcgccgcctatgcatactgatgatgccatcttgatgtccaaaagtcacatcatcacccactagcaatagcaatagttatatatttaacctcatgcatacatacaacatcgtctacaatttatttaattctataaatcaacatacaattatatctaatcatcacctctcatatcatttgtataatattttaacaaatctattgattatttttataatatgttccacattaaagcgtgtgctttgttttatagtaagtattgataaacccacacatttcattattttttttttgtttttaccctaactcgatggtcgaaaatatatattaaatattacttagtaattcctgcagcaaagcatgaggaatcacctagtgtatagaaaccgcataccccagtaccttacagattatcatcgtattcatgtacaattttttttaaagaaaagtgttcattggtatttcacataaaactttttaaaatcaatttaccgattttctaaaaataattcttttgtgccctcaaataatgtcatatataaactcggtttaataaatccatcatgaaaaatctgttgacaacgcaccaaagcgtattctccattttagtttacttttcccttttgaccacgattcgaaacatgatcgtttgagtctcaaatactacatcattttgtattatttcttatttgccaacatttatcactttcttttcatacttcctcacttgttaaatagataaaaatttaaaatatgcacaaaaatatcactaagaatatttttatgttaatattaaatgtgtaattagaaaaaaaacaatggtaaacatagtgatcataactcaactgattaggttacttattatggagcctactcacctgattgcaggtcctaagacttagcacgagtgctcgtatttgtagttaattattcttttagtagtaaaccatgtatccatcgatagcggcgtcattaatctcaaaatatactggtctaatcttcagaggtaattataatgtatgatacatgtgtgtacatttatagagataagtatataagcatagtagtatgagcttttttttagaaaaaaggaaaacaatgatattatatgaaaagggtataaattacatgcccataaattcattgtgatttggttaggaaaggctggtgcggttgaaaacttcaattctagcccattcgcgatgttggccgctaggtcgattaggttgaaactccggattgatctattgtttgtcatggttatattttacaagatcgcagaaaccaagatttataagaccgtgtggttatcgcggttatcacgtgtggtaaccttttcagtttttaaaaccatggtatatctcgcgataaccgcgtagttatcgcggtaaccaccgctactacggaattctaaataggtaccagcctaaagatacaggtttaaagcaaaactggcacctattatcaattattaagtgcgggttagagacaaaaccggcaccaatactttaggttctggttattaacaaaaaaagaggcatctatagttcattcggccactacgggacaaacctatatgtaccggtttaatttaaaaaccagcacccatatatacttaggaccagtacctatgctattaggcattggtaccgctaaattagatctgactaggaaaccgattagagtttatgcagtagtgagccaaactgatgggtgacggtgtaaccccaccaccatacaatttgttaaaccctccgagcacgacaacctgcttgtggcaaacaccacgatgaatccggagctgccttgcgctggactcggctgttgggtactttggttcgctggtggttaggggtggatgccgagccagctcggctcggcttgactcgctctagctcgtttagtcgtttagacggctcgttatctaaacttttgaattatgatctaaattcatttgcacttaataaaagccagcttctgctgtagtggtgcagaggcccgtcaccgatgtagaatacatgtctagagttccatattctagtgctgttggttttttgatgtatgtcatggtttgctcccgtccaaatttatctcatgctatgtgtttggttagtagatacatggctaatcctggtaaagaacattggaaagctgttcagtggattttcgggtatcttagaggcacagctaatgcttacttgaagtttgacaggactgataaggggcttgttagatatgtggattcagattttgctgcagatttggataagagaaggtccactgcaacaggaacccccctctagcaatacatacttggcaacacattaagcatgcgttgccaaaatgcgagcctaacaacgcttattagtgggtgagcctaatttgcaatagataatatgtgttgtagaacatgtgttgcagagattgagtatcttgcaatgcctgagtccactttacaatagataacattcgttgcaatggtctcaatgccctgtaaaaacttttggactaagcaaacttattgtttatttttataaaataattgaaagagatattcttttttttacatttcggacatctagcgagctggtttttttttaagaaatcatcaagtgagttggttttttgccatgtaaaaacttttggactaaagcaagctttctttaaaaataataataattgagcgagctgtttatttacattgtgtactgggcgagctgttttttttaaaaaaaaaatcaagcgagtttatctttttttttaaaaaaacgaatcggcctgtgttaatcga

SEQ ID NO: 59038 - DNA, 965 bp, Oryza sativa
caaccccagcctcggaagacagtatttggaattggaggctcaactgcttctctcgaactcctacgtatagcacattatttatgggatagttacctgatgggcctgatcttctgtcatagtgctaaaagatttttggtgcattgaacctgttcgatgatatggcattatcaatgatgcaaacaccaattaaacttatttagctattgagttgaacatgatattctgactagttcatgccatgtacgagcagaccatggacattcagcattctattgaatgccgcagaaactttctgctaccctgttaatcaagcaaagttgtactccctccgtcccattataagtgcaaccataagtttccgcgcctaactttgatcgttcgtcttatttaaaatttttttataattagtatttatattgttatgagatgataaaacatgaatagtactttactcgtaacttatgtttttaaatttttttaaaattttttcaaataaaacggacggtcaaagttgggtacgaaaaaccatggctgcacttataataggacggaggtagtagtcaatagtaggaaagtattacaccaatatgttatgccgctggatttgtttataaaacaattaccaatctgtttctctacattgccatgcctataggattttaaataaatttgtgctaacaatattttcactggatttagaccaaagcaatgatccccttcatttatgttgcctcttttccaattaaaggaattaactaagttctgaattttcaagagactaatttacatttatggatgataatataattttgatagtttatttctcatgtttaaccttgaatcatttgtactaaaaacattctctctatcctttaatagtcccggcgctgatcctccatcaacgtcgtgactttcaaccccgcagtcaatcgccggaggtctcaccacttggcagtgccccgatc

SEQ ID NO: 59039 - DNA, 20921 bp, Oryza sativa
tcctcacttggcgagctctttatttttatggtagtaattttggatggagatttactgggatcaaggcttcttcaccacaatagctttactgtgtcattagcagatttccttggattgtccaagtgattgagccagatggatgcattttttttatttgcatatatgctttgtgtaataatgttctacattagttatatacagaattggtggttagatcttatttttcaatatataagatatcatattgtttatatgatgataaaatggaatggccgactataatttttgcatctatctgtgttgtgttattctatttccatcttatacaaatacctggagaaaactatttacattgtcaatggcacctaacgtgaataaataaataaaacagacttctccaacgtgaagtggacatagcctagtggtacttggctgcttctactgaattgaagactccagttcaaatactagcaaatgcatatatttttttcatttcttctctagtgacgatttttcatttcttctctattggcgattcctaaaactttttaaattctgtcggctcagattttttaaaatttcttgaacttttttatttctaaattttaaaataaaccatccaaaaatatatttttagaatatgtggtttttcgctcgtcctaacataatttaaataactattaagaaaaaaaatatgttacgtccaaatttcacgcggtctatccgaatcaggtcgacaacgaaataacacgtggctaagacaaaatatgttacatctggatttaatctgcggtgtccggaccacaagtgttttttcggtagtgctagcataatttaaataactataattttaagacaaaattatttatgtccggaatttattcggtctgtccggaccgggtcgacaatgaaaaaacaagttattgtttggtagtggtaacataatttaaataactataattttaagacaaaaattatgttacgtccggaatttatccggtctgtccggaccgggtcgacaatgaaaaaacaagtgattgtttggtagtgctaacataatttaaataactataattttaaggcaaaaattatgttacgtccggaatttattcggtctgtccggaccgggtcgataatgaaaaaacaagtgattgtttggtagtgctaacataatttaaataactataattttaagacaaaaattatgttacgtccggaatttatccggtctgtccagaccgggtcgacaatgaaaaaacaaaaattatgttacgtccggaatttatccggtctgtccagaccgggtcgacaatgaaaaaacaggtgattgttttgtcgtgctaacataatttaaataactatatttttaagacaaaaaatatattacgtctgtttttcatgtggtatgtccggaccgggtcgatgatgaaaaaacgcatagtttttcggtcgtgctaagataaattaaataacgattattttaggacaaaaaattgttacgtcttgatttcatccggtctgtccggaccagattgacaaaaaaatacgttttttcggttgtgctaagataaattgaataactactattttaagacaaaaatatgttctgggccgagtcaacaatgtaaaatcaagtggttttttttttgtcgtactaggataaattaactaactacttttttattaagacaacaatatgttacgtctggatttcatccagtctgtctagaccgggtcgacaatgaaaaagcacgtgatttttcggtcgtgctaagataaaataactaactactattttaagaaaacaatatgttacttccggattttatccggtctctcaggaccgagtcagcaatgacgcggtttgtactactagaaaataatttttactagtgcatttatgaagttttataactacttcttattgatccgcacaaaaataaattagctgaactagattagataactggaggttaaatctgccctgaaaaaatcgagcttaaatttacttgatgtgaatttaacattttgtgtatttgcgcaaattattttgctctccctccattctttccctcttttttcagtcttattccaaatcattccctccaaaaaattgagcttaaatctacccagtctgaatttaacattatttttatctccgacaaaacgtttgctctcgctccgttctttccctcttttttttttcagtctcacgttattttccaaatctttccttcgaaaaaaaatgagcttaaattattttgctctccctccatttttttcggtctcaatatttttttttctcacgtctttcgttgtcgcgccatttattccctccattttatccctccaagaaaatctaattgcccgtgaaaaactctatcccctctctctccattctccaacaaagagatcgtgggtgggttttcttctccaacgaaactctatcccctctcttcttctctccgctccgcgtgtccactcctctcccaatctgtgttggctgccatcctatgcacctacctacacctccctgccgaccaacaaccctgagcaggcgagctcccccacggccgctgagggccacgcggcgacgcctcgtgcccggtggccgtgcactgcagcgctagtgcggttttgcctccccagcgcctacgtctacaccgcgccgcgcaccccacggccctgccgccatgctcctgcatctccgcctcccttcctagttcctacatgtttcactacttagctgtgttgccaaatcacactcgggcctaattccatttcagcactatactacattactaatttgatatatatgttctgtatgcaggttttggatcagatgcagtgatgaatcctaggtgacagagcctattaggctagaacagaccagtaagcaatccaatgtgtgatctttttatattcctctgtcctggatgttgcaatctagccgaataaaccacttttgcttttgatcgttcactgtccatctatgcattttatctccttgcgtcaaattaaattttgttctttctatcaattacttgtttcaaattgttggccaattaaaatggacaaaggaattagtgactggcaaataaatccaaattggaattggtaaatttattgttcaatttttaatgtgttgacacctctatttgaaaattgttcattagctaacagaggtatctaataacctgtaggctagcacctttctcatcaatacaaaccatagtggtacttttttggacaacagtagagtaaaatgcctaaagttttagccaattctgaaattattcttctagagcagtagagaaaagtggtactcaaactgcaatacataggtttatgctatttttgttttggtgcagcagatatggcaaggagtagaaggcggtgcattgttcaaagccatgaggaatatttgtcagaggaacacattgcagaagaaaatgcccctaaacagcttgccacaccatctgaacaagaaacaatatgtagtgatgttcaagagggtaatgaagatactaatgacgatgttggagaagccaatgaagatactgatgacgatgctagtatgaatgctggagaaggcaatgaagaatctgatgatgatgttgaaattaatgttcgaggtaaatactaaatcttgatggtaagaaataatgaaattattcttcttatccttgcaatttaacattgaacagatgaaaatggaacaattgaaacacgtgggaagacaaaactgaaagatatttggaaccttccgaaaaggcttaggattgtggttcagtgcaatgatctcaaccaggcagtaggagatgaagctggaattttgtctaaatttcttggaatggtagctaggaatggtactttgtgtagcttaagctacacagactggagatttctaataggaaagagagagagaaaaacaaaatccctagatgagtttctttgttggtatccagatgagattcctttatgctcctcggatggaagaattcatattaaaaacaattagagagagatggaggggacataaagcaaaactaaaagaaaagtattttgatgtgaataagagcaaagaagctaattgcaacaatgtcccagctgatgtgcttcctgaccagtggattgctcttatcaatcattggatgagcgagaaatcgaaggtatataggcattgcatattcactactgtgatgttcttacaaatgagactatcaattgaactaaacaatgttgtgctcatgtatatttgctaactcttatgatacgagaacagaaaataagcaagcagaacaaggaaaattgtcgaaagaagaaggcattacacacagcagggacaaatagttttgctcgtacaagagaagagatggtaaaacatgtcctggaatagcatttgtccaatttccattccaatcctatatagactgtgtaggatttaatgatttgttcacatgttccatagagacaaaaagatcctgcaaagaatcctcacagagctattgtgtacatccaaacacacaagcgcaaaactggcaagaatctaaatgggcatgtggtatactatcaaatctaaactatagataatttaagtttcaactttttttcatatgttctattcatattgttcctgtgtttaggataatttgaagaaacttgtagttgaacaaccagctttagcagacactagtgaaggaaggactgcttggaaaggagatgcattgaaccaaatacttggagatgacaagcctgggcatgtgcatggtcttggactagttccaaagcctaaacaagttctcgatgtgccaaattcctgacgcttaaagaatataaatgttactagactggatgataactggagtgaagatgttgtggctgctagactgcagttggaaaagatcgaaaatcatgtccagaatcatgatgctgagcttttggaattgaaagcgaagacaaacaagttggaaaaagaacaaatgaatcaggtgagaatttgaagaagttgtcctaaaatgtttgtaactcactgaatgtatctaacctacctagttggtgttacagggaggtttagatcgagtatctacaaacaaagaagctagtgttgatggccctatttcgaaaaggagggtatgtatctctatggaagattaccctatatagtttggaaaaaaatatggtctaaaactccttttcttttctactgttgacagagagtgtattctgaccatcccttgcaagaaatttgtattgctgaggaggaaaacgatatggttcaggaggaaaacaatatgatggtaatatactggaattgcactattgtaaagctaggaatagttgcactattttgtaattgagaatatatggtccctttcaaaacagaatatacagagccatgttccaaatgaggatttgcaaccaaaaaccaagcaatgtgttgaagacaaggtacttgtcttaccaactatattattattctgaacccaccatgattacttaacattatatgattttgtactgtttgtagctatggttgtttactatagttcataatcttatgcattttattttagaacaaacaaaattgggaacaacatgactatgggaaacaaaggaaggttatttctgcacaggttagttttcattttttttattgattgcaactcaccatgtttgtgctattttaatgcaacaattgatgaaacaatccatgtcttagagttttcgtaatgtttttttaccttcttctatagaaaaaaaaaactaacaaggaaaaccatgtgatgaatgcacgaaaagttgttgaagcatccaaggttattttttattcatcatgtctataaatttctgttttttacaaaatatagcatgtatgattgactagtagttttgattacattgcagaataaagaaagagaaaaaaaatgctcagagccatgttagactaggccaaaaccaaccaactgctgctcctaaggtttgtactgtttattctattatattttgcaagggattgactttgtgcacagatttatgttttgctttagcacttcaacatttattttgactgtatgcagttaagttgcagactcatgatcgaaacaattcttatttttacagaaaagacagtgcagcacaacaaactttatcgctgacaattcaatggaggtaaaccatattaaagttttactgtacagtgcttcataaatatatggtatgaatctccatttggtttctactattgttagagagtgtgtgttaacggtcccttgcaagaaaattctatggttgagcatcaaaacaatatgattgagcatgaaaacaatgctatagtaaagtataaaaattacactgtttttagctgggaatagttgcactattttctaactagtaatattgtctctctttcacatcaggacacaaatatccatgttcagaacaaggttttgcaactaccaaccaagcaatctactatatataaggtcattctcttcttatttgttatgtcgaactcactacatagcattatatgatctcgatattgtttgcaactgtcaacgtttattgtagctgttcattacaatcttatgtcttattttattacagagcaatcaaacttatggccaaaatcaccttgagaaacagaggaagattatttgtgtgaaggctagtcttcacttttttattgattggaactcacagtgtttaattataaaaataactagattattgtagtttgtgccaatattttgatattccatgcagaataaaggaaacatgaaccagaatgatcacatgcaacaagggaagaataattctaatgcttataaggtaaatttttacttctggagccacctaatataaagataagctatagaattctatttggtataatatgtttgtactttatagttaaattattgaatcttgatccaaataactttgtacataaacaacagtgcaacatagtgaacattatggatgccaattcattggagataaaacttttaatatgatgttcttttccatacttaattgctctttatgtagagataatgctcatggacatatatttatgcaccagattggaactaatgtattcttgaaaagctggaaaaatcgaaataagaatgtggctgttgcttcaattgtaagctgtgatccaacacgcaaagttgcaggtgttgagctaggaactgaatacttgatggtgcatgttcattttccattggcaaaatatgaagaattgatcaggccatacaaaggctacaaaattattagcaatgtcgtaaaacttgatattgcgtggccagcaatttttgtacggtgctatttctcaatttctttagatgtggtcttctttcttccaatgttgtatcaatggttgtttttttctgttacaggttgacaagataaatggatcatgatctggggcaatatggttactgcaaggtggacaactgtcatctaaagatcccttgtgaatatgatgatgactgtaatatggaagatggtggcaatgatagtggcaacttcagatgcatgtttttttttctatagtttagtttacatttgtgcatgatgttctgaacaaaatttaatgtcatgacttatgaggatgattttccatgtaatacaaaaaattctctttaattacaattagttttatgaatgacttggtttttctcatgtgtacatcatttgagtttatgtgcctctaacccaacaagataattgtgcaaaggcatgctggaatgaatagttgcctatattgcaatacttataagtgttggtgcaacttgattatagccgttgcaaggattatatagaattgttcatcaccgaaactaccaacgcatacaagtatggctgaaaactatttactttgttgctaactagcaacgtttattcttacatgttaccaacgattgtgtatgtgttgttattggtgctagcaacagcagcataggcaatgcatattaaatgcattgatagcgcatattaaatgcattgatacagaccctagcaatgcttattttcactttttgcaatacatatatgtattgctaaagggggttcctcttgtagtggtcactcacaggttatgtgtttaccattgatagttgtgctgtgagttggaaggcaacattgcagcctgttgttgtctaatctaccactgaagcagaatatatggctattgctgaagcatgtaaagagtcagtttggctgaaaggattatttgctgagctttgtggagttgatttttacattagcttattttgtgacagtcaaagtactatatgccccaccaaagatcagatgtttcatgaaaggacaaagcacatttatatcaagtaccattatgttcgcgatgtagtcgcgcaaggtaagctaaaagtatgcaagataagtactcatgataatcctgctgatatgatgacaaagcctattcccggtgctaagtttgagctttgctcaagcttagttggtatagtggtttagcccaagaggctatttggcgccgaaagtgttttatgtctttgttgtgttcaggatgaaggattgattcatgctacaagaaggaatttgtctcaaggtggagtttgttgagttgtgatacaaatttatttgcacttaataaaggccagcggagcccccgcgaaacggatcgttatcccttttagggttccaccatatatatacctcatgtaagccgctgtgtggcgatataaactccccagatatagtgaagatattttgctggctggcgcccgtggttttttctctcctgttttggaagggttttccacgttaaatctcatgtcttatataattgatatattgttttttatcgattgttcgcatatcatttccttaacataaacgaccagaaaacgcagctcggctcggctcggtcagtagctcgagctagctcgttttggctcgcgagctggagagggcaagatatcagacatcgagattagaagagctaggacaacgaaacgtgtgccgacgagcagcctgcagcggcgaggacaagcacgacggtcgacggcgaggcaggcaggtatcccgcagcagcgagttcgagtgcgacgaccgacgacgcaacaatctgcagaggcgaggtgacagcgcatgcgacggccagctggggcgacgccgcgacgactgacggtgctgcagccctcagcgcaaactggcagaggctcgcggcagagaggcggcgacggcgcaagcaccagggaccgagaaggaaggggcagcgcggcgtggctgcgaggtccgcgcgtgcaccatgtggcggcgctgggcgatgagcggcggcgctgctggcgcagatggattgtgcgcgatggtggcggactggcggcagataggcagagtgaagacgagagatcgagactcgagagaggcatatagggtttgtggtaagtagtagtactactggtactttccatgctctgatgggcctcgtggccttgtggcttgggattgttgttgcctgctgggttgtcaaatgtcaaagttcgtttcggctcgcgaccagctcacgagccagcttaacgagctaaaaggctagctcggctcattagaaaaataaaacgagccaagccgagcttgtaacgagtcgagcgaactaacgagtcacgatcttttatccatttctactggtggtcaccacccgctgggacgacgccgacgccaactgccctcctcggtacgtgttgtgcacacgtggctaccagccatagtgcaacttaggctgtgtttagttgctcccccaaaaaaaaattttgacgtatacggatgcacatttgaagtgttaaacatagactaataataaaacaaattacagattctgcctgtgaactacgagatgaatttattaagtctaattaatccatcattagcaaatatgtactgtagcaccatattgtcaaatcatggcgtaattaggctcagaagatttgtcaagcaatttacatgcagactgtgtaattggtttttttcgtccatatttaatgctccatacatgtgtctaaatgtgacggaatttttggaagtttgaagggaactaaacacagtcttaggccttgtttaggcatggtttagttcccaaatttttttcccaaaaacatcacatcaaatttttagacacatatatggagtattaaatatagattaaaaaactaattgcatagttatgggggaaatcgcgagatgaatcttttgagcataattagtccatgattagccataattgctacagtgacccatatgtgctaatgacggattaattaggctcaaaagattcgtctcgcagtttccaggcgagttatgaaattagttttttcatcagtatccaaaaatcccttccgatatccggtcaaatatcttatgcatgcgacacccagaaattttctttttatgaactaaacaggcccttagttcccaaaacagaaattttcacgctgtcacatcgaatgttttaaatgtagagaaaaaaccgattacatgtaaattgcgagacgaatcttttaagcctaattgtactataatttgataatgtagtgctacagtaaatatatgctaatgacgaattaattaggcttaataaattagtctcgcagtttcctgacggaatccataatttgttgggactacctaaaaaactgtcgagtgtttttaaggtgaaaactttcaaatctaactatagtgtataatttcactagaactatactataataataataacttatatatatgtattaaaataatatatacaactttatatctaatttatatagagataacaatatagttacaatgtaattatagtgtaactacaatgtaactagcatgtaactggaatgtaacttagatgtaacttaaataaatctaccataaacatgtgatgatgggactagcttgtgaaaagagggtttagatccgataacaaaatatctcagtacaaatcttagagcggaattgatggccaaaaaatttgacaattttcacagaagaaaactgtcgacagtcatctagcagttccgtaatttgttttgttattagactacgtttaatacttcaaatgtgtgtccgtatatccgatatgacatccaaaactaaatattttcccctactaaacgaggcttaattagatcgtgcggcgcaatcaagccgcctgtcgcgcagccctgctccacgcgctgccgcctgtgtgcgcatgcatatgcaggaaggctctgcacacgttcagccgtccgcaagtcgaacgcgacttgcccgctcctccgctgtgctcccatccgttctcccgacgcatcggacggacctgattcttccgcgatggggactgttcttctttctcctaagtcctacgtactcttctgacctgcattggatctttacctttttataccttggtcctcttccatgaaaataactgaagcaaagggatcacggacaattcagcgaggaattgaacgaagatattggttggaatagatcgactacggaggtgtgtgacgtgtttgtcatgagttagaatggtgacaagcggcggcaagatttcttatttgcttcggcaaaccggggtggaggtagagtatgggaagagggtgcccagtaacccggttaagaaaattttttagctataactcaccgattttcaccatgtgtacagcccctaaatacaaactttggcagccgtatcagtttaaacttgatctaaagtagagtaaattaagcaagagccaccctcctccattttgttctagctccgctcctggcaaagcgatatatcatatcatcaacactgaggatcaagtgtagattgttaatctgaccttgattatcgctgtaattaacaccgtgcagcaaaatagcagattaggatattttctatgccaagcatccctaaatacaaacttgggcacccgtatcagcttaaacttcatctaaagtagagtaaattaagcaagagacactctcctctatttcgttctagctccgcccctaacggcaaagcgatatatcatatcatcaacattgaggatcaagtgtagattgttaatctgaccttgattatcgttgtaattaacactgtgcagcagaatagcagattaggatattttctatgccaagcatatgttgccctcatatctgaggtcattacctttgatttctttcgtaggagaagaatggaatggatcattaaggagtagttctagcatacacttcacttttcgttgaagatatttcttttccttttggaaaaatgtcgtcgttgatttggaagggcagagaagaagctgcaggacccaccgctggagaaacaaagcggttcgatgtatcgggagcacggatgggagcaggcaagccacgtccgttttgtgggtggacggaaagtttaagggacaaacctataaaggaattttgtgcgtcgcaatgaagacggatgatttacagtgtaaatagatggataaaattaaaagaactaggcaaaaaggtatatgcatattgaaaaaaaaatgattcaattggttaattgtgttgaaagtgattgtgtttccaattaaacaggccttggcccttaaaatagacggtattgcctcctataggtactcatctatattcaatttgagatagagagatcaattggaattcaaaatttgctttggacttggactcaatcggtctgaccggccacgtatcgccggtcaaactagccccatgtatacaattcaaaccataagccatgcaccttgaaacagtactcaactgaaggggttgttttgtgaatagtttaaagatgtgaaatcactgatagggtgcggaatcatttgaattcaagagggcatttcagacttttttttactagaaaaaaatgtccgtgtattgtaacaagtgatggctattatactcttattattgttatatggtttatttaagataaaattctctattaaattcgcttggatatatattttgttagaaaatcatgagctgcattaggaatccgatcgtctcaaattagcgtgcgagtttttttaagagatttcctatacaattccttttatattttcaaaagcgaacaaacttaaaagccgactcaaattcgtatttatattttcaaaagcgaacgaacttaaaaatagactcatacacaaataacgtatcaaagtaccgacaaaaataacttcaatttataatagtagagatttcttattataatggagacaaacatgttcctcatacatgaacaccacatgcacacatatgtggacgtccctcttaacgcaggccacaatgctatgatggtttaaactaagaagccgagttatggaataacaattccttgaccacaccaaagttttttctttatccgaacgcacgcaaatgacatattctctttttacaatattgttttaagacacaattatgtgtgcgctttgatcagttggaaatttgtgaggttcacatatctatataggttctgtctcctaaacacgtgtttaaagtactccctccgtacaccgttgacttttcaaccaacgtttgaccattcattttattcaaaattttcgtgcaaatatgaaagtatttatatcatgcttaaagaatatttgatgatgaatcgagacacaataaaataaatgataattgtataaattttttgaacaagacgaatggtcaaatgttggataaaaagtcaacagtgtcatacattaaaatatggagatagtagtatatttaggtttgtaaatacatcagcacggtgtacaggaagtacaggttatgtggtgtggtagagttgtgagtgtatgatttcaccctttaagatatcatacatacgtcggtgtgttttcaataggtttttaagtcaaaatatggattaatttagaggacttttacggtacattctactgctagtatatactaccagtatatttgatctaacggtgtaaattcatctgatcttcctcccaaatatcctgtagtataaattgtttagggtatatttgtctttttatctatttgtgtggggggtaattttttaaattcgcgtttcctcacttgatctgatccgatcgatagccgcccgcccagtcgaagccctttttttctcgatgttgcgtgcatgggcgaccgtcgccgctcatttcttctgcgagctgccgacgaccacaatcggcgccgccgcgccgccgttctttctttagtaagttcaatgaattaaggacttggtatgtgttagggattcagacacttagaaactgatcgaaccaagaatgtatgagataatccacttcattgctgtgaacagatcaaatctatttacactcttatgtggtcttatgcaaatcatgcccattgcaaactcaatctactagattaaatccgaccgtcgaaggaattgctacgcctccactcgcgccgtcgccacgcacgatgggagcgctacaacacccggacgacgagatccatgaactcccgattgaattaaatcgcaagaaataaatctcaatttcaaattactaaacagccattttcagagttttaacaaataccaaatctaccctttaacatactgctagtatatactagcagtagaatgtactgtaaaagtcctcttaatttatcgttggtgtccatatcatgttttacagggggcatttgatttgtgggtgtatttgaaggtggtgtgcaggtgcgtgtagcgtatacgttttctatgtaatcacaaggaaaaatatatgtggggtgcgcctctacggtgatatctcttaatctttatgtctttgttctatgtaattataatagaaaataaattaattatttaatgacttatgaacaaataggtcaatgaatggattcatataagtttatgtgagatcaatatttatttttgcaacacatggtgtctgcccgggatcaacggcccgtcacatgatcgatcgtgccaacgtgccacacagacaaacctgagctatcagacgttatggatctagtatttctcaaagcacatgcgtgcacgattcatctgtgcgcaaacaattgcataaacataaataatatctgaagttaaaacatagtcccaagctcagtacaggcgttcaaattttggaaatgcaagaaaaaaacaatttgaaacctaaacagatttacctaaacttgaacagtaattttttttctaaattcaaacaattttgaccttttgcaatatgcatgcatatccagctatggcctaccgattgctcaaatccgactttgtatagtttgcaactgtgctacgaatatgtaccgtgcaatagtaaagtggattacgggactcaaccgtaaacaacgcatagtcggagtctcgaagaacaccccccctctcccgcacctcccctcttttcctcctcaacacatacaatagatacaggggtgaaaaatatcattttgaataactagatgagatttgtcatatatacttaaataggatttaagtttagcaactagaagtggaaacacactaaagcagggccctatcaaatgtagaatgtttcaagaaaaagcttggaaacagatagtgcagtacttttcacctttaatcgagatgatggcatccgatttgatctgtcgacgattccccaagttttggattctcacccgatggaacatatgcacacagcctagctaccgcaatttggccacacatcgatcacaagagggaataattcgattccatttcaaccttcaaaatatttgcaaccatacaatcatcgtgtggacggacgatctcgatcgatcaaacgtaatcaaacgaaggactacgaaatgtacattgtcagcaacctaaaaagtctcacatatggaaaaatatttcaccatcgtccacgtacacattgactagcaaacgaacactaccttctaatatatgttcttttagacttttacacgatgaattaaagagtaataaaatgtgacttgatatctagatgaaccaaacaaatcattagaagaggctaattaagcaggaaaagtaattaaaagtttacttgatttattcttctagctgcgagcggcggcggcgtcgtcttctacggcaatgtcggtgacggcggcggcggcggcggcctcgatccgctcggccatgcccttgccggcggcgtcgaggtaggcgagcaagccgtcccttgtccaccccttcacgggctcgcactcgaacgcccacacgagcttgcaccctgcggcggcggcggccgccggcgccggagcgttgacatccacgtcctcgccgtcgtcgtcgacgagcgtcatggtggcgacgtagcggccgaaccccaagttgctgccgacgacggcgtagacgaggcggcgccgggcgtcgtccctctcgagaagctcctcccgcgcccacgtctccaccccggcggcggcggccgccggctgctggtcgtcgtcgtcgtcgtcaccaccatccttagctcgcggaggtggtggtggcgggcgggaggcgacgtagcggacgcagccggggacgccgtcgtcgccggcgacgcgctcgcagacgtcgatgccggggttgtagcggtgcagcgagcagaaggcggcaaggtgcggccacgccgcggcggccggtgtcgacggcagccgcgcctccaccgcgccctcccactgctgctgaggctgcgcccccatctccggctccggctccggctgctgctgctgcggctggtccgccattgtcgacgtggcgttgaaggagagctagcttagcttagcgaggtagcgagagtgtgaagtatactgcttggagcgtgaaattagatgctctggtggtggagacgaagtagtggagagggtgaagatatattatgaacgccttccactcacgttaagtttagaccaccccgcttttgggggagagatggcatgcgaaaatgtacagcgtcatgtgcactccagccatattaatcccctttttttaagtaggtttgtttaaattaagtatggctcggatgccgtccagtggccactctgcagagatagggccaaactccatagtaattaattaagtattaccagtacctattataaattttaaaaataaatttatttgaattttaataaaaaaaacttaagtaataatttatttcgaaaatgtactgtgtttttaagccgttcgataagcttgctaacggaaaatatgagaaaaatgcagtctatgtttcggatcactactagatcatccctgccggttcgatagtgttctaattttctcgtccaatgtaatcccatcatagtatgacactattacagtttggaaaaagtacgaattacccctcaaactatcgcggtcgaccgaattaccccctaaaccataaaataggacattcctcaccctcaactatgtaaaccggacaaattacccccctcgacccaatccgcggtggttttggtctacgtgtcgcacgtgtggcagtccagtcagcattctattcattaaaaaatgtgggacccactctcttgtctctctcactcttcttctctctcacgcgcacagtggcgaggacggggccggaggcggcggcgaggacggcggcacgcacggcatggcagcgcgcacgcacgcacgcagcggcgaggacggcggcatgccctgcacgctccgtcgacctccctccgccccgcgctttctcttccttccctttcacctccccctccatcggatcggtgccgccgccgcaggagctcaccatcacgcggcccgatgactgacacctccacctctgggaaggcgatgtcctgtcagccgtgctccccacaggttggtctgctcggctcggcgtcactggctcgttttactggtgccgcacgcctagtgttcgatgttatgtctcagtgaggtggcctgactgcttgcatgatcgtgtttgcatgtttttgggcagcgcgatgcatattgggaggccgtaatgcccaacttgaagccaccggtgaccacaacagcacgagctttggagtactaggaggagatcctcaaagcgctgcgccgccgcctccgggccctatccacgtgcgtgtgcgccgccgtgcgcgtctcagccacgccgccgtcctcgccgccacctccgtcccctggccgcgtgcgtgcgcgccgccgcgccgtgtgtgctgccatcctcgccaccgcctccactccccggccacgtgcgtgcgcgccgccgcgccacgcgtgccgccatcctcgctgccgcctccggccccccgtccttgccgctgtgcgcgtgagagagagactaagagagaaagagtgagagagaaagtgtgtgagagagaagacagagagtgagagaggagagagaagcgaaaaagagagtggccccacatttttttttaatgaatggaatgctgactggactgccacgcgtacgccatgtagaccaaaaccaccgcggattaggtcgagggaggtaattcgtccggtttgcatagttggggtgagggatgtccggttttgtggttcaggggggtaattcggtcggtcgcgatagttcgtgggggggtaattcgtactttttccttacagttttggccttctacgatgaattttctttgacactttgaaaatgctatagatcactagtaatagaacatttttttccaaatgggtcaaaagtgattttcgcgtacggaccttcagtcaatctgcccagaaagatcaatgaaaaccactatttttccacgcaggtggtccacccgcacacaaaaatcggtgtttcgggtacgggaccttctgcccgaaaagacatgcgaaaatcactatttttccatgcgggtggcgcacccgcacacgaaaatcggattttcacgtgtgggtgcttatgtagtccgcacgcaaaaataaatatccgaaaaaaatcgcaaaaattcaagggctcgtctgcccgctgccatcttactcctcctgccactgccgccgctgtcgctggatccacactgatcggggatggccaccggatccgagcgggggagccgccgtcgcctcctttaatgcgtgggggagcctgccatcggctgtgcctcccaccacccgctgtcggcggtgcctccagccgcctatcgcgaggccggtggaggtggatccgcttgttgcccgccgcctgccatcagctgcaccgtctatcgcctgccgcccacggatctggtcgtcgcgggcccggccaaggtggatccaagcgtccaaagaccaagccgcgcgccaatacctctcgtccagagaagatgagagggaggaaagtgagaggcggggaggtgagatgttgtggggaaaatgaaaaacgaaccaacccaatccccttgccggagcgttgagaatgggcagatctggccaaggcccttcatcgagcggatctagctagcgtccacctagccggagcgtgacagcatgtgagatggccaggacttagccaatccaccaaggcagtaggcggccttgaatagtgggcaactgtgtgacaacaacgagggcgtgacgtcgagactcgttcggggcgctctcgccactgcagccagcacgggggcatacgcacgcaggtgcacggtagctcatgatcccccttggcccgatcgatggagctggaggttcgggatgtcgtgggagaacgatgatgggtcacttggaggacaattaagcaggccggatgacagcggccttggacgtcagtgggcgccaaggcgtcacccaacagccttctcggtgatagcaaatgatgtgcgcacactgtatattgtctctcatggtctcttgggctaacctaaaattttgtactatcaggccttttagccgctcgtctaggaaaaagtacaccgaagttcggtccctcaacttgtcatcgagttacaaattcgtccttgaaccgcaaaacttcaacttataaaaccagtgcaaactatatccctcggcgatgttaactccagtttcatccgacgtggaagcttactcagcgtgggacccacgtcggtcccacctatctgcctctccacctctcttcctcagtcctcttattttctctcacttttctcctctttagttgggcagcgcaggatgggtgggggaggtgggagtccggcggccggcgacaggcaacgaggcggcggcggcaacaacacgggagcaggagggcctcaccccacgccaccgctaccgccgccgctgacggcgcgggcgctagatccagccaccacgggcggcggtccatggacacgtgcggtcggtgaacactaaaccgagggacacgtgcggccggcgacaggcgacgaggcggcggtggcaacaaagcgggagcaagagggcctcacctcacaccaccgccgcgccgctgccaccaccgatggcgtaggtgccagatcccactgccacgggtggcggtccatggcggcttgtcgatggcgcgggtgaacatgtccttcactccgtgctggcaaggtcgccacggacgtgccgcgtgagcgcgtacctcctcatcgcctccccatccaccagctccaccgccaccgcctgcttaaagtagtcatccgcgtcaccggcatggcatcatcgttaatggcaaaacacgtgggaatgcaacgtcgatggcgacgatgtgtgtgtacctgtcgaggtccttgtcaaactggtagaggagctgcacgtggttggagaggatgagcgagttgacgtcagcggcagtggcgatgatcctctcatatgtcgccttccatcggtggacacggatgatgtcgatgatctcctgcaggccgccctcgtcgtcgaccaactccaccagctcaggcatctcgacgtcggcgtcctcgatctggtccatctcgccgccacggaccaccactcgtggcggctggatctggcgcccgcgccgtcggcg

SEQ ID NO: 59040 - DNA, 24255 bp, Oryza sativa
  unsure (1)..(24255): unsure at all n locations
ctttgttattttgtgcacttgcatatttgttgtgtggcttgttgagtatgttatatgctcattcttacaatattcattcatcagaagaggagtatctcagtgaaggtgatgatctggaggattaggcttgttctcggttaagttgcctgtggagtggagtcgccatcgctgttccgtagattgttttagttttatttttccgctgcgtagaatgttatttttctttgagaggaactatctacctctgtaataatttattatttgcgaatattaaatagttattcatttgtactctattatcaatattgtcattgtgtgcctcggttgattcctggacgagggtttaacacacatgtaagcgtttggaattttggatagaaattccgggcgtgacatttatcccggtgcactgtgcacatgcccacgggcttctaggagatatgatccgggcgaccaagggtgaggtgtgcggctagccatggttcgttgtcgccttgccagagcgcctttagtcatggatgccccaactggctggtccctcgtgaacccaagactggacctctcttctttggccatttggccatatggtattctggtccttaggcttgctgctgtagatgcaccagcggaatcctggtgacatctcggcccaggacttaataaaattaatagaatattcatatcaataagttgtaacttttttttcggaaaccgatctctaaggaactctgaagttgcttggcctggagcaatttagggacgggtgaccgatcgggaaattcttctcgactgagcacaaagtgcgcagaaaagatctgtgagggcagtctatgacctatgtaagcgggcctggcctaggagaggcggagacgttacaatcctggagaaaatatgtatcatggaaactaggtatgtattgaaaacttggaaactactgctcaattgaaaaaattttactcacggatttacttataagtaaaaattttactcgcatattttctccattatcagcgtgaaagaaatatgaatccactgcggctgtatagctgtaggccatagcatagctgcaccgaagagcctcaatattattgtttttaataacgactaagcgtcaaattgtgcgttgcacgatattgttatattacattttaaacaatattaaaaaaaatctcttgcttaaattttagttccgacaaatgtttcaatttagtacttttttacaaggaatatttttcttaatttaaatttctttagttgtgaaattataaattactaaatatcgatatcgagttatacttgtatgtttttcactatacaataattttaaaatttggaactatccaatattgagttgggcttttgcagatgatatggagacaaaaataattgtggctttttatatgattaaaaaatacttcctatgtcctataatataagggattttggaggatagtgctagaaagtatcacatctctctaaaatcccttatattatgggacggagggagtagaacttatgaattaatcattaatttttaacgtagagtcttgttttgttattttcttaatgcaataatttcgtaacttggaatcaataaagggagtatctgaaaaacttgtcacaagtttcttgagtcaaaaacattcagatgtaactataatatcatgaaagtgtaattatactgtaactgcattataactacattgaaattacaatataatttatataacggtttggttagctagcactaaaatcttacgtgtgatatgtgtgaaaatttctttctagcaagtttttcctttcatgcagaaatttcgaggcaatccaatggtcacaaatctgaaagttttgggagcaaaaaaattgcaaaagtttttaagcaaatccaatcaataaaacatattaacccgtactccctccgccccaaaaaagaactcaattctagagtttgaattttgttccaaaaacataaacttctaccatcctaactaccttcagcacctaaaacgataagttttatctcttaaatactctttatctaaatatcatcattactactttttttcaataactagaaaggaaatccgcgcagttgcgcgggtaatttatttgttgtttataaaaagaatgctaaaaaaagttatatctcaccatatttactataaggatcgtagattaccttaattatactcataaaaaaagaaaaaaaacactttattctgcttacatatatggtcgcctatggccactacttattttcattgtcggtgtctttttaatagatagaattgcatttgtacctaaaaataaacataatagatcattaataaaatgagaagtccttcttcacttcgtaccaaaataaaatgctcatgtatgacttgtgtccaaatgcatgtataaatatttaaaaatatcatttttaccaattaatagataaaaccattaaaattagatataaatgctcgtctaatagatgaagcatagtataggcgctatggctttctactatgatggcttgaaacgatgtacccatcttccttaggaacagtatgaagcacaattttaacatttaagttcattgttagtacactcataaaggattgcatggtaagaaagccagtcgagcaatattgccaacagagccatctcaactcagcaatactatcatacttattgttcatacattgcaccctttacggaatgattaagagaaaatccaatagcttacgtcctgagaaccacatggaataatatttactcaagctataattcttcataaacatatgagttaatatgggtcttattattgttttcctttattgtagatcttactcatccatgcatgttcaacgtttaatatacgataaaataatctatgctgtcattttttttaattgttaagacaatttcgatgagaatgacatgaaaagagaaagaatatgttccatgtgatatttttttaataaaaatgtagttaacatatttttatttttatttaaaaaaaaatgaacaatcaaggttcgtaaataaatattgctgatcgccaaatctgtgaaaaattgctgatcttaatttgcttcttccaattgtccttttgattgatggattgacctgttggaataaataggctaggcccaatttaattcattaaaatctcaagaggccacaagtaatgttagagagaataatactgtcttgaaaatttagatagaagaacctcaacttaaatagggtgatattggagattccctgttgaccggttgaggtgatggttggactgccacacgcatgcgcgcgcgccgagtcggcctcggccgtgggcgtagcgaggcgaggcggccgaccgagccgagcctgccagctgctcttccgttttgtaacatacgagaataaagtcaccattaacgaatgaaattcattgtgttgtaacctccacaacaaaagagaggtttatttgttgtaaccttcacaacaaatgaaatttattttgtggtaaccttcacaacaaatgagatttatttgtgtggtaatggagatctctctctaaatataacacaagacagaggctctcaaagagtgtgtcttcctacgttccttggcgatactctccttgtgttcctacgttgtctctctgtttccccagttctgttcatctcgcgcgcacgggtgatcggaacgagcaggtgcctccgaaactccgtcggcttgagaacctgcacgggtagacgggcgatcaagtttttgggtagcacttcaagcgcgactgctttgcatcatcttcaccaacatgtcgacaaccggcgacaacaacaacactggagacaaggagaaggagcctctcgtcaacaccaacggaggcaatactgcctcaaactccagcagagggccattctcgggatataacgtttcactattaccgttcgttcttcgtttcctacaactgtcggtcgcagtattattgcgttctcttatctatgttgatgcttattctatattaagcatgctcatgttgtacacatctagcactgtcactagatctactcaaattacaaatgtcatgtttattgtcttaatattttagactaaaatatgccgaattacgaccaaatttccaacaatccaaaaacttgataggtctttttcggtagttggctttgttgcatcactaaaaccacatgctttcgatggttcaaattataaaaggtggaaagcacgtgcacttttgtggttgacggtgatgcaatgtttctttgtttcacggggcaaaccgagtgaaccgccgctctcccctgaggaagaggctaagttcgaggttgcggattgcttgttccgtggagcattgatcagtgtgctcgccgacagtattgtggacgtgtatatgcacatgccttcaaggaaggacatgtgggatgctcttcaggccaagttcagggtttccgatgccgggagcgagctgtatgttatggagcagttctatgactacaacatggtcgacgaccgttctgtagtggaacaggttcatgaaattcagatgctggcaaaggaacttgagaacagcaactgcgagttgctgggttgctggacaagtttgtggcgggtggcattattgccaaattgccaccttcttggtcggactttgctacttctctaaaacacaagaggcaagagttcagtgttactgatctcattggctctttgggtgttgaggagaaggcaagggcaaaggacaaccggggcaaaaaaaagaacgatggaggttctagtgccaatttggtgcagaagaagaaccctcacgcatctcacaacaacaagaagaaagtcaaacctgacgtcaaacctaaggctacaaccaattttaagaagaaaggccagggaaaggcaaaagtagatttctttgtgtgtggcaagcctgggcattgggccaaggattgtcttgatcgcaaagacaagaagtctgccaacatgatcattagcgagggcggaggaacatcggggtatggtaaatttttacctacagttctctgtctgtcactcacctgattggtgggttgatactggtgctaatattcatgtgtgtgccgatatttccctgttttcttcttatcatgtcaggagaggttcctccttgttgatgggaaacggatcgcttgcggctgttcatgatgttggtacagtcgatctgaagtttacttcgggaaaaatcgtgcagctgaagaacatgcagcatgtcctttcaataaagaagaatctagttagcggctctctactgtgtaaaggtggttttagacttgtgtttgaatccaataaatgtgtcgtatctaaatatggaacatttattggaaaaggttatgactgcggaggcttgttccgcttttccatggatgatatgtgtaataaagttgtgaaccatgtaagcgatgatgatgatgagtccaatgtgtggcattcgcgacattgtcacgtgaattttggttgtatgacacgcttagccaacatgagtttaattccaaaattcactttagtcaaaggctctaagtgtcatacttgtgttcaatcgaaacaacctcgcaaacctcacagggcatctgaggtgaggaatttggcaccactagaacttgttcattccgatctgtgcgaaatgaacggcgtgttgactaaagggggaaagaaatatttcatgagagtgatagataattgcactagattctgctatatgtacctattgaaaacaaaggatgaagcattacattactttaagatcgataaggctgaggtagaaaaccatctggaaaggaaaatcaaacggttgaggtctgataggggtggagagtatttttccaatgagtttaattctttttgcgaagagtatgaaattattcatgagaggacgcctccctattcaccccagtcaaacggggtagctgaaagaaagaaccgcactctaactgagatggtaaatgccatgttagacactgcaggattttccaaggaatggtggggtgaggcaatattgactgtgtgtcatgtcctgaatagaattcctactaagcataaggaagtaacaccattcaaggaatgggaaaggaagaaattaaatctctctcacctgcacacatggggttgtttggtcaaggtaaatgtacctatagccaaaaagtgtaaacttggacaaaagaccgtagattgtgtgttccttggttatgctatccacagtgtgggatataggttcttaatagtaaattctagagtacccaacatgcgtgttggtacaattactgagtccagagatgccacattttttgagaatgaatttcctatgaaaaatgcacttagcacttctagtcaagaacctattttatctcctgagcactttgtgccgatagaacacattgatcaaatgcttgaggaaaatcctgaggaggataacattgtagcaactcgaaagagtaagagacaaaggactgcaaagtcttttggagatgactacattgtatatcttgtggatgatactccaagaaccattgaagaggcatattcatctcttgacgctgactattggaaggaagcggtatgcagtgagatggactcaattatgtctaatggtacttgggaagtcgccgagcgtccatatgggtgcaagcctgtaggatgcaaatgggttttcaagaaaaagcttaggtctgatggtacaattgaaaagtataaggcaagacttgtggcaaagggttatacccaaaaagaaggcgatgactttttcgacacttattcaccagttgctcgcttgaccacgattcgagtactacttgctctggcagcctcttatggtctactcgtccatcagatggatgttaaagacagctttcctcaatggagagttggaggacgagatctatatggatcaaccagatgggtatgtactagaaggtcaggagggaatggtgtgcaagctgttgaagtccttgtatggtctcatacaagagcttaagcaatggcatgagaagtttgacaatacacttacatctgctggctttattgtgaacgaagctgacaaatgtgtgtactatcgctacggtgggggagagggagtgatcttatgtttatatgttgatgacatattgatctttgggaccagtctcaatgtgattggggaggtcaaggactttctgtccaaaagctttgaaatgaaggatttggaagtggctgatgttattcttaacattaaactactgagaggagatgagggtaggattacacttgtgcaatctcactatatggataaggtcctgagtcgctttggttatagtgactgcaaggcagctcctactccttatcatcctagtgtgctattaaggaaaaaccaaagaataggaaaggatcaattgagatactcccagatcattggttcattgatgtacttagctagtgcaacgaggcctgacatctcatttgttgtgagcaagttgagccggtttatttcaaatccgggagatgatcattggcatgctcttgaaagagtaatgcgtgctatctaaaagggacaatgagctatggaattcactacgccgggtacccaaaagtactagagggctatagtgattcaaactgggtatgtgttcacacttggagggggcgttgtttcctagaagtcttgcaagcagaccatcttaacgaggtcaacaatggaagcagaactcacagctttagatactaccacagttgaggccgaatggcttcgtgagcgcctgatggacctgccagtggttgaaaaaccagtaccagcaatcctgatgaactatgataatcaaacagtgattattaaagtgaacagttggaaggacaacatgaagtcatccaggcatgttaaaagaagattgaaatctgtcagaaagcagaaaaactccggagtgatagcattggactacgtctagacggctaaaaatctggcagatcagtttaccaagggactaccacgtaatgtgatagactgtccatcgagggagatgggcttgagacccacttagagttgcacaatagtggaaacatgtccattgtgatcggagatcccgtgaatttggatggcaaaacaaactattgtgtagctgagagaagacaccctaaaataagcttatcttcatgatgcaaatctggcagatcagtttaccaaggggctaccacgtaatgtgatagactgtccatcgagggagatgggcttgagacccacttagagttgcacaatagtggaaacatgtccattgtgatcggagatcccgtgaatttggatggcaaaacaaactattatgtagctgagagaagacaccctaaaataagcttatcttcatgatgcacttctcttctaatctgtatggtaggatggtatacaccttaatgtgatccgagtggcttttcataaagcagagatgttggcctacagaacatcttagaaggaacatacatatatgagtccgactgctagtcacagtctatgagatctgggtgatctctagatactcatgaaaaggccaggagtatgacttatatgctccaaacagaggggatgcaaacaacagcccagtaccagttaaggctttagtgaaacctgaatcgcacaagactgacatttcaaggcatagtccattgttcagttgtgatatggtgtagctcttttcctaggtggaagttcaacttaacagtctccatcgaaacactggtataactagacattgttcagttgtgatctggtaatggagatctctctctatatataacacaaggcggaggctgtcaaagagtgtgtcttcctcctaatattgttccttggcgatactctccttctgttcctacactgtctctctgtttccccggttctgttcatctcgcgtgcacgggtgatcggaacaagcaggtgcctccgaaactccgttcgctttagaacctgtacgggtaggcgggcgatcaagtttttgggtagcgcttcaagcgcgactgctctgcattaacttcaccaacatgtcgacaaccggcgacaacaacaacactggagacaaggagaaggagcctctcgtcaacaccaacggaggcaatactgcctcaaactctagcggagggccattctcggggtataacgtttcactattatcgttcgttcttcattttctacatctgtcggtcgcaatattattgcgttctcttatctatgttggtgcttattctatattaagcatgctcatgttgtacacatctagcactgtcactagatctactcaaattacaaatgtcatatttattgtcttaatattttagattaaaatataccgaattatgaccaaatttccaacatgacctagaggactccaaccatggcgaaaaaggtggacactgaaccacgccagcttgctgtgtcgtagaagaagttgggtatggcaaaattagcgtgtgaccgtgtgatcaacggcttaacgcaccctcttttctggagatacgagatatatacggagatataaaaagtttgaaaagttaattcaaagtggacctttgctttaggatacgtgatggaatagatggaatttttttccacgtagagtaggatacggtgtaaaatgtatcggatggttgaaaataaaataaaactgatggttgatatctttttgtcactacatctaatctaatctaatggtataaattatcaggcccaccgatttaaatgaaaactgatggttgatatctttttgtcactacatctaatctaatggtctaaattctcgggcccaccgatttaaatgaaaatcgacggtgagattacgcattgccatgtggcggtctaggagcgtttgtagaagtgtcatgtggcggtgttgacgaccaaatttggtaagttgtgaaccaggttcgacattaggatcgaggcggattcgataaagagatggttttaaaaaacaaagtatgcatcggctgcgaaggcatcggctgagatggatcggatagaggacagctgatacagccgatagaagtgatgcagccaattccgatgaagatggtttcaaggttgtttctagaatcgatcaaagtgcttcacagggattgccacgatgaagataagctctcagataggcaattgtatctgttaattaggatatttcgtgtaaatttcttagagatatgtttgggcaaaagtctaccgcaaagacttatggtatcttagagtttgttagaggtaagctttgtgatctttgtgactcatagtctgatccgctatgctataaacgtttataatctttgtgttaatgtatatttcgatctaagtgatttatactgtctcggcattacgaccgatctatcgcaatcacttggtttaaatatatatcgacagaaggattgtatatcattaatatctacagccgatcaagtagatttagtcttatcttatttttctataactgtcgatcgatctcaatatgacatcggcttaaagataaataatatgtcatcggcggctggccgatcggctatcgtttatggatttaaccaaggttttcttgtctttctttcttcttgattgtaggatcaaatcaactggcacgctcacgaacctaaaggcaagattggacctgcactgaaattaagcagatcttccaggccagtgtgtatttttcgtatcaacgggcggcttaagagcgtttgtagaaagtttaatggacttttagtatataatagatgaggggcattttggtcgcttttactcttcactaatttcaccttgggatgctagagatggtctttttttgttgagacaggagtacttcttcagctagcaggtttgccagaatccaataggtataggtggacctcttattagctgacgcgtgtgcgagggaaccgacgctcgtctggacggccacatggggccgattatagatggccaaatgggcctcccggcacggtacgacccaggtatgagtgggcccgtgctgaggtcaatcgggctgccacgggccaacctacacgcaggaccgggccgtgcttgcccacaagctataccaaaggcccacgtatggcccgataagacacgagccgtgcggccgtgccgagcctggccgaaggacgacaacccatcgagcttctccatagaataagtctatttttcctccctcatctatttgggctatgccttatatggctagaataagtctattttgcataatctatgctctttgggccatgtcttatatgtctaaattaagtctattttagatctctgaactatttttctttgacagtgctgtgccggaccagcccaccgtgccaaggcatcaaccaggcacggcccaactatcaggccgggccagcacgggcccaacaccagtcgtgttgtgtcgtacatgggccaggccaaatggccatgccatgggccagggcgtcgggcctatggccatctatagggccgatagttggggtcccgtccagaagatgtggcttttttcttccggaaagagaagcgagaggggcatagggcagagcattagcagcatgtcctctcctcatctgatattgttggtgatgcttgccaaacaaattccagagatttggaatttcagcaagattcattcatttgtcaaggaggatgtgctccatctgctatgagcttactttttttttttagagaagagtaattttttacccggcctttacatccaaccggatatatacaacattttttcaatcgggaacttagcccatcaaacaggaaacttagccctcaaataacttaatctgaaattcactccaatggagatttgaacttagaaccttggggatgcactcctatggagatttgatacatgccctttcacatgctatgcctttggaacgaaccggagacaaaatgtattgatccgaatgatataaatcaagtgaaagacccaaaaaatgtcctagtaaaagctatcatttcattgaacagagggaggaaattgaaatcaaagaaaaaacacaaaggaaaacaggataaagaaacatacagttcaacaactgattataaaatcaaacccccaaataaccattcagtggtatatatttcaggtagttcccaaaattatttctagcaatttcaagaaaattaatgcggcatgcccctttatcctcttcaagtcaaagcaagcaatcgcccatcttcagcttcatgtagcagcagtcaacaatttaacatgcatttcctcatagtcatagcgtagtggatttaacagctggtgacatgttgttttttgattgattgagcacaggctaaccatccacttcttttacctgtgggaatgattttcacctgttctctttagcttatgtcctaattcctgacttacaaatgcagaggatatgtcatgacatctagagcttgtcctctttacattacaggcattcagtctaaattaaaattcaatccaaaatcaaaattcagtctacaccactattaatctagtgccaacttaagaaattcaaaacgacctgggatgagaatcgcaaacatattgcaggttgattcataaaagtcggatcaccaacatcttccacttcctcatctcgcaacattttgaagtccacaatacatacataaacagcagatgcaagattctactacagacaatgccatagaactcaagaaacatccatgccagttgcttgcttgttcagtgggtgaaggtgtagaagacggtgccgacgtagacggcgagcgcggtggtgacgaggccgacgagccctgcggcggccttggcggcggcgcggttggtggcgcagccgagcgtgccgaggcggatctgcacgaccatgaccatggacaccatgaggaagacgcagccgacgacggagccgacggcggaggcgagcatcccgaggcggaggaggcgcgcgtcgatgtgggcgtgcagcgtgtcgtgcgggtccttggagttgatgaggttgagcgccagcttgagcccctgcgccacgaggctggagaagaggaaggaggagaaggccaccacctccagcaccaggagggaccgcgccaccccctgcccggcgtcgcacgacgcgtcgccggcgaggctccggagctcccccgggtccgccagggagaggcccacgaacacggccaccgtgaacagcgagttcacgttcaccaccccgtccagcgccgtcacgtgcacgctcgtcgtgttcgccgacagcgccgccggcagcttccactcgtacccgcggtgcccgccgccgccgccgccgttgctctgctcgtcagatctggtccgtgataagcatcattggatcagcactgaatcgagttcttggcgcatcttatttcaagaaatggagttcttggtcgaatcgaacaacgcaaagaggggattacttactcatccatggcgttgatgcgaagaggggattgatttgctttgctggttgggaaagaagagatcgatgttttgaggaaaaaaaaagaagggggacagtcgaatcgaaatcctgatgccttgtgccgaccatcaacatgggaacatattagcttttctagatactccctctcgctttgcattttttttttcccttccattctggagtacaagacattggccctgttattttctcctaggaaaactgcataatctttaaacggtacacgcaaaactgcacacgcttttcaaactattaaacggtatgtttcgtgcaaaaattttctatatgaaagttatttaaaatttaagattaatctatttttcaagtttgtaataattaaaacttaatcacacattattataacattattttgcgtgaaacacttaatttttatcttcatcttcattttcaggagattcaaacaccaccattgtaaacttcatttatttaattttaaattttttcattaaatatttatgaattcatagaaatgtaaattcctattttattttatatttttactcacttaaaataatctcctcatagaggaaacactaatggtaatatatggtgctgaaattgtgggtatggtgtatgactctattaaggttcaaatcaccaaaatttgtcacaggacattaaaacaaatatgtaattaggtgtgttaaatgattatagtgtgggtaaaggttgtgtttacaggtaactagctgtgcggcccgcgcaattgcgcggctagcacccaaacaaaattatatattttttaagtatgattttacttaaaatttattaaatagctatcccattgttttcagactttgaaagaccaaacattatcatcctcgtgtttctaattatatagtttttaaaagtcacaccagttgctacctctcatgtcatctctttatttatttgcttgctcgatctaccactatttctattcattctccttggaaatatttaaaaattggattttatagtttttagaatttattgtcacgttggattttgtttttataatttctagatgtcccatcaaatgtagccattatacttctctacggcccgtccattgtctcttctctttattgtcattgagattttaaaaatcaaacataaatactactttctagaaatccggccaaaccgtcagtggctttgccattgtactccactacgcctcgcccactgcctcccttctttattgtcattgagattttaaaatcgaacatgattatcattgttttttttttactttttagaagttccaaacctttaaaaattggaccttgtagtttttagagtttattatcttgttgggtttcattttttataatttttagaagtcccgtcaaacgataccactatactcctttacagcccgtccaccgcctactctttattgtcattgtgattccaaaaatctaacataactatcgttggaattcattttttattttctagaagtcccgtcaaccgtcggcggctctacaactatactcctatacaccccacccgctgcttctcatttttattatcattgagattttaaaaatcgaatatgattatcaattgggtttattttttttactttctagaagtcccggcttccaccttactcatttgcttcacgtcctgcctatcgtccctcttttaatcgtcattaggatttatttagtgttttattaatattttttaatatcgtatcaaccgctaccactctactcattcataggccctattactcaatttatctcgtcatgtgttttagatggctttttctttcaatagtctttatttttatcacaaaatttagttatttataaattgtattcctaactcaaatcttattttcctttttctaattttagatttttttttcaaattttagttaatatcgtattgtgttcttttaatatttttactttttattttcagttttagttgtttcaaaattgtattcctacttgaactctcttttagttttcctaattttggatattttttttatttttttctgaattttaattaatctcgtattgggttcttatatggattcttctttcaatattgcttttttttattccgaatttcagctaattttaaattgtattcctactttaactcttcttttttttgctaatttcagatttcatttttatttttattctgaattttaattaatctcgtattgggttcttctatgaactcttcttttaatttttcttatttttaattccgaatttcagctatttttaaatcgtattcctacttggactatccttttcttttctaattttagattttattttatttttatttcgaattttgattaatctcgtattaggttattatatggaaacttctttcaatattgcttatttttaattccgaatttcagctatttttaaattgacttggactctccttttcttttctaattttggatttattttatttttattttgaattttgattaatctcgtattgggttcttatatagaaactttcaatattgcttatttttaattccgaatttcagctatttttaaattatatttctacttggactctccttttttttctttttctccgattaatgtaggaatttctagccctacagcgaacgtggtgcctcctttcaaaactgttttgataatataatagatggttagtaacttattcctacactaaaaacaagttagctcattattagtggatgattaattattttaaaaattagattactataattttttataacaacttttctatagaatttttttaaaaaaatataccatttagcaatataggaaatgtgagcacagaaaagaaagatcgaagtttcaaggaaaaggaataagagggacagtcaaaagcctgatgccgagcgccgaccatcaacatgggagcaggggcgggcccagtatgtattcaagggtattcagatgtatacccaagatttttggacaaaaaataggtatatatattctatagttcgtatatgtattcaaaaaattaaaaaagagaccttaaactgcttatattgggccttgtttcatcatttcttctcaattgggcctaaatttctcactcccctccccctttcctctcagcccgcactctatttgggccgcatatcagcccatttcgatattttctccaattctcctccccatttaaccctaatcacctaatgcccaaaccctagaccacgggagcagagcggcaggcgcggcgtgcggcgcggtgtgttgcggcaggcgcggcgtgcggcgccggcgcggccgcgcaactcgtggggcggcaggcggctgccggctgccggctgggcgcaccggacctgaccggcgcagggcggcaggccccacgagcaggtccgccatccgcggcgcgtcgcggctcaggccactgccgacgggcagggccgtagcccccagtgcagcaacgcgtcatctcgccatctctttgtcagtagttccaatgccgctaatcattatttgctacggatttaaattgtgttagtgtgacttgatcaatagagctataaggtcaccctggtactgttaggcatttaggccggcttgccattggtcaagaatctagaggcattaatcccattcccatattgttggatttttaggtctaaaatatgaagagaaaaaatggtcttgctcttgaacaattgttcatgaattctaaatcagtaattcatgagtcccttgcctcaaacactgcacaattttcaatcatctatatatttcacatattgccactcttatgtgttgaacaattgtcaaatactcctttttgtcctataatatgagggattttggctatgcatatagccaaaatctcttatattatgggacggtttagtactttctatttgtacaattagtagtttaaatcaagtatataattatatgaaattatacctaattcatgttacataatttgtagtttagtactatgtgatacatgctaaaaaaattactccttcacatttcgaatacccaacctaaaaatcctaggcccgccactgcatgggatgggagcagattagcttttccggatactccctctcggtttgccttggtttttttttcttacttcccattgggtactgcacaatttgtatattggattttacctgtttcagtcagtcaaacatttatacttaaaactatatcaatacaaaagctttttaagtactaaagttattttgagatatcaagtattagcatttgtttatgtttcactcttttaaaacggtccataaataagcaaagcacgggttatttaatggtggccaccagggtttaaaagtcaaatcctactgccaataaaatattatgcacaggccagtgcactttcaacactgttttaatgagggtagataaaataccattaaactttatgccacaaatgaaagtacatcttcataacttatttttgtgattaatgatgacatttttaagaatgctctactgttgcctgagtgcttcaaaggaaaatggggttctgggttatttgatggaagaaaagacatgatcctagacaatggtaattcttgtatgtatttatttcttgagtctagataacgtacagagaatatagtgctcaatatcaagttttctctaagtttgagttgatttatggtcggaatttctgacactagtcggagtatttaacgcatcataatttccttttttcacggtgaactcgaggctctgtttgtgttttgttgaaagtgatcatagtataggctctgtttgtattttgttgaaagtgatcatagcatctgatgtaacattggaaaatccgatcaatcaggctatatgtttttgcaaggaactggatctatgtttaacttcaaacattcgatcaaaaacttcttacgttgaatcagaatgtccaacatcccaggcaatccgatattgcaaagaaattggctctcaggtcgaggcaacattatgaattataatatccaacttagtagtctgaaacttagtagtctgaagatcaaatggtcgaaatattcacttttccttgtaacccaagtctctgtttggatttatttcttcaatctgagtttccaattattaattggaatatctgatcagtattttttttttatggaatgggattatgttttagacattagagacctgatatgttgatcgaatatataaccttcaagtcagaatatccgaggtgtgatgaaagatcctcccaccccataatgggcagatttagggtgatgaaagatcctcccaccccataatgggcagatttagggtttcctatataagtcccaactctcactggctctatactagggtaagtctttcgcttcattcaaaatattcttggcttcaagcatgatgttggagtgcttttagctcttttcaccgcctctctcgaacccttctctgcttttgttatttggatacggatttggagttttgaatctagtgattgttcttctctcatggatcttgaacactaggttttgattccaaacgattatgtaggatatgttattcttggaggtcgaggacacctgtagcatcatctgaacacccattcacgggtagggcaccaaaagaagtttgaaggatccacaaggtaagagatactaccaatgaaagagaagtgtgcttgtgcaatattgaggatagggttaaaaaagactggctctttgtgagtttctcaatagagacattgaatcctctcaatggtttgaactcagggaatacattgttggttttaagacagtggactcaatttacactgctttataagttgaggtgctctatatttggttttgcgatttttaggcatgcaattgaaactcgacacttgtttgagggacccaaactgtacttttatcaaacaagaaaaaggagtagcccaaagaagagaaaagaataaagaggtggaactatggaagtgggctggtgggaaaagaagaggaagaacaagccaaaaataacccgagactttggagaatgattttaatttaaataatttctgaaatgttgtttcattttttaaaaaatactcagcatgctcaaaatgattcatgaatattgcagaaaatattagagaatgcaaagtatttaataagattttatctagctcaatttgaagtttaaattttgatttttattcaagcatttcctttaattattaaatgatttctagaaattgattttccacattaatttttaattaggatatttttagagtgtgacatgttgaacaggtctgatcaccacaaccattgacagtaaccaagaagaggaggcctagggtgattgcaagggctagggatgctgaaccaaaaggttgatggttgcgtatgtacacttgtgaaaggtgtgcaaattgctactacctctgccacagaatataagaagttttacagttggatatggttattaaaaaagtaggtggaattaaattggaagatgctgtgattggttaaaaagtagatgacggtggaaaaagtgaatggtggaaggttgtgactggttggaaagagaatttttttagtgaagttgggaagagaatgttggtagagaagttgtcatgttttaggataaatcctgaatgctaaaagttgttatattattgtgagtaaattgcacccatggtataacaacttggcagattggtgcgatatagtgcaagaacttgagaattaaacgtccgagtgcaataacttgacaagtaggtgcgttttagtacaagaacttaacaatttagtatttttgtgcatcaactaggctaagcatatgctaggtgagttttttttctcgatgtcaatatgccattacataataatcatacggatattatcttataatattgaatttaatctttaaaacttatgtagtacaatttacatctaatttactttaagaacttttttagttttcttcaccttctcaaatatcaaccaaaatataataatttctatatccggattaattgacttttaattattagttattaggataaaaatataaatatacttatacaaatccatgatagtatattgtcaaaataagtacttaaaaatgaatttatataaaaaatgctccaaataattaagttgccgcataacctttttatttgttctatgaaaatcgtacctaacttgcaagttgttgtatttataggatcacttataaaattcttatactaaattgcacatacctattaagttgttgtaaatgattatttctcaagttattgcaccaaattacatctacctgccaagttgatgtaccgtggatgtaatttactctattagatgagtacaaagcttttacatgttacctatcagctttgtgttttgcttcactaaggtgagatatatatatttatagacaaatctagtgaagcatggtagcattcaaaaactgtggatcattgtgctcacaggaggaggtgatcagaatataatgaggtgtctataaacgaatacgtgcgtgcaatgcatgcaaattattcctatacatctagccacgtacgtgtcgcatccacgtatgttatagatcagagcagttgactttagttttatgaaaaacttaatatttagctggttaagtcagtgtgcaagctactgtttaaaatgattaattgtattagtactttctttggtaacgtttagcgtaaggcttcaacaaatgtttgaaagtttggccatcaataagtttgaaagttagttatttaaaaaaatgttttgcatagatttgttaggaaaccgctatcataatatatatatcataaactttttatattttataatctttttctaatataaaatatggtcgcgtcaagtttgaaaagtttaaccgaatatttttttttctaaacatcaaatatatatttatgacaggatggtgtatcctctatcatggtacaaggaactctgacattgttctacaactaacatatttgataaattgatttgagtgtatatacaagggctattgttttgatcttgattaaagacattatgtgttgtaagcatttcaccgattcatcaaactgtattgtatatatgaaatatattattataatttttcaagtagtataataatgtaaaaatatacaatacgttaacactaatttaatttcagccaatcaggaaacatcacagccctaaataatgatcatttgacaatagcaaagtatttcataactatttgtgatatgaaccatatatactgtattacatttccatgatcattctcattatgactgcccgcttagtaaagttccattctgtaaaaaacatattttgaaattgaaccggcaatgaggcagtttcaagaatgaaccaacggttaagccggctcgccagctataaatataaataaaccgtgcctgtctatttatcccatctaaaagtcgctatctcccaaattccccatctctctagctcttacccaccacctacattttgctcgcccactgccgcatcctctctttcccaagtccagccgacatgcccctttttctagcaccgcttccacaccctcctccctatactcacatttgccacctccttttccccatccccgccatcggacccctcatatcccatgtctaagcatagacaccttaacttcctaagtcttggcaccagcccctcctttgtctctctgagcatagacattagcgactatgggccttatatgactagcatgtgctcaatgttgccagatatggctgacacgagcttagggcctctggatctgggtgtgatcgatggcaactatgagatggttgttgtcaatagcaacatcgactgcagcgacaacataaataaaggggggtttggaagggctagtagagttggatgggaatggcaacgacgtctgcgactgacttggcttagggagcctgtagtcttaactcatcgtttcatcccgtgaattgcgtgttgcttcatctcctcggcagtgaagggctgcgagtgtgctgattgatctcctggtaatgttgtgtggcaaatcacgtgttccgaagaccagctgtgacaacaactgactggtatacagatcgacaaatagccatcacgcttaggtccatgcataggcgaatttttccaccccacttttgtcattgtctgtgctcagagaacacacctctatgctgggttcgttctacaaacacctaggaggctgagaaccatctatgaacggagaaaatctaattcaaaacaaggtggaatatttatcagtttacaatattttatctttcctactgtggccaaattttaagctcatgcttatgacctttgtactgccaaatttcctatatctcctgtccttcaattgtgcagtccagaatagggcagcgcatatacatggttttgcgtgaggtggcacaggaatcccaccggtgacggtgatcgatgccgacaagtctcatcgcagttgtgacatgcataatcagcggctcagcctcgtccccatcaattacggtatcgagtatcctccgtcccaaaatgtaagcatttttagctatgtgtccagattcatagtaaaaaattgctatattttgggatggaggtagtagctttctcgacattgtcttgtctaaattgttgatgtggttgttcaacatcgaatcaccaattgcatcccagttgtttttccatatagccacatcatgatagcatgactaggggatgcacattttttttctaattgttagatttttcagtcctttgaacttctaaaaaaacaaaatgagttcggaactaatttacaatttatagtagatctaggatgcacaaaaagaaatccattgaaattttgcaagctcaatcctcttttagcaaacaaaccattggtaccatttatttcattttcatgtgcaaattagtccaactagtgccatatatattttcatgaaatgtgcttcccgaggctaaacaataagcacattagtaatttatctagttgaacaaaaatgcatacacaacatgtacaacacaatacaaagaaacaacccaacagtgcacaaataaggcatgcattctttcaatggaaagggaacatttattcataagcacataaggctttgcgatattacatagcactcactggaaggtaacagcaacaacggagaaaacaaacacattcaggaggtgcatatatatatatacttagagtgggcaagtgaagccaggagggcatgtcctgttgcatgagttaagaatgagagtgacatcaactagaacgtctacgttgataacaccaaggatattcgccttaagagcagcgcataggcaaagcgctgcatccaggtcagcgagcccttgaagcagtgtgcagcactgcgaggaaggaacatttaagctgagcacgttagcgcacaccgcaaggttaagcacattgatggggcatgtaccccctgttggtgttggcacagcgggcggcggtggtggggatgggtttgagcagctcgtgtcaccacagccattggcgacctccactgagagaaggctcatggtgatgacaatggcgagaagagctgcagatttgagagccatggttgaagtttgggcaaatgtatgtgtttgtgtgcttggttttgctggatgttgagtttgtgtcaatattgtgatgtatttatagtagaaactggagatgcttcatccctttctacttgtgcaggaggaacgaggtgtccgtcagaccagattttgcgcgcatgcatgcataccctttcttgttgatccaactacgtgtcccagccacgtattgatgaactaatgtaccaatgataggcgattngacatcg

SEQ ID NO: 59041 - DNA, 568 bp, Oryza sativa
tgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcacagcatatatgcaagttgaatcaagccccaactgtatgtgtttatatatgtgtcgcccagcgagaggagctcttattgccaggtaattaattaacttgtacaagatacaagcacaccacacgataatcatacggtacggacgagcataagttactcttagctacgtatataggtgggtagctagcagagaataattattctgcaccagattcgttgatatcaacttgagccttgatagagagctggatcgatgtatcgatcagctcagtagtagggctggatcttccagcgctggttgtcgccctcgcaccacttccagagcacgatgttggtgccgtcgcggacgccgccgtggtacttgtcgccgtggaaggcgtcgaagttgaggtagatgttgttcaccatgcggatgcacctgaacccggtcccca

SEQ ID NO: 59042 - DNA, 1290 bp, Oryza sativa
cgaataatgctagacacctatagtttaaacatatttcaaaatgtacctgaagatgactcttaagatggtaaagggttaatcccagaatttcccatgagcctcatgattgttttcggcggcccctctgaagaagtttcaagtgtagccattgtaagatatgcaaattaccattcctctgctgcttcaaagcatgaatgattaattaagttttgaatactcactgtccggccctcccagctgatttactgcttccacaaaacgctcatgcaactctgatgtccattttaaccgaggtttagcgtcggtcgagaggacaagccctgatgatgaatctgctccgccttgcaggagaaattgcttctccggaggcaaacccggccttgaagacaggtgctggctatcactctgaacctgttgctgatgatacatcatctgccatcaaagatgtcatgttcctaatttgcagatatcatcttgtgtgagcataagcatatgatacgaaaggcctctcttccttgcatggttcaaagaaactaacacagtagtacatacagacctgttcagttccagtcatgcactgaaatgtctgtctgcttgtagtaggctgcacatttatcagtagtgataagatcctctgcagcctttttcagtgcctctatttgtagtaaccaaagacttgattggattatgtgtgtatggtcttctgggagtgagacaaccttggcttcttcagactatctgcctctccaatgactagctgctgctgcctctgctcatgtcaaggtctcaagcagagagtcttgagtctttataaggcagggaagagaatgtggaatcactgggacaacacacacactcaagcctgcctgacccaatctttgcagcaactgaaaagagatattatccttattctctcagggtgcccgtggaccctaacctctgccgatcttttccattgtaaattccaaaaacgctctcccattctgattatacacttgtaccaactttggttgaaattacatggcacatgagaagggcgaaaggcgaagaacaatcttttatttttcttccttttcttttcttttgagaaactagggggagggaggggcggggggagcaccttattctcatgacaactttggggctgtggtgctgcaaacctatggtgttagaacttgccggcctcttcggctggattcctgaatgatatccatagttgagaactaattctggtctccactgcatttctggaggcctataagtgttgaaatgaaagggcaacatctgtgg

SEQ ID NO: 59043 - DNA, 76077 bp, Oryza sativa
ctatactactcaatcaggaataattaactattttccacttttacgaatggtcataaaggatttgccattaaactcatatgttatagacacatgatggtacacatgtcataaatagtgagtgttaaatccgtaattgtcacatcttaaaaaaggcaaatagttaaatgtaacactcaatcatacttaccccatcccataaaaaataaatatagaattgaatgtgtcttattttaatataggacgtgactacatatctagtggtaattgttttgtctaaatcaactaccacatcatctatgagaaaccctatccatctatacttgaaataaaatcttctcttaaatacttatccgatttatgattcgattacaccgttgtgttcgtaacaattaaatctttataataaaatctcacatggttatattttgatgaaaaattataaattactttataatatatctaaattacttttagatttcactaaattacttcttagacatataaaagtaaattcaataaagcctaaaagtaatttacatatattatagaagtaacttataacaaagagaaagtaactttaatgcatacttttttcattgtggacgtgactacacagttagtgatagctggtttgtactccatctaatgtcacattttaacttgaaaaatgcaatagtatgtatctttttctaatccctttaataaattatatattttaaatcacatattgtttttaagatctatttgcatcattgtactccacccaaaatatgtgacaaaacgagattcatattgattaggaaaacgtacgaattaccccccctccgaactatcatggtcgtctgaattacccccctgaatcacaaaaccggacattcttcacccccaactatgcaaactggacgaattacccccctcgacccaatcgacagtggttttggtctacgtggcgtacacgtggcagtccagtcagcgtttctttaataaaaaattatggggcctgcctatcttactcttcttcctctctctctctctattctctctctctcgctcgctcttttctctctcgcgcagcgcgcacggcgaggacgagctcggggacgggcggtcggtgtgggcggtcggcgaggtgaggcgagcgtggcggcgcggaggcggacacatcgttgattcgattggcgaggtgaggacggcggcgcatggggggcggagccagttgtgggtggcggagcgggcccgaggacgacggcggccaccggaggcggaggccaaccgggtgcacggggacgcgcggtggccggtaggctccccctcctcgttgtgggcgcacggggacgcacggggacaccaccgccactgcagctcctcctccgagccgtcgcgccgcgccccatcccacctccccgtgccaggatcggcgatggagactggcggacgcggttccaccgaggacgcaggcgtgaatggcgaccgggaatcccgctccaccaccccagatccaaatgcgagctcggtgatgacacatggagcttgggtcggcggccgcgcgtgcgtcggcagcagcggcggcggccacgacagcaacaatgccggcacactagtgccagcgccggtgccggcgtcgtcgtcgtcggtgagcgcggggaggccgagccggcggccgcggtggtggcggatgtggctgcgcgagagcgaggcggtggtgatggagtcgacggagcagagctggagctgtgatgacgctttctctcgtggcccaatcttctggtgagggggataactctcgctttgatcgagtgcgacgtttgcgatgtggctaccaaccagaacaagtccaggacgcctgcaatcgctacactacaaacgatgtcgtatcaaccgtgacgcgcggttgatgatccctgcaatgcaaacgagagaacactgcaagaacaagataagatgcaatctaaatattgcgaataggtaattaagcacaaatgaatagttgcaattgaagtggtagatctaatcgacccagcaaatcaacacacaaactattaggggctctgaatctatagtccttgactaatcgaatgaagactagagacaaggtgaatggcacttggcaaaattcaactaaacaaaacccaattgtttttaaggatgtacaaagctatttatagaggaaaataaagctagggttaagtgctaattcgtggaggtggagggagacacttccgagatgggcctagtctattacaaggcccaagacccaagttcggtttgagcaacatcactgtcttgttttggtgattcccgttgactcgagatgaatttggacatgagaccgaatgcgtttgaaaggtagcgagatagctttccacaaagtccaagatcacccaaatcggagttggcaagaaggcgctaggtccgtttgaagtcagtgctgtctccggaggccgaaatggacttggacttggaattatcattggaacgtgtgaagttatgtgcgtttccgacgaagtgatgtcctcatcatcctccccttcttgaattggagtcgtcctcgactcaatcccatcttcttgatcgtgttcactctgtcgtccaggggtcatccttggaggtatctcatcatgaaaagcaccctcatattcctgcaaaaggttagtaacagcgagtagcaaagaatataaagtactggaagcagtagccaatgtgggtatatgatctttgcaaaatagaggatagcaacaagaatctagctcttctagtgcacaaatattatatttagaagctaacaaagcacccgtcaacttaatttcattctttgtggcacttggttctgttgtactaggtgaagcaagattcttagtaataatctgattttcacttttcgctttcttttcacattcaagacttgcaagatcatctttcaaagcagcggctggagtcatagaatgcaaaacaactcttttaccatcgaatataaatttatatgtattagtcctaccatcaaaaacaacttctctatcatattgccatggtcgccccaaaataacagaacaagcttgcatatacacaacatcacattcaatttgatcatggtaggagcctatagaaaaagtattttaactaagcgggttaccttcatcttaccacatgtattaaaccactgaatatgatacggatgtggatgtggatgggtagtcaagccaagcttcttgaccatctcttcacttgctaaattgttgcaactcccgctatcaataatcactttgacggtatggcctttcacaagaactttgctttggaataaattgtggcgttggttttgctcttcacacttctctttagcactaagtgctagcttgacaattaggctaggatactgatctagcgactctggatgcaaatggacttcctcgatgtcatcgttatcttgtcctcctacatggtcagtggcaactaaagcatattcatcatcacaatcactagtagaagtatactcaccatcatcattcacaaatagagctcgctgatttggatagtcgcgggcaatgtgtccaatgccatggcacctatgacatgtaatatcacgggtacgtccagtggaagctaccgaagttgcactcttggctggagtctgaactgaagcatttttgcttgtttcttgagcatgggatggcgtggaggtaggtggacgaacggccgtagtaaattgacgtggtgttgattgtcgtgtggaagtagcacctgcaaaagaactcctatgcttgttgcgtccctgcacttctctttcagctttgcaagcaaattggaataatctattcacggtattgtattctttgtattcaagaataccccgcatctccaccaaaatgataacaatccggcctaggtggggttggccgaggcccaacaaattaaggttgcctggactcaaacagttcttaggcacactaacttggggaaaggcccaatctccctaaaagactaatccaataggggaagggtggctctcccttttaaggtgtctttctcctcccaagctaagcaaggtgggattattcagaggctcacacggtcgccgcccgacttttgcgtctttgccagcggataatagtggaggatgtcctcatcattcccaccctcttaacaagggcccagctctgataccaaatgataaagatctggcccaggtggggttggccgaggcccaacaaattaaggttgcccagaccccaacagttcttaggcacacccactcggggaaaggcccaatctcccctaaaaaaatagtccaataggggaagggtggctctcccttttaaggtgtcttccttctcccaagctaagcaaggtaggattattcagaggctcatacggttagcgctcgacttttgcgtctttgccagtgggtaatagtagaggatgtcctcatcaagctggtggacagcatgatcaagatgctgtgcaccaatggcgtctggtggctggaggacctgcaggacctcctcgcctgctacctctcgctcaacgccgccgagcaccaccgcaccatcgtcgcactcttccgccgcgtcatcctcgtctgaatccaccttagcagcagaggcttcttcccagccaaaggcttcttgctgacgcggtgcagcctcctgccgaccgcccgtccccgcactcgtcctcgccgtgcgcgctgcgagagagagagagagaggaagaagagtattacatgcgggacgcacaatttttaattaaaaaaacactgactgtactgccacgtgtacgccacgtagaccaaaaccaccgtggattgggtcgaggggggtaattcgtccggtttgcatagttgggggtgaagaatgtctagttttgtggttcagggggggtaattcagacgaccgcgatagttcgagggggtaattcatactttttcctattgaatatattcaaacatttaattaatttaaaagtaatttattacatgttagaaagtaacttctatgttatcaggaagtaactattacatcttatacatggttaattctcattagttattccatcaatgttatttacaatccatcaaaggttttatcttcttttctctttctacatgaaaaacaaaaatgaaaggaaaaaaaatcggtaattaaacatatttatagagagttacttcttaaccatgcaaaagttacttccaattaacattgaagttacttttgaaaaacattgaagttacttttaaaaattgttaaacttacgtgtgttgatctgtgctgattaaatttaatttctagataaagtcatatttttatccctacaacgaatttacttctaatgttgtgacaaagttacttccgttttgttttaagttacttttataatatatgtaaattacttttagactttattgaatttacttttatatgtctaaaaagtaatttagtcaaatctaaaactaacttatatatatatgataaaagtaacttatttatataataaaagtaattaacaaatataaatattttttcatcgtaatataatcatgtaatatcttgttgtgaagatttatcgtaacgaacacaatggtataatcggattatagatcggataagtaatttgagagaaaactttatttgaagaggaaaaagacacccacgtggatggacgccacgatgacgtgcacgattagacggctctgagatgtgtcgcactatacagctaaaccgagagcgctctcgaaatagatttcccgtttaatataatgaatctgattgtccagattcgttgtacgtcctagatttgattttttttatggactagatttgacttttttattactgagggagtataattttggatttccgcattttcctagagcacaccacaccagcaagcccgcccgcagcatacctcctacgcttagcgctagtagagattaatgttaaggtaatagcgattagcgttagcatgccgatttttggcaattttttcattgtattttataattaaatgtttcatcttaaattttaaaatattctattgaaaattttcaattcgaatgttgaactcagatttcaaaacattcgtctcaaaatttaaaactctcaactcaaaaattcaaatctgagctgaaagttttcaaatccaagttaaaaatttcaaatattgatttaaaagttttcaaatctgaaatggaagtttcaaatcttgacttaaagttttcaattctgagttgaaaagtttttaaatcttgacctgaaagtctttaaatctaagtttaaaacttttaagttaacttaacttaaaagttttcaaatcttaagttgaaggtttttaaatccgagttaaaaattttcaacaagagaaaaaggagattggataaggtgtgcgctacttatcttgctagtgcatatgtgttaaataggattccagttccactagagaggtgccaaaaaaaaattaaaaaccccatctccacatatctcgctctccataagttgggagtcctccttgtttctatccacggatccgaacgcgagcacgaggaactgttggtaggaatgggtgattttttatattgaaaaatcagatttcttctctaccgagctcacttatcaattgtagggaatcagttttaggcatccattggaaaagacgactattttcatgcatcaaattctgtttagggttctcaaattttttttttgaggatatatttttttaatatctcttggtaacgttctaaccccactagtttcgttctaccttggctcttcccttggacttcatagtttgtcttagatttcgtgaagatagctttagcattttcccttctaggtgtattcatgttttctttaaaaaaaattcaaaatactggtgcgaaaacgatttagattgatttgctctaaggatagcaactgagctagggcttgtcacatatggagtcgctgtactaaggcgacctaagaaattctgttaaaaaggattcttggtatcctgcaagcatggggtatttcatatgttggatggaggagtaagattagagtcatcaatatcctgtgaggattatacaaaaggtttaccatattcacacatccacgaacccacccctaaacacgtgctcaaatagccagaggtcggcagcaaatctcaaaacctcactaaatctatctattatattattaaaggaatagaaaaaagaacctccacgttcattctcatggcctagaaattctcacattaatcggagaaaaagaaaaagcagagtccatatagaaatacaatttagaaatagctgaaattcagaattaaaaaataaggaatattagaagaggagactagagtccatatagaaatacaatttagaaatagttgaaattcagaatagaaaaaggagcctccacgttcactcccatagtctaaaaattcttacattaataggagaaaaagaaaaagcagagtccatatagaaatacaatttagaaaatagctaaaattcggaattagaaaataaggaatattagaagtaaagtatagagtccatatagaaatacaattaggaaataatataaatttggaattaaaaataaggaatattagaagtagagtacagagtccatatataaatacaattaagaaaaaaaatagaaatccggaaattaaaaaataaggaatattagaagtagagtatagagtccatataggaatttaaaaactaactaaaatttggaataaacataataaaattaaaagtagagtttagagtccatataaaaatataatttacaaataactaaaattcgaaattaagaaaaacatgggaagaagagtttaaggtcagagtacaatttagaagtaagtgaaattcgaaattaaaaattaaaaaatattgaaagatgagtttagagtccatatagaaatacaattagaaataataaaaattcaaaaataaaataaataatattggaagaagagcatagagtgtatatagagatacaatttacagaaaattcggaataaaaaaaagaaatattaaaagacgagactagagtccatatatgaatatatataatttacaaataactaaaatttgatattaaaaaaaattattaactaacacgtatataaaatataatataaaaattcataaataaaaataaataatattggaagaagagcatagagtctatatagaaatacaatttacagaaaattcagaataaaaaaagaaattaaaagacgagtctagagtccatataggaatatatataatttataaataactaaaatttgatagtaaaaataattaataactaacatgtatataaaatataggggcaattgtattcttgcttctactttgcagtttaattgtgattttacccctaatttttagggtttgtgattttactcctgcttttttttaaatgaagcacccgtttacccctagttttcacggtagtttgatgggcccggaatttcccaataaaacgaagaaagaaaatgatattatagtttgtgaatgaccatcccttggttcactaaaagggctagccagtaaccacttctcttgctggaacgatttccccaaatcgaaaacctagcgacaagcggcggcggcggcgacgcgcgcggcagggaggcgcggcggagaagggcggcggtgttgcgcgcgggcagggaggcgctggggagaggagcggcatcgtcgcgcgctaggcggacaggcaggagggcgcggcgcggcgtgcgcacgcgcagggaggcgcggcagccccgcggccagtgcgcaggagggcgcggagcagcgggcgcacgcgcagggatcaaaacttttgtaattcagggggaggaggacacctgcagcttcgtcttcctccgtcagtgccttcgctaccgcctcctattcgcagaggtgatttgatcgattcagcttggagttgcattgagccattggttggggacgctgatttcatcttcttgattgcgaatcggggatggatgtgaatgtgatttgcgggtttgtaggctgactgggaaggtcgccgtcatcaccggcggcgccagcggcatcggcagggcgacggcggaggagtttattgtcccaaataatgtgttctaatcatatgacggagatgctgtacatattgtcccaaataatgtgttctgtcatcttttttaaattgtgtcaaaattattgctaaaattctgtcaaaactatcctaaatatagtgttctgtcaacttgtacaaaatttgtctaacatttaggtcccatattaaatacgcacaaatttaacttgaaacatgtccggtgttcatgccaaaattatagtagaggtatatttgtccattcactacacatttaaaaccattacatgaggtaacatagtaggggcaagcagctgcttcatttaaaaaagcaggggcaatattacaaaccctaaaaaaaaaaggggtaaaatcacaattgaactgtaaagcggggtaaaatcacaattgaactgtaaagcaagggtaagaacacaattacccctaaaataaatatgatatgaatattacacattagtagttttgtaaagttattgcaaaatttaaaattatattgttattttaatatatttgaataatataatgagaaaacatatatgctattacatgagagaaaatataatgatgctaaccacgcaatctgcgcgggccaccatgctagttcctatttaaagcacaactgcatgtttgtaatatttgtaggcatcaaaatttaaaccccgattaggatgcatccataactccacacaacacgactattgattcttcagtaaatttcaagttttgctataaggctaaatcattggtgcttctgaaaagtagatactacttccgtttttttaatagatggcgccgttgacatttctcacatgtttgaccattcgtcttattcaaaaattttatgcaaatatataagatataaatcacacttaaagtattatgagtgataaaataactcataacaaaataaattataattacttaaattttttgaataagacgaatagtcaaacacgtaagaaaaagtctaacggcgtcatctattaaaaaacggagggagtatttgctacggtcaagatttttgttagcgtatatatgccacatgatgtttgacctaagacattacaagcatttagttcgttgggtcacaaaatggtcaaatgcaagctctagcagtacgacactgtctgtaccctgctcacctgctggctgctgcagtgctgctgctgcttcatggaatgttggagctagtttagtggtagtgagcaccgaggggtacaaaattactctcttgcttcttattacaacggagacataatcacaaaaaatgtgtctgtatacatatattcttgcaatcttgcgagcatcgctctatacacgcacgacgacccaaaagaaagtgaaaaagaaaaaacaaacaaaaacaaaactgatgtaccgtgcgtgttgtcagccagctatgaacactaagctctgcctgacggccggaaccgagcaaatgagcgaaccgaagatccccgtcaggccgtaagcgatggcgcagaagggcagcgcttcaggctccttggccgacagcgctgctgttcccagtccatgagcactgcaacgtaaatgcaaacattattcatagagcatactgctgtatgtatgtatatatatgcagcttaacttactaaaaaaagcagccagcaggtaggtaaaagtaaagaaatttgctatctcgtggtataccaaatcattttcgatcatttgatctaaatcgtttccgaccattggatctagttatgtaggatggacattgttagatctaacgatcggaaacgatttgatactgtgaacccgtgaggtatcggtatctcgaaatactttttgttggaccggaacaaatctcaaaagtaaaactcaaaggtatatatgtacctggaagccgtccctattcctcgcgcgatggggtcgttgaggccaagcttgtccatggctgcttgcacaaaatttgcgccgatcagcccggtgaggacgacgaccgcagcggttagcgaagaatttacacctgcatgcccgggacacacaaactaagtcatccataccatatataataagctagctgagtactccatattatatatctagctgatcgaccagcaagaacagaaattgatttccagcaatataagtatgtactaggtccgtaccttcaaagaaagacacgatgctcagagccaacgccacggttatgcacctcggtaatattgatatggtcagtgaaggctctagccctatcacccgtcctaggatggcagttgagtataacgagaatgttgatgcgatggcaattgatgtgaaaatttccgctgcatgcctcttcacaagctgagttttacccaccgcaaaacattattagttgattagccaacacacaccagcaacaacaaacacagagcctcaggatatatatgaatcatctcacaccataaccatgcatgctaactgagaataattctgcagaaacagcagcaagcactacctttctctgcttgaacattgagaatgcaaacgatatgatgactgaaccaagaaatcccatcaggacgtcaccagctccaggattagatggcgcctttgtgaggtaatcacctggcaattaaaaccaacttatttcagaattcacaacttgattagagcactattgatcagggtttagtttacaacctagcactgcatcaactccagaccgggagagatacccatatgctattgctgccaaatctgcagagagtgcacaacaaatgattgggtgaagcactttcttgacaccagatggtatcctgccaagtaatcaataagacccatgtatgttgttagagaaatggagtaaacaaggcagctggtggcttcgtcagatcttacagattaagtgtatacaaaaagcatatgtatttacccagaaccaaccatgtatcccagtacagttgaagcgaggaggaaaggaagacatgttcttgccgtggtgccaagcgctgtggggttaacatacgcaacagcaaacgatgcgacaaagacagcaccccaggcccagaattccagcgtcgcgaacggagacggcttgctcatcggctcagctggtataagctgtgtctggacaatcttcctcacggtgagtgctgtgtatccggccaccatgagtgaagcaaaccagccaccaactgggaaatgaaaaccagataacatcacaccatcggttttttcagattgaatgcaaattaatctgaaaccaagggcatgtttagatcccaccctaaaattttacaccctgtcacatcgaacgtttgaacacttgcacgaagtattaaatataggctaaaaaaataactaattgcacagattgccactaatttgcgagacgaatcttttaagtctaattgctctatgatttgataatgtggttttacagtaaacatttgctaatgacggattaattagacttaataaattcgtctcgcagtttactgccggattctgtaattagttttttttattagtatccaaacaccctattacgacaccctatataatatccgatgtgacacggtaaaactttacacccctgaatctaaacaccctctaagtaaaattgttgtgatttatgaatggggccaatccacaatgcaagttggtgtggtaatatttactgcaagttaattgatcagcatatcaaatacgaagtagtagaatgtaaaatccggaggaagcagaggcggagcagataagcacgatgatcaggaggaagaaagaagtagcagaatgcatgcaacgataggagcgtagtgatgtgcatacaaatgatgaggaagatcttgaggccggaagcagccgggacgtccctgacggcgagcggcaggacgaccagggaagggacgtagaagaggggcagccacctctggatgaagagggtggccggctcgaagaagtccatgaaccccttggcgagcgcgggcgcgaaggcgtcgaggacgacgaggacggagaagacgcagaacatgccgaagagggcgctggggaacttgatggacgccgccgcgaacgcctgcttcaggaacttgtcggaggccagcacgatccccagcgacaccagcaggtgcgcgatcccgacgagctataaaatccatacatagctcacgcatgtcagttcgatcggcaggtcatgcgaaatcgcgacgaggctgcgtgcattttgactgattgacgactcacgctgggtaggcccgagggagaggtggcgcccgcgcctcctcctcctcctccggcggcggcggcggcgtggatcggggcgatgaggcggtggcgaggattggcgggagccatggagattgccgccgcttggcgggaggaggaggaggaggaggaggggttgcgtcggcatcggcggggaggaagcgtgcggaggcggggcggcgacgtggcggtggcggagggcgaaaggcggcagcgatggctgctgcgtagcgaggcaatcatgcagggggaggatgatgatgaggtcgctgccatctcttctcttctcttctcttcttctccttctcctttggccagcgagagagcagtggcagtgacagtggatgagaagggagctgggagcagtggcagaggccaggtggaagagaggagggcggcagagggatgcaagtgtggccagaaaattgggatgatttggggattgggattgttgggctaccacgcgccagcatatcgtcgttgcttttaggcgtgggtattcgattcggtttacactagtatggtctatgtttggtaaaactttaacattgaagaaaagtaaactgaaattatgattggaaaaaatctatctatctatctatctattaaattaaattattaaaacagccttaaaattaaaggagacaccgtatttattgtgcaggctaaaaattcccacattaatcgaagaaaaagaaaaatatctaaaccattggatcataatagatctagattttagcggtaagatttaatcagagtttcgcaaagtatatacacaacaataaaaaccggacaaaaggtaatatcaagtcagaaccggtttagaagttcaaaagtcgaaaaggtttattacacgtattccaatagctcttatggaattggaagcttttacagactactactcctgtcacatgacataaaaatactactacgaaacgctataatacacggattcacatgcaatagcttttctagagattcctatggccaaaacttttacagcaaaaacttttacagattactactactattcaccgaaccggctgattcctatgctgatcggattcgcatccaataaataccaagcaatcccacagctaacactacgagaggtgtgtggctttttgacattttattaggtcataatatatgaagttgacgtaatttcaaacgtcaaaaagccaccgtcataaatttagtatgtgacgtttgtacatctattgtcacaagcatatgacattgctttattatcacaaaatcctggggcttgccacgtggcagctgacttggcagttgacatggttgaaaaaaaaagtcacaaaataagattcggcttgctaaagcccatgtagctcacgggctacaaaatttttttttctggggttgtttctagctggcccagtatattatttgcttctttttaatgagtgcagcctgtacaaattttcagcccacaccaattcggcccatatgatttttctagcccgcacaattcagcccatatgattttttcaacccctacaatttagcccatatatttttccagcccatataattttttcagcccacacaactcatctgattttttcagcccatacaattcagcccagatacaatatttcagtacatacaaaatcagattcaaatgaattaacattccacaaatgattgcaatatcaaatgcatttcacatttcacaagtcttaaaattcaatatcagtacatccatccactggcagtgaattgattggccaatatctgattgaacatagagagattttaatgaacaattccgcagaatatgaagaatgagaagaattgaaaatacaactaactcgtttgttttgaaacaaaccattccctcaagctagctagcaacattgaaaaactaacacaacttgcactgtacttatgaagtgcatgcatcgtatcgatcaccagattatgctaaagagatccatcaagcaaggatgcatttagaaaacattcagattaaaatcagttatgatctgtagttcaactgctaaaacttttattgaggtcaacaggttacaggtagcgaataactcagaaccaatccaatgggccaatccgtgataaaagaaaaggtggcaacagtagatctttatattagatgaggtcttatacttgtgtgatactggaatatcaattcaagctattttctgctagctatgtcataataaggtgtgagatttgggtacctgctacacttttttttaatagtagcccaaaatctttatatcatcagcagattgatccttgtacacataaggaccacttaggtaccacgaacctgcagcacaatgataatattcttcaacacatcattgatttgcttgatcagggatgtaagaaaaattcaagggggacaacataagagcaatcagacaacaatatcaagaaaaacagtagttacctttttgtatttgtgaaatttaaagaactactactatgccggaccatgccaatcaaggttgaaaataacaagccaatatgaaggcaaaattaattagattcatggaatgcaattcggttgcacgctcctagcacggaggtcgggaacacaacacaccttgtgcttcaataaaatgtctctaaagaaagatgcatcatttcttttaatatatctgtctttggatccactcaaaccaaattttaagagattggtccttgggcaggttcattgtgaggcaatctaagccttggtaatgaaaagataaacactcaaattcctggaccagagaaatggatcaattttcatagtcagaattagaattgttccatgccaagtttagttcatctaataggtactactcaaatataggtctttgcccttgcttgaccagtgaaccgttatcttataaaatagtaaaaactaaaagtaaagaaataattgcacgtatggatattaccttcatgttgtgcttacggagtatatgaaattagatacatcaactagagaccaatcaatgctaaataaaagaacaaaatctcctcgaccaacatcctggatagatatggagacatgttgatcatctatattaaggagttcatgtggtcctgctcctctgcctctgtctgaagtttgggtagcctgaaacaatggaattgttaaaactaaacactagacagtctaattagttgactaacagttgtcgtactgattagttcgccaattccccttgacctttgtcaaatgcaccttcatatgcacaacaatttactcacatagaaattccattgaatatcttgcaaatgaatgaaattgtgaatctaacactacagctaatgatttctagaggaaaagcatactcactgaataaacgaacccttttttttcttgagagcaagcataatgtaccttgtttgtgtggatatgttgtttaaccaaaaggagctccaagacaccattgtctagagcctccatattatctagagcactataaacaaaatatgctagctgtgtactgtttagcagtcccaagtcacataaaccaagctactaggaataaatcataattgagcttaatcattgattttctacttttgtggagtatggaacaaaactacaaataaataacaaaaccattccttgatatgtctatatgtacatatcacgaaacataatgtatatacatgaatattcaccaaatgaagtcatatccacgctgttttgtgtagtgagcttaatcaagtagctcttggggattagcaccggatcaatagggcatgttgaactgttagtcgatacagtagttagatgcacacaaaccaccacatgaccactcacgggtgaaacataataaagaaccttaggattatacctgaccgtttaggttcctattcttcttgacctggcgaagaaatatttcagctcctgcacttttctattgcagcatgtacggagataaatcaaattgattgctgcatataatttattatagaatttgtcatgttaattcagagtgcaagggaaacaataccttagaggtaagcactgtcaccgtctgaagtagctagaaggctctcagaatacatgatcgtgttgtagtgtctagagattatttcgggtaaacactctacataatctttctacaagcctttgcattagcattggacatgtatctttttctaattactctgatttctaatcctttaaccaaagtctcccatgtgtatagcatagttcagttaatcagttggtgcaaataacatggagccatcacaatttcgtcatcagttggttgcaaactgtaatgcctgaaaaaagattgaccaagaacattaacaacaatatttagcttctgacaaagttttctctccacacagcaagtgtaacaacagcaggaaaaaagtaattttcttaataaaactcgcaggaatatcaagcgacggagggtgcgcaggtgttggcggacaggacgacacaaccggcgttggggcagtggaggaggatctgacgacgacggctgcatggcagcgacggtggccgtcgcgagattgatggcagcgcggagagaggatatcggcgaggcgaaggacgacgcggtgggtgatggggaggcggacgcggcggcggtggacaggacggcgcgacatgtgttagggatcgagagctggaccaccgttgccgagttcaccccgtcggcggatctgacgacgactgttgagccggcgaaggggactcggggatggtgaccgccgcgggattgatggtggcgctgagagaggagatcggcgaggcaatggcgggcaatggcgggtgatggggaggaggaggacgcgacggcggtgggtgaggaggaggacaacgcggaggcggtgtggaggaggcaatgcagcagcggtgagtgtgaaggaggacgacgcggaggcgatggggaggaggcgatgcagtggcggtgggtggggaggaggaggacacggcgacggtggcaggtcagggagattcggcggcgcgggggtgtggcaggaaggggttcgagagcggtagtagcgagtaccgcgggcgaagtcttcgtgcggtgatgggagcgaaaatcacggtggagataggatggagttgcggaaatacttcccatctagcgtccgatcacggcgaaacttcggacgcctcatcatttcctcccccatttgaatcacctttttaatgttacatgctaatacctcctcatctctttatcatgttagaaactcaggatgcaacttttgtgcaagtatatatgcatacgtaagttgaatgtaatctttaaaatcatttttctccaaaactactcattcagtctatgatccgtttatttcagtgtattcgtttcaattaaatctttacaataaagatcccgccttggtcgcccgggggagggggagaaaatcaggcgctccccccgcccccaccacgtgcgcacatgctccccctgggacccaccacgtctccccggtcacactgccacgtgtctccaccacatactccattacaacaaatcacccacatattttgaaaaccctatattaagggaattcgtttcattttttgttcaaaaaaatgtttcactatgtatagatctaatgttgaagtgaattgaaacattcttttgcaacaaattacccacatattttagaaaccctctattaagagaatttattttatttttttgttctaccaaaaatgtttcacctagtgtatttatagtgtttcactatgtatatatcaaatgttgccgtgaactggaacattatttcgttatttgctgaaacattgtttttatataaggtgaaacaaagcctgatttaaacgattgaaacattttcgatctattcagtgaaacaattccaatatacctggtggaacatcgtgcaacatttaaaaataattcaataattagctaaaaaaatttcgtcagaatatattcatgtgtggtcttgttttgaagatttaattgcaacgaatttaatagtgtaatcggatcataatttgtatacataatttaagagaaaaaatagattaaagtgtttttgcacatatcagtgcatgtgtcagaaatataacataacaagcgtccgtttttctgttatccatcggacgtatgaagtgtagtggtctccatggagttgctgtgcgagggtgaatcgcagtggacggtagggatgagagctatgcggatgaggatgcagatgatgataggaccaacatgttgatttagcctgcagcattgcaaggagataactccccctttttatattagtatagatatagatatctacctctatatatcaatggtagaaaaagaaagcaaataatttgcttaaaggacaagaagattaattgaaatttgaaataaaatataaaatgaattccaaaatagaaaaataattataaaagttcaagtaggaatacaacaagatatcggaataaaaaatatggattttttttaaaaatagtacatctagaacataaagatgacacatgacaataaataggggagaagcaacaaacctataaaggaccagagtggtggcggttgattgaacatctaaaagctataaacaaaaccccaaatagaatccgacgattaagaaaagagacgatgggtaaaccattaagtagcactgtcatgacagttggccggacatttagaaagcaaaagaaaaaaaaaaccaatgataattatgttcgattttaaaatttcaatgacaataaagaggggaggcaacgagtaggttgtagagtagtatagtggtggagccgccgacggttggcgggacttctaggaagtaaaaaatgaacccaacaataattatattcgattttgaaaatcccaatgataaagaggggaggcagcgggcaggccgtagacgagtacaatagcgacatttgacggacttctaaaagttataaaaagaaacccaatgagacaattaactctaaaaacctaattttgaaatattccaacaagaataaatagaagttgcggtagatcaagcaagcaaattaataaagggatggcaaaggaataagtagtggactggtgtgacttttcaaagcaacaaaaataaaaagttctgtaaaaaatatataattttatattggtgctagccacgcaactgcgcgggccacccagctagttactttaacaaaaactacgaaggggaaaaaaatataaaacccaagccgaaaacccccaactacagtaaagtttttagtttaaaccgaagcaccggtgaatcaccttctccatgcctgggcagtgggcaacgagaagaccacatccatggtcgcgtcgtccgcgagccatcgacttctcggcttcaactctcaagggagcgcagcggccgttggcttcccgcgccaccacggtcagatgccgaaccactccgccatccactgcatctttcaagtttcaccgctcttccgccgccaggcgccaaccggcctccgttcaccagcgccagcacggcccggcgggccccagtccatcgccctccgttcgtgtgagtccgcatctccgccaggatggcacgtggctgtgtgcatcgtcgcctcgtcggctggcaaagtggcgattcgatagctgggtcctgggtgggtgtggtcgtgggatagaataagtctactttgcctctctcgtctcttaccctcgatcgaatcatctctctaaccataaaaccgggtataacaccttccacatcaatcaaaaccggtgcaaatcgactccttcgacggtgggggtgtggggataggcttgcgtctgagtgctgactggaggaggagcatcaacgagctcgatatccaacaatgaggacagttgttcctgcatctatcgacggccagaaatgatgggatgcggcagaggaggcaagaaggtggcgaagaagaggcgcaagaagcgaatgatggggtaccagacttgactaggaagacgaaggctgacgagagtacacctgacttgacaatgatggtatggctttgcttggatgtcacccatttatagagagatggtagataaaaggtgtggacaccccgagtattataccatccagtgtccaacgcgaccaccacatactattggagaagtgggatccatacacgcataaatagccactcgtcctcaatgtgtccatgatcgcggttgacaaccttctattataataaacgaaatgtcgagtagtgagcgcaagacataaccgtaagatagcttgccagtccaccacgtcatatgcccgtcaaccactcgaaggtggcgaccaaaagcataccccagtgactcgatccaaagcgctatccccaattatctcaagcgatcaaaacccgttactcgtgcttagctagtccctaggaatgcgactagtctcacactttcatcgcaagcaattaataaacatagcaagtaccataatagggttaaagtgcagcgaggtatatgacacataatagggtccgaggtctcaacatacaacacataaatatagcagcggaagtctcaaatagagttcataagcaaaagataaaaccggtggtgccacaactccactagggcaaaccaaccgagcaagagccaagctgcaagagatcactcattgccctcgccgccctcggcagagcaatgaccacacaagaagcataactcataaccggaatcctctcctaaaattgcagacaccggttaagtacaagattgtactcgcaagtcttacccaaaattatatatacataagggagagagaaatatgcaagctttctagcctacagtgggtctctaggttcaacatttgcataaagctaattttattgagcaattaatgagtaaaataagcaaggataagtaaatctagcatcattttaatttatggacagcaagtatataattctgaaatgtataagcaaatgagcccaaacggcgctctcatcatcatccatggactaccaaagtccataccaacatggcacaacatgccaacaccaccatcaagcataatcacatccataataatccacatttgatgctaacataactagctaacacatcaagcattgtccataaccgaggacgcggctattcgaatagattatactttgatcagaggtgtacaattggacccacacgaaatgaacaaagatcaaatgctacacaccccgtcaagtgcggtacacaagtgattcaagctcattaaatgccctttcttagccccaccccaaccacctataccacgctggggttcccgacgactcagtcacgtgcgtgcgtgatgtgaccaaggtgggcgcgccacgcaggaggcacccccggccaaacctaggcacccgaggccctccaaaggctacctgcctcacaactctccaatgtggtataaatgatcacagtagaactagtaagaacaagccggtcccaaataagacatgtggtaagtacgaagggtgcttgaatagatgtcaaaatgttcggtccttaacgacctagacggggctacttgcatcaggggaaaccaacctcccatcatcgccctatcacccgtccaagtccaacatatttcatcaaccattatttagtgtaagtgctcaagttttatgcccaataatgcaagttgtttatataccacaattaatagcactgtccatccctatagttctattagcactaagcatggctaagcattaatgaataagaaatcccaagtaatcccaacaagtggtaataggatataaggacagcaataacacaagaactaaatgcataaataggttctacccatacaccataaactgacaatattaatatctaggcaatgcatgcatatatatacgtatagattgcaaccaaatcatttttagagaaagtataggttctatatgcttaggtgcttgccttgctgctgagggtagtcactatcctcctcgggatatggctcgttactctccggaatctccgaatctatcgaaaagaagcaatatgcgaataagagccaaataaacatgcacatgcaaaatgatcaataaattatgaaataaatacagtgggtagatcatattttaacttgaatttaggtgaaagaatcaccagattatcacttatggtttgggagatatgaaaatgacaagctcttaggtgctgaaaatggcagttctgtaaatattaacgtttcctttagtacattacaagtaaaatgcatttcaaaccaagatttcataataatgattatttttagagtaaattacatcactcacagctcctatgaaaaattatttcacagctatatgtgttgtcattatttatttatagatcttacaagttagaaacataggaatgctaaataaactcctaaacatgatttaagaggtagtttttccaaaaacaacaccacaacagcaaagagtactaaaatataagctcaacaaaattggtttcataattttagcttttaccaataatttcttacgaatttcataagagctagaccacacaagggatacatatagctatttatatttttactgggaaaaccagtacaaatgttggtcatttttattttacaacattgaagatcacgtttttcttaatccacagaaatttggttcactgaattcggagttcatatgaactagttatgaatttttaaagcgcaaacctctttcagctcaaaagctatctcagaaatcgatttctattttcgctcccccttttctccaaattccaccagacttcgctcacatggtagcaacctggacgtagggtcatgaggctaaggcctcgggctgatggcaagagacggagcaaggcctcgggctgacggtaagagacgttgcctagggctgcttcaaccgaaatcaaaagagattaacaccggatgagctgcagccacctcctagctgcaataatggagatggatgacctgttgaatgttgctgtagatgttcaacatgaagggaaataaaaaaaaaggcaccatggatggcaaggaagctcaccaaatagagggaaacaaagtcatgttgctgctgcaaccatgcaggctgaaaccaccactctcttctcctatttcaatctctctcaactctccatgcatgtgcaagatgttgggatggatggaaagcttggatgatggggattgttgtgatctaacatgcatgaattgatcttgggctattggatgggatttggggaggagaagtgagatgagagctcagcttgaggaaaaaaaagaaagaacaagcagtgaagatgaaaggggaggaagaagaaggggttatctctgcccccccccttaagtcctgaggtggaagcacgcccatgggtgtgttgtggggctaaagaggcacccaaggtcagtgacaagtgggcccaagtcgtggctgttaatgagggtgagagaggtaggtgaaaaactgagtacatattcgtttttgcaatttccaggatttattttctttccctctcttggtaaattcaatttgactaggtaaaactagttcaaaaattaagggatttgttgtggtgataggtgttggtttctaggttccatttttcaaagtttcactcaaaaattcgaaatattttaattctggtgaaaagatgaaattggttaggctgaaagttggtttgaattcttaggaggcctaaacagagagtaaaaattccacaaaatttatatttgttggtgataaataaactagtatttgaataaattattacacatgtaacttctgttcaagttattgttcaaatagaagtggtttcaattttaccgattagaattaattttgttatcgccaatgatcaaattgcaatatagtaaatatgaaatctaaacgacaacaaatgcacttctaaatacctggttatgaatgtagggctgttacaaaaggaatagaggagagaggtggaggaatgggggacaaatatggcagctattttaaaaaagttgaagtactgactatgatgtcacgtagatacaagtgggccaagtcaatgcgtcacgttagacgagactgttgtgctaactactaaatgaggtaaactgaccgttttgatagttgagtgatgacgctttctctcgtggcccgatcttctggtgaggggataactctcgctttgatcgagtgtgacgtttgcgacgtggctaccaacagaacaagtctaggacgtcgtgcaatcgctacaccacaaacgatgtcataccaaccgtgacgcgcggttgatgatccctgcaatgcaaacgagagaacactgcaagaacaagataagatgcaatctaaatattgcgaataggtgattaagcacaaaggaatagttgcgattgaagtggtagatctaatcgacccggcaaatcaacacaccaactattgtgggctctgaatcaatagtcgccgactaatcgaacgaggactagagacaaggtgaatggcacttggcaaaattcaactaaacaaaacccaattatttttttaggatgtacaaagctatttgtagaggaaaataaagctagggttaagtgctaattcgtggaggtggagggagacacttccgagatgggcctagtctattacaaggcccaaggcccaagttcggtttcagcaacaacactgtcttgttttggcgattcccgttgactcgagatgaatttggacatgagactggatgcgtttgaaaggtagcgagataagctttccacgaagtccaagatcatccaaattcgagttggcatgaaggtgctaggtccgtttgaagtcagtgctgtctccggaggccgaattgggttccaaaactcattggactttaatatcttgtagatcctccattcatccaacgtattctttggcaatgttttatatttctcatgcttggttgtatgcatatacttgatggccacatcattgagggagactatgtgtctgtttttttggttaagagaggaaaatctgactcggtccatagtcgaaggaggtaataccataatatagactttttccttctcgatttgcaagaggcccaaaccgaactatcaattgaacatctcaattgccatcagtttggtctaacctgacggcagaaacagattctctagagtagtctacaaagccagaactcaagaatatttcatttgaggaagataccacatacacttgatgtcgcaacagaagttcaccgagtgacttgaaaaaaatctacaagatatgataattgcaactgcaagtgtataagaattagggaaatgccgtacaactttccatggtcgtccctagcaatttgggggccccgtgccaaattcaaaataaggccttgtgttaaaaaatacaaattatatgaatagagcaaggctatatgtttttcacaaacgttgatatgtctctactaacattgtctttttatttgatctgcatcgcagccactggcccttcaatcaccttgcacttggccctaaatttcgagggcctatgcggtctctcacctcgcacttgctcagggatccttcaccttccataaaatgttcaacaaggtcagaggaaacattaattctgctctcatcaagcaccagataggaagctacaagtaatttcggctaaatttcccatgcaactcttaggccattcccaacccaagacactagacatagttgtcataaactccatatcatcaagaaactagtactagatatactctttcaatgcaaacaccacttttccatacttaaatttaatgtttcttatatcacatgatgtcttagatgatgtgtagaaactatgtgtcatgcaagatctggttttcttatctttcctcatttactcacttgctacatcatttttcatcctaggtgacaacttatttaatgctattgacaccattttagtcattaggttagggatggccttatgtgtttcatccatcctaaagctgaccgcagcattgctctagctttcgaacatgcccaacgtagtaaaatccttattactaccggtcactagtgaaatcatcgccaaataaagatttttattttcatcatttatatttttttattttcatttacatccaagggcaatggtcagatttcttttaccatttagcctccacacccctccacatggcgcttttccttttttatttgcgattttcttttttcctttttcaattttctcctatttttagcgttttcttttcgtgttttttttgacttttttcaatcttcaacacatgtgttttcaaaattttgagttagaagttttttaatcttgatttgaaagtttttatatcttaacctaaaaatttttcaatccgaattgaaagtttcaaatctcgacttgaaagttttcaaatttgggtcgaaagttttaaaatctaggttaaaagttttcaaatatgggttgaaagtttcaaatttgaattgaaagtttttcaaatttgagatgaaaagttgaaatttttcaaaaattgacttgaaaaaaattcaaatttcgattgaaagtttttaaaatttgacttcaacgtagatttcttttcaatctactagtaaaaaaccctgccaaaaaaggaaaatattgctaattaccataattagcactaatgaaactaattacagagctaaccgcgcagggcgtcgaggggggcgtggctgcgcgttacttccgtagccagtgtgcacgcgaaataggaatccctgcaattttcatgatcgggtaaagagaacacgatgtactacatcaacattacgatccgttgcccccaaatactatacaacgtgcatgcatggtatgtggtagttttttccgttgcaacgctgagacactttactagtataaatataataatcaaatatataatataagcttgtacaaaactttttgcctcaatactttctttaaacaaataaaaatatatgagacttaaggtttcatgaaatttatttatatatatggaaaacaatagcaactttatagaactctctccatcccaataaagcgtgcacacattttaagatttaactccctaaatatttaaccaacaataatttactggtaacatgcacatgcttacgctacggcttaacagttattttgacaattaaatatataatgagattggtataagattcacacaaaacggaacaaattattgggtgacttcggaattagacaattcattaaccttcataccaacactttaaccgaaattgagaatgcaaaagcactagtcaaagtgcaatgcagcatataaaaacagatagaagggattaaatctatcatctctttgcctctctttcaatggaaagacaaaatatttaacattttcatgaagcagcaaggaacagtcaaattttccaacaccaagaaattagttgaatttacttgctttgtctgtcgaatctatataattgatcgagaatagacaagtctcacagtctgctataaaaaaggacgtctttgcaaaagttgtttagtaagtacttaagcaggaactacttggccaacaaattatagattttcttaccaagtcaggagaatttcacactcatcaatttatctggaaacaaaatcctatgtgtgccataaccaatactaaagaaaatacatataatatagcactggtattggtgaagccgcaatcatcaagctgagcactatgatgacctacgtttcggtggtggcgacgcagaggagatcggcgaggtgggcgactgccagcgggcattgagcgtgtgaaaaaaaggtgggagagggtgcgaaagacgggagtcacaggaggtagatggtgggagggatctaggaaggctagggcaagcgtcgatctgggcgacctcggtggcagacagtacagggacgcggtgattagtgggtgagggttgtagaggaaggcatgcgaaggaaaatgggccgtgattgatttgctggcgtgtgtgattttcagctggtgaccctgcgtgcatgcgctgttgtcagatctgatgtattggatgattttcggacgttagatttgatgaataaggtccgtaggatatcaatgatgaactatagggtagattataaattaagttttatttgataaaaaaataatattattgatcgatatttgtatttacttttatataattatgatattattgctataaatatcataatatttaaaaataccattaattttaaagtggaagagtatttcataccgcggccgtccacgccacttgatgacacgctgtcgccagcggaagttcccaaaagtgacgaaatttcggcatagcgaaatttcgcagctcgacttggaaaacccaaaacggcaaaaagcacggagaaacaatccatcgacgtggtaatcaatcaaatcgaaagaaaaaaaatataaaagaaaagaaaagcgcacgcccctcaaagcagcagcggcctccccttccttggagcagagaggactagaggagcaccgaatccaaggtcgaggggaagaaaaaaagagaaaattccacgaataaaaattcaaaaaaaggaggaggaaaaaactgaatccccttgcggctcgtgctccttctccccgacctcgaggcaaggcaaacccatccttccccctggcctcccttctccgcttcgccggctcacgccttccctctctcgcgaggcggccggcgagatctgcctgcgccgcgctcccgctcgcgccgtggtcaggtgagccccatctcccggcccgatctcgtgcgggtttcctgccaattcgggggggcagggcgaggtgaccttgtcgtgtggttgttgttgttgttgttgttgttgttagggtttcgtcgcgtgatggcgtcgtcggggaagatggaggggccgtcggcgccggcgatgcggcgggacccgtacgaggtgctctccgtgccaagggactcctccgaccaggagatcaagtccgcctaccgcaagctcgcgctcaagttcgtgctccccctaacctgtccgccctgctcttgctgctgctttcgatcgcgctattcagattgcagaatgtgaacgtgctgctagtttagttgaatgcgttctctgcggcttcattgctcatggtcacaattgtttggatcagctgcagcaatttaccacatcagctgtggtgttcctcagaatcacttgaacttttctcatccagatgcatttaacagcgctgaactttatgcccatgtgtaattgactaatgatgtgccaattgtgtttattgaatggaccactgaacgcataacaaccgcatttttccaatgcaacatgaagaatgatgctcttactttattgtgctgagtagatatgtaacattatttctgaagaaacgatatgtcgcaaacatcattctagatgaaactgaatcaagtgtatttattgttttggattaaatttgggaggaagcattgaatgagagcaaaagtttctttgttgtacttgcattcttttctatagatacattttttgttagatgctattaccacaaacataagagcttactgtcttttccttatttttgtactgtttctgggttaccatagaacattttgtttcttgattggtgcaatactaacaatggaacagaaaagagaacattagagtgacttgtactctaatagtagattatttacgtgggattagaaactgtttggtcataaagggttggattagcatgctctatatgagcaaattccatggcaatgagtttttccttcttttggatatctatactttactaccttttgatgaccacatgattcttctttgggttattagtcctctctattaatgtgtcatctcaaatactgtcaccccattacaccctgttgattactgaattaggtctgtcatgtatttacatgtgtgatgtactgatgtgcttggctgctctatctattcattcctgcatctgcagtcttgatgattttctgtactcatagttcctgatataattgataggtatcaccctgacaagaatgctagtaacccagaagcatcagaactcttcaaagaggttgcatattcatatagtatcttgtcagatcctgagaaacggaggcaatatgatactgctggttttgaggtgctattctcataatctcatgctgactaccagactattttcgaacagttttttttgtgtgtattttgcttttactccaatggttctgcattcttctccttttctgatcaatcaataaggagaagtttggctgggataaatgaccagcaaggtgatttttggtggtgctgcaccgacatgtatcatactgttgctgtgtatttattagaccatgtgataactgatgagatttttggatgcttatttatctccaatcctttcttctgttgcaatgaagattagctaaggcagcttggtatataacgtcgtagactcatagagagagatttaatccctggaatctgtcaaagaagaaatggagattactcatctagcttgatatttattgtcatagatagacaatccctggaaaccacttaagaggtaatggagaacctgtatcctctaaacaatgacaaactattagaagcatttccaccatgtataactattttaattccaaaaccatttgactaagtacctttgtcatggataatatgcttaagatgataattgtaccaagtagccaagggccacagcttatcctttacaaatttgaactcagtggcattttttttgggcacttcaattattttgggcgtgtaggttaagatgtgtttgccaagtttcacatagttggcagaaataatgtaactttgttggtttgtaatctaaccatctgttgtaatatgctttcttaggcattggagaatgaaggaatggatatggaaattgacttatctaatcttggaactgtgaacacaatgtttgctgcacttttcaggtgactgtagcatctgtatgaattgttttctagaaagaatcgaggatcactaattgcctgctaactttcttacatattataccatttagcaagctcggtgttccaatcaagaccacagtatctcctaatgttcttgaagaagctatgagtggaacagttacagtgagacctctcccagttggatcatcagcaacgggaaaggttctgccaataccagttttatggtcttgtttataatgggacggctaccatatatatttttctatttataggttgacaagcaaagtgctcatttttatggtgtaacaataagtgaagaacaagctcagtcaggcattgtagtcagagtcacctcagccgcacaaagtaaatttaaggtatgaggttgattcttccttcaattgctctggaattgaagcttttatgttctgcatctctttgaatttcaggatattatttaattctctcatttgccaaatatttctctatagctgcttttctttgaacaagaaattaatggaggttatggactagctcttcaggtactttcgagccttcgcctttatataattgcatgattgatgtgttctgtagtttttctcattatttgtcaatggaatgccatgcggccatggattagtattactttctctgttcataaatacctggcgttttacactcggcatattaaacaacgtgacattttgcattttggtggataatgaggttctctgttgcacccttagcctccatgaataaatcaagcatcttggccaccttaatgaaaagaaaatgcacccttatctttccataaatgaatcaagcatcttgccctaaaaaaggcaagcatcttagccacccatataaaaaccgtttatctatatgagtttttatatgggtggctaagatccttttattttttacagcaagatgtaaatgcctcccttgcaactacaaatacctccctcgaatgaaggagattcacagcgattgtaaatgatttctccatggctgtaatcgtaacatagataaaatgacaccacataattgtaaatgaagtagtccgcagccataaatactatcagaattgtaatatagctccatggcactttttaggggtaaattttgattacactttgagctaaaaggttctaccattacaatcccattagtatttcattataatcaagcaaattctatttacatccatgttcatgagaccttacagtcaatggtacttgtttacgaccacaagaaaaataatgcgtgtacatgtagatccattacattctgtgttatcaacccaaaccaacaacaaaaagaaagaaggccctagtggtgacgcaacggcagtaactgccttgtgttctctaatgggaggttgaggtgataggagaggaggctgcaaggaccagcatgcaaggactctctgtcagggaaggaaggcagtgaaaccaacagtgtgacaaggtttggtggtggtggcttgagcttgtcgagcacagtaggctgccttcatcaccattctggtggataagtgggatgccattgatggatctggttgaaggagttttggatgcggtggcatcgagtgctggaggacaggggtgctgtcgatatatccggctagaggagacaaggccgcctgtagagcgctggaggtttccgctattgtcagatctattccaactcctgaggttgccactgctgggctgggggagcaatggtgtgtcattgtctcattgatggatccatctggtggaggagaggaggtgccatgttgagcgttggaggccactgccatcgtcaccattggtgttgaagtgggagtggttgggatgctgtcagctggagtaggattgagaggcggttgttgaggagggaggaagaggagtgggtagttagggttttggaccgtttgtactctgtttatacctgcttatggtcgaagcagtttattacagccaagattgacccatttactattgtgggctaccacttatgagtaatgcgagtggtaggggtgggagctctccaagagtccatggcgtagactagaagtatataaaaatttatcatttatgtaaaatgtgatatttctggacttctccaattttaattttgataccaattgtgcagtaagtgaccaatgcatgctgtacataactgtctgccaaatggataagagccaatgtttttctagctgtctccaagtttgcatctgtgtctctagttctgccattgacttctttattgcctctaatcacaaaagagtgtcgttttaggatgcacacagtcaacacaaattaattttgaccgtaattattatttggaacgtaagtttttaggcataaggacattatgtagccaagtttgtgacaacaagaacattaatattgtacttgtctaagttcttattttggttcatgcaataaactaagtgatcaaacttatgtcttttgagtgtgaaaagtaaaaaacaactcaccttttgtggctggagggagtagtatgaatggtcaacaatgattttttttttgttaaccagctatgaacatgatcttaatattttacattaatctgcagtttttttcttttttcattttgggtatgttaatgtgctgcatataaaaaaaattagaagcctagcttaataatgcatttggtaaacctgggcaccattacattgtaagttatttctatggcgccatgcttaatcgttgttgaatggcggatagatttgctaaacgtggcttgccacacccagcagcttgccgtctttgtgatcaagacgatgagattatccaacacctgctggtttcttgcatggtcgcccggcaaatatggattgaagtgctcgggtctacatgctatgatacccaaccagattcggttaggttttcgagttagtagtaccgagcaagcaagttcacaaactgaaacgaaaaggctcaactctttgattattgtaatagcctgggagatatggacatattgcagtgaaatgatgtagccagggatgttgtattagtagtgcgtttggtggaaatggagggcaccctttggtgtggtattggagcaaaggagcttgagagcttgttgtttgcattgctactagtgttggttgtgtattttctttatgtggctcttatgtgtcaaacgttgtaaggggttggatacttggatctgtttgttctttatttttcttcttctttaaatgattaaatgatacgcagctctcttgcatattcaagaaaaataataacctccagtttttttccgcacttccaggaagatagtcagaagactggtaaggtgacatctgcaggcatgtatttcttgcattttcaagtgtatcgtatggattcaacagtgaatgcggtatgtatgttctgctatatagctttagtttttatgctctttgggcctgatgtgatgtgagactttgctgcttcctactacagttggcaatggccaaggatcctgaggctgcattctttaaaaggttggaaggtctccagccgtgcgaagtgtcggctctcaaatctggaactcatatatttgctgtatacggtctgcaaacttactttatctgtttatatgaatgacatacctccgttctgatccatcctaattaatatgttcaggtgataattttttcaagccagctagctatacaattgaagcaatgtgtgcaaagagttacgaagacacaacacagaggctaaaggaaatagagtctaaaattctagagaagagaaatgatttgcgccaatttgaaactgagtacagaaaagtcagccactacatctttttctacataacacatgaaatatgtatttagttttcttttcaatttggagagagctttgatcgagttaaatggtgtgcaggctttagcgcggtttcaagaagtgaccaacagatacacccaagaaaaagaagcggtgagcacatcttttctcctctgaatgccttttccttctttcacaattgatacttcattgtggatattgtagagacaaaagaaatagtcatcgtatttttgccctctaattgtagagtctaacataactatgtaagggtgaagcagactacatagtgatgttttttagacatatcacacctaccgtttttttgtagtgagcttgtgcctgtttgaactggcacagcagcatattgactatgtagatgcctctctgttcttctagacagagggtgtcaggctagctctcaaacaatgtctctaaattcttacatgtccacattttcttgatgtctatcttgcaccggcaaacttttctttcatagaaaataagtcaaactagaatatgatttcaaacattcctttggagggcactttgaaaagcaatcactgtgttataacttgcaagaaatgtgttataacttgtagcctaggttaacagtcgtgtgttatctttcttattagcatatatctcttcttctatcagtcttgcagtctgaacgttgactctgaattgtgtgaatccatggtatgcttttctcattgcattgttagaaccttttaacggccccatcagttggctgtttataagcataagcgaaatggcatatttgtaaataaaacttttatatacgtgttcttaacgatctaaaagcaaaggctgaaaaataaactacgatgaaaaaaatcccaaaatcaactccaaatttaaggttgaaaattcaaatttggatgataagcataagcataagcgaaaagatgaggccataagtgcttggctccatgctgtgttcaaattctaagtgagttgcatatttgcagctagtacttgattgccaacactgatgtttggttatatgaatattggtacccactcaaactgaaattgcgtataattaagtctgcacagtggatttacatggttggtgcagccatgttcagtgaatgcagcagaaatactgttattaagaattgacttgttaaattattttgtcagttgacatgcagtttcttctgagctttcgtcaattaaatagtgtcctagctgttaatagtttgaagtatactccctccgtcccaaaataagcgcagccatgatttttttgtgtctaactttgatcgtccgtcttatttaattttttttatgattagtatttttcttgttattagattataataaaatatgcatagtacttcacgtgtgacttctggtttttagttttttcaaaagaatttcaaataagacagacgattaaagttgaatacggaaactcatggctgcgcttattttgggacgaagggagtacatagtagtgtagcttacagaaccgtgcgctgtaaaaatttgaaaccaaatggcatcaatttatccttcacaaaaattcatcaaatagttatatctaccaatatgataaagtttgtatcatattcttttctcaggctgaaccctgatgattcttcattacttttgctaataatattggattattgctaaagagttgtaaggtctgcaggttgatgatatgctgagagaaagggatgacatccactcctccttcacgaccgaacgaactatggtgaactctgttggagctggtagcagcagtagtagataccccactgagagtcccgagaatggtaacatagatggtaaagataaatcaagtaaaaagaagtggttcaatttgaatcttaataggtctgacaagaaagcttgagtaatctttcatcaaggatcttccgctgttgtacatttcagaagccctattgtatttgtgcgttgtgagctataacggttaccaattcttgggagttttgtagcattagaagttttggacacagaaagtcatgtattatccttctttaaattccatgttcctgtcttacttttcttccactatctcgtcttcctcttgctcttttacctctgttgccggtcgagaaattgctaaggtaattcgcactggtgttggaagtgggaactcgagtaggttctttattgcaattgttgattatttgtttgttttcggtgctaattatcccatttcagcagttacattgtcagaacgagctccttggcattacccattacttatggacgtattgtagtagccactactttgggccttttaaggtcaaaactttcattaatcagaagaaatattaccgacttgatcgcaggtagcaagaaaatcctggtattttttttgttcatgctaacgatggcagttgcgacccttttttatttatgaggtcatctgctaaattgccatcacgttgatcaaaggacgacatgagctatttcttttgggattagcattccgacaaaaatttggggatgaaatcaccagattttggactcgacacatcatcgtgctgggcatgacctgtaactatgtagccttggtgcttgtaaagtctcgtactttgtttgtcctaaaatatagtatttttgagattagtacggatattaagaaaatatgtggaaatgattgaaagaagattatgattagttgaaaaaaaaagtagttaaagaagaatggttataattggttgtgaggagaaggtaggtggagaaatagcttcattttagaacaagacatcatgctagaaatagctatattttaaaggaaaaattggttatatagcatcgaaagttcacgtttttggttttatagcgccgaaagttaccggttcactttaatagcatccaaagtttaccatgttcccatttttagcacttccgttatttttttcgtccgtcttgatcgttattgatccagccacacacatgatatgacatttctacccctcattgacatgcattatacttgtacttgtgaggggtagaaacgtcatatcgtgtgtgtggctggatcaagacggacggaaaatgatcgagaattgacggaagtattaaaaataggaacatggtgaactttgggtgctattaaagtgaaccggtaactttcggtgctataaaaccaaaaacgtgaactttcgatgctatataaccaattttgcctttaaagatcgaggtaatataaagctaagggtctgttcgttcatgcatttaggaatgagtattgagttgcttgcaaaacgataaatctcattagcgtatgatcaattgagtattaagtattataaattttaaaaattattttaaaaatatttgtatagaaattttttagaaattgtacattctggcgatttaagaaacgaattgacggtaaaggagagagttgcataaggaaaatttcatcagtagtgaaaggaaagaaaaaagaaaaagaaagaagaggccagcactgacatgtcggtcccctggtcttcttcagacccaaacccacgcctcccccccatctccgatccgccgcgccggcaaatcccccacaagcccaactcacgccgatccacctccgatggcctccgccccgccggcggcgccggcgccggcgccatcgctggtagacacgctattccagcgctccctcgacgacctcgtcaagtccctccgcgccgacccgtcggccgccggcgagtccgccgccgtcgcgcgcgcgctctccgagatccaccgggagatccgcgcccccgacaccgccaccaaggccgtggcgctccagaagctgacctacctctcgtcgctccacttcgcccccgtcgcctcccacccgctcgccttcccggccatcgagctcatcgcctcgccgcagctaccccacaggcgcctcgcctaccttgccgcctcgctctccctccacccggcctcgctctccctcctcccgctcgccacccatcagctccacaaggacctctccccctccacctccagcgccgccaaccaccacgtcacggccctcgcgctccagctgctcgcctcccccgccgccgccgccgcgcccgacctccccgtccacctcgcgcacgacctcgtgccccacctctcccgcgggagcccccgggcgatcgcggccgccgcgcgtgtcatagccgcctcgccgtccgcggccgtgccggtccttttcaagccactggccgcgtgcctcgcgtcgcctgacccgcgggcgtcggctgctgccgcagctgcattctgtgagctgtcggcgccgccagccgatgctgctcctttcctgccgctggcgcccgacctctacaatctgctcaccacgtcccgctccaactgggcgctcatcaaggtgctcaaggtgtttgcacggctggctcctctggaatcacgcctcgccgcacggattgtcgacccggtgtgccagcttctcgcgcgttctgctgctatgtccctgacgtttgagtgcatccggactgttctaactgccctgccggcacatgatgctgccgtgcgccttgccattgggaaggccaaggagttccttgctgctgaggatgatcccaacctgcggtaccttggcctccttgcgcttggtatgcttggaccggcatatgcatcgacgttgcatgaatgccgtggtgtgattgcccaatcactgggtgatgctgactcaaacatctgccgggaggcgttgcacctcatgatggggttgatcgatgacagcaatgtcacggacattgctggcatgctggtcagtcatgcttcgaagtcagacccagagtttgcaaatgacattcttggcgctgttctttcagcatgtgggcgcaatgtgtatgagctggtatcggactttgattggtatgtctcactcctcacagatatgggtaggaaccttcattgtgcacagggggatgagattggtcggcagcttgttgatgtgggactgagggtgcaggatgcacggccagagcttgttcattcatctcgaactcttctcattgatcctgctttgcttgggaaccacctcctttgtcctgttctttctgctgctgcatgggtctcaggtgagtatgtgaacttcacgaaggatcctgttgagcttgttgaggcacttctgcagccaaggatcagcctcctgccgatgtccgtgagagctgtctacatccaggcagtacttaaagtgatcactttctgttgcaatttgtatgttgagaggttgagtgattcaagcaaggaagtgtctgtagcattgaatgggttatctatggatcaaactgttagtgggggaagtgacgctccaattgggtctagcaatggacaaattacagtccctaggatgatggaaaaggaccctttttcacttaaatcggttgttcacatgattaacttgattgaaacaacagttggcccacttgttgagtgcaatgaggttgaggtcctggaaagggcaagaaacttgattggttttgtttattcgctaagagagattcaagaattgaaggaaagcaagtttgatgatgataagcatagcagggtgaaggagcttgttaagaatatgcaaacagtattatctcacgaaatagggcctgtttctttaaatgcacaagagaaagtatcccttccagatgatcttgtcctgaatgaaaatcttgccgagcttgttgacatcatcagtgaagatgacactactctgtcatcttcaattgttttctaccctcgtagctgtggttcagtcgaaaccagagatgaacctgcattatcacttggttcatcttctcttctttctgagcaccgtaaaaggcacggactgtactatcttccaacaggaaaagcggaggatgggccagttgattatcctcatgccaatgatcctctgctgcctgctagcagcgaaagtgctctggatgataaattgaagactatccagcctgttaccggtgggaaaaaaccgaaggccgtcaagtccagaccaaaagtagtgaagttggatggtgaggatttcctaagttctatggtggctagtgcaagtgttccaaaagaagattctttatctggtgctgtacgtggtgtactgttgggtagagatctcaagccatcatcttcacaaaaggcttcagataaggcttacgaaggaattataaacaaaatggactctggtgaatctagttctcagtggaaaaataatgtagatgctgatttcgtaggccatcccacttcaagttctagaccaagtattcaacagagccatgataaagagagtacaaaccctcttgaaagtgatgggaaggaagcgagaaaacacagaagatctaggagtgggcatcgtcaaggaaaacataagcatagagaaaggcattgcactcaacctgatgtacctcaagctcctataatccaggattttcttctatagttgctgaggactcccttgtttttgatacatttctattgccaagtacatgttaccttttgttcattcacattcagcggtttttagttttcactttcatttcatggaagttatttagttggtttatctgtggcagctggtctaactgccactgttgtatcctgtatatctttcttgagcatagcacttgatgttcttcatagctccatggcaatatatttgttcatagtgtacaaaaccagacttaatgtttttatcttttactacctccgtcccaaaaagagtgctgtccaggtagtgagaaatgcactatttttgggatggtggtagtattaatgtagacttcttttacatccctccttatacctctaagaaattgatgtaaccttgcaaactaattatccctaatactgtaagaccatgggtactttcgctatgcatatccccataggcttacatagttactggaatgtaccagttatacacattcataaatcgttttcatgttcttgcttcacataacataaatccagttatatatgtacaatctagattgaacaatgcaaacatgtcctatagatgctaaataagatgaactgaatttagaagggaaaactcttttcaagatgtactacagtacataccgagggaaaagatccttcagaagtatgctagaccgtgatgatttgaaaagtgatgctagtcgctaggccagacaccatttggtgagagggtgacctagaacagccaggcagccagccaaggatgtcaggcacagtacaagaattggacggatcgcacgtaataaacttggaaaagcgaaaactagtggctttatcagcttggttcaggctctaagggctttcacagtgcggtgatttgtcatctggcctgagcttgccacgtctacgactagatgggatccagtgtcacgttcgcagttgggcccaccaaactgaagcctggtcacccgttcgaatgtttatacttttgtaatttttcatcagatctagtctctactctcgagactatccagactaaataaaatgtttgtagagactatccagactacttaaaatgttttctgtagtgcataaattatggaattgattttattagattctctttgtttctttattcttgatttgatgctactgtaatcttttgtattattcactcttcttttttttaaacatacatgtacttacctttcacaacttgttctgttttgcctaacatgaagtaaatatattattgctccggcggttagaccgataaactggcggttggacgggtgaaccagtggtccgatttgttctttttctttaccacgtgttagggaactagagtaagaaaaaataaactcgcaggatatacacacgagggcaactcttcaatctggacaggatttgtagtaaaacaagattcattttcgtactgcattcgtttattttgagatatatagagtagtcatgtaacaacataatgttacataatgtatgatattgtgcttaggagccccatttatatatacattgagggttaaatgtcattatgctacgcaatgtcagtcttctcaacctaaaaacctatagaaactctttcctttgaaaaccataccttcaagatggaggtacattatttagttattactccctccaggtatgaaaacgtactgttatagtgttatggacatgtttcaagtcaactttacacataaatatatttttaattaccagaaaaagtgcccgtgcgttgcaacatgaagaaaagatgagaaaattgaggagaggttaagaaatatttacattacttaattaagtaaatacaaatttccggaatacttgtatttttttaagctggtaggtgtttaaattaattgaaaagtaagtaagtgtgggaaataaaaatgatatggctggatttaatttttattaaattctccatagttaattacactctcttaaattttcttgaaattttcagagcttaattgttaattttaataatacaaacatcatttcaatatttatttaaataaaaatcctcattacactctgggccattttcagcccatagcctccctcagcccacaaccgagccggcctgctttcatcccttccctccgcctcggcccgcaagcacgcgtccggcccagcaagcaatcgaaagtacaattagcctccccatggttctctcactgttgtgtgggcctatcgctacattgtcgtcccctacctccgtccagggttcctcatcttcccgatgcctcctgatgtcgccgcctccgtcaaatcgggccacatccttggagataatccgaaattgattgagggggtttcaatctttatgtcctctttccgtttttctgagaatcggagcaaatctgtttcgtattagctgtgaataaagccctatccaaaccctatttttcctactttaatacgatgcgacgtgtgtttttttcccgtgctaacgatcggagacagacaaagtgcagcgtcacgcacacacgagtgagagggggagagggaatcagatgattgatggacgaaaataagtatgacaaacggaaatttaccaattttttaagtagttaagatttacattagacgtgtggaattatgtctagaatttaccttgaaaggtactttcataatattacaatactagtgttttttataaatattttgcgatggaaaatagcggacaaagttgtagccccaatgtctaaaacaacttgtttttatgaatgaagggatgtgtcccatctacccaaaatctcttatattttgagcgaagggagtacctatgttcttttttagataacattaggatattgtcatgactatctttcatgaacatatttgattattaattttttaatcatacttcataaaaattattaaaaacataagagtaaaatacacgaatggttcttaaacttgtgcttaaaatatatttttgtccataaccttgtcatgtgtgtcatatatatatacaaacaaaaagaccgaatgtgtatgatgatcggatctgtttggcggaatttttttaatttttaattttatttattaaaatattttaaaaataatttttggttttaaagttttaaaaatctacacccataacgccttctcaaagggcgttttttatgatatggcacacgcccgttggtgttgtaatggtcgggtgaacatctacgagggtggcaagagttttgcctgtaaatggtcagctccggttgttttgcaagcgccccctttagccctttgggagggcggccaggggttgcctgtaaaatggccgaccgctctccatgtgaccgttagaatgcatcacgtcataaataacgccctttggaagggcattttaaaaaacgacatcctaaaggatgttagggggcgtagatttgtaaaactttgaaacaaaaaattatttttgtaaagatttaataaatctatctactctaatgttataaaaattaaaggtatttttttttgctaaagtttggtacgtcatccatagtccgattcccgtgctcgtccacgcgacttccctgtctgattcacgtctgacattgatgtgatcgcgatagctaattcgcgcgcgcgcgttgacggcgcccgttttaggcccataagggctaaggcccacgcataacctagcgtgcatgcgtgaggcggatggcgtccatgtccgtatgttttttccccggaaaagctaacgtccacgcatttttttcgtttctttttgccatttttttcgtgatctttttattttagaagttgaatctttcatctgtaattttagttgaaggttttgaatttgagttgaaagtttttaagatttaagttgaattttgagatgaaaatttttaaatttgaataaaatgttttgtattttcagatgaaagttttaaatctgagttgatagttttcaatctttagttaaaagtttttaaatccgagttgaaagttttcaaatcttgacttgaatttttttcaaatctaggtttgaaagtttgagttaaagttctatttatgtattatttttttaaaaataataatactaacaattatcattaaaactaattaatgtcattaatgctaatcagcgttattagcacttagcagaggctgagatgggggagtgcgttacgtgattacccactcatgtgtgagatgaaatgacccaccgaacaaaagatggggtgaccgaatgagatggtaaaatatatgctatccatcattaattctttctgcctgcagtgccctaattacaacctggtggcatatatggttaatgagaaatgataaaattttcaaacagacacccccaaataccagccgtgcagtagcgtgcattctagatgacatacgagatagggaatttgctttcaaaccgccttaagcgttaatgttctttttcttctcttgttaaagtgtatccatattgcattgtctcctgtgtatatgtaaggcacctattctccttttaatataaccggcaactctcttgccgtcttctattaaaaaaatcattaattctttcattagccctttggttttattaatatttgaaaaagtcattcatctttcattcaaatgatttcttccatacctgcccaagagttatttttgcagaagcttattctttgtgctgtagttgtatatatatatatgaaatatatatatgaaacgcatttcatccctcgtacaaacatcccgatgaggtatacccctacaccatagttctctatatcgttgtgttccgtcattaatgttgataatattaattaattttaactgttttgctctcacttcaacttcctcaatcccagtgattcagattcagagaatctatcaattgctctacaaactagataactttagctcttcaacccaaaaaatatttcttttcgtagtactgttttcatgtataacattccagaagcatacactgatacacaagctcgatttggagcagttgttttgtttgaggttcgtgtatcttatatcttatatagtttttcatcgatacatctatatgtacataagtattttggatttttttccgtctcctcccacgtgatcccacgcaggcagcgcgcctccgatccgcccgggaagaacctacgcgcataacgcgccttcgccccgcccggaccgaaccgtacgccactgcgatcatagatttgcctccacatatgtttcctattgcaaaaatctcactccctcattattttcgccgtaatttccttttctattcagttttaattcatcgaatttaatattttccccgtaattttcttttctattcaactttaattcgtcgaatttaatctctatttcagatggcctaccggtaagcttatccaaccttttatcttgagttttgcgaattctctccgatttgaaaaaaacggaaatagaaatcaagtggataaaaaaccatcaactaattttgggatatcgagagaatctttcgaaggttgaaaacgatagcggcggctatacgagttaggcgcaggcgtgcagcccacaatttgagccagggcttgctttaaaggaaggaatgaatgtccacaatttgagccgcaggctgaagagaggtagcgccgtaaaggaagggatgcagggccttcccatcccaaaaccaaggatggatttttataactttttcaattataatgtataccgatctaaacgtttcaataaacgtttttacccgttataacacatgggcattttttataaaatttaaaatataaaaattttctgtttggcgtgtgtgagtgggtgggccaagcacatcgcacattttggctcctgtggtcagagaccaaacaacaccattcgctcatgtgaagtcgagtactaggaaattagtaattttattaattaggtgttgataaattttcatgcatgtaatcaccgtaagtagatagtaaaaatatttcaatgaaattgaaaacacgtcaacaatgtttttgataattgtttttttttcttttgcaatcaaaatttcgatccaaacattggtttgctaaccgtctataataatcgttaactcattgttttctgattctttgggtaacccatacatatttataacattacttcagagtgaacataactagtggataagatttaaacaacgagatatattcacggaatatatcaacttagaaactttttttttctttcgtgatctcaaaagaacagtgagcgtattccttgcacggtaataacttcgattttgtggtaaattaagacctcgattgatctggaggacttctgctctgctcctaatcatacactattttcgtcggcacgcgtaaataatgtacatgcacgagcattttttttttctgatgttagtttaattgcccttatggttttcacctttgtgtactttactctgtcatactgatccgttggcacaattggtggtttctaacagaaattccaaggatgctgaaatatattagttacaacgtaatggtaaacgctgaagacaatctaggaatattgaaagagattgcaatgtaatgataaaagcagaagactaatttgtcctacaagcagaagactaattccaaacaacaaactaactcatcctggcataatccacatttcaatatcgaattatccaaaagggccgccaatccgtcatcttcactgtcgatcaaataaatttaactagtcaatcaattaaataaggaaactagcttaactgggaagctagttaagccctgattgttgttgcatacctgcagaaccttattgtatcaggagataagataattgaccctaactcactccgcaggatcgccaaattaactgccttccctttcctgctcagctggccgggcgctgtaaaatccttcagcaggaaagaactactacaactaaataaacttgaagtctgccgttacctgcctaagctggtcaagtcttgaactcttgattgtatagttgcttatctgcaaactgatatgatttaatcgggagaaaaattaattgatcttactgccaaaattatcttctttccctttaatgttcagctggctaggaggcggctgacattcttcagtaggaacaacaaagacagtactactaatcttcagtaggaatctacgcaggattagtacaaattttgggtcccgctatttaccctgaagtttaaggtagatactcaactatgtgattctcacatacacaactgcaaatggtacacatggcttgctattatctggcttttgctattgtcggatgaaaaactagcaatattccacaatagacctaagaaaaacatgatccagatgaatacttcattgttccccctcgccaggccaatcacaaaagaagcaaaaacaaggatttatcaagtatcaaaagggaaatgctagcaaacagaacctcttcaaaattattaatatggtcacatggatcgaaatgtgtgaatgcgatggtctgtacaaaaaaattatgtggttcctaataaaatagatatcaaatcaactttgccacctactactactaacttgccatctcatgttaagctggtagtttgtactattgcacaaagagctgttatgccaggcgtgccaagacaaagattttgtcaactgaatttcatgccaaagaaagaaagagcaatttatgacccagtatcaaaacaacaataatcacaagtgacatcagaatggcaaaccaaatgtcatgtagaaacatataatgccggaactaagtttttgccatagcatagggaacagactacataacgatgatgttactttcccaacatacagcttcttccataagcatcatattaacttagaatgtcagcaggattttgcatacttgcccaatctattcactatcaaaccaccaaaaggacataattaccatcacaaaaggacactactaattaacctatagagtatagagctaactgatacttaactatggaaccgaagatgacgaggagagactagtggatcatattaccatcagctaggatcgcagctccttcgagcttgtaaattagtccctttctaatcttggccatcttaactgccatctttttcttcctcttcatatcaatccacctcaggttctccaactttttctcaattgcgacaacttggtcgccgtccaacctagggaacaattccatgatagcaggttgtccctccatgagcaccttaatttcctttgcgagcaatggaaactgtttgcacatatcatcgaatgacctctgctcatcactagctaaggacttctcctcgtccctggccaaagacttctcatccctggcgaaagacttctgctcatccctggcaagggagctctgctcatctctggccaaagacttctcctcgtccctggcgaaagacttctgctcatccctggcaagggagctctgctcgtctctggcaaggcacctctgtttgtcgtccccggcatgagcaacagagcgcccccagatctcacaggagagctcatgaagctgaaggtcatgatccttggtaatagcaaggcccgacaagacaacatcgttgtaccgacgcttgagactgcgcaccttatccctcacatcactgtggttgaaggtgcggccctccaggcgctgcacgagttcatggaacaaggggtggcccggctcctgcggcacatttccaccactgcggatttgatcaacaagagcctctaggatcatgatctcgtcattgccattccacttgcgcccgaacccgggcttctgcgcatccacaatcttggccctcttgggatcaggtgggcaaatgctgcctgacaatgcggcaaccctcttgctcttccgctgcggcaacggacccttgccgtcttcctcatccccttgccatggcgccacctcctcctcagcctctgccatcaaatcaccatcttcctcctcttgagcagcagcatgttgcttcgccgatggcttcttccttgcctgcgctgatgccttcttctttgccttccctgcgttgggtggcacctcttgctcagactcggccaagcggccgtccacctcccccacatcttgctgggggcgcgtaggctcagcgggatcgtccggagcagcgaccttgccggagtcgccagctcgcagggccttcttcttcttcttgcggttcttcttcgacttgggaggggactcggggagatcgtcctcctgcgccgcatcatctccttgcggagttggcacctcgttcgacggcgacccggcggcgaggttctctctggagccgtggtcgctcgacggcggcgccgtcaccctcttcttgggcttcatcggcgacttggcggggccgtccggcgccgcggcattgccagagccgaagccggagccgctccgcggcagcgcggagtcccccttgggcggggcggcgacctcgtccttgccgggatcgccgccctcctcccccgattcggcagcgcgcgtcggcggtcgagggggctgggccgcagcaggaggcggcgacctccgccgcattgtcgatctgcggagagtcgcctccggagggggaagagctggaagggagaggcaacgagggcgatcgggcgacgcgcacccgcttgggcgccatgggtggatggatggatgctgctgcttggggatgagatcgaagtggaaggatcgatcaggatttgtggggttttgcagggtttctttcaggggggactcgtatagccagcgaacgcctcctcgggtccatggctcgccgagtggtggtggtggagaaacgaagcgccgagaaactcaacagggacggaggagggagtacgatgcagcagggcgggtttggccgtatttaccgaaatactccctccgtatataaaaaaaaacaaagacaaactcctgatttccgtgtctaacgtttgaccgtccgtcttatttaaaaaaaatatataaaaacaattaaaaagacaagtcacgcataaaatattaatcatgttttatcatctaacaacaatgaaaatacgaattataaaaaaatttcttataagacggacagttaaagttggacacgaaaacctagggtttgtctttttttttgagacggagggagtaagtttggttacctgcacgatgcctgactcgtattacgggtgtaggcaatgttagagatatactcctatttccttgtttgtgttaatctccaattgatgaatctttcatattctatcgttgtttctataaatcggttgaggataaatgaaatgttattttttgagggagcatatatatggaatgttatagcggtatatataaaaaaaagaattatcgtgtccaattctcttattctaacatggtattagttgttttcgcttccgtcaccaaaccctaaaactctacctctctctcccatgctcactgttggtgccgccatgatgcccacaccttctgagcctttgtctccacgatccttcgcccttgccgacaccgtgctcaatgcccaccacccgcatggtgcttcgggcgatcccaccctcatcgcctccgtggtgaccaccacgtctaccaccgctcgcaaggccatcactgccctcctcgccaagcacgccacaattgatgcgtcctcctcctccaagtcgtcatcgttcgcggcagacgccactccgtcggagctcgccacttcgttggcccaggcgcttgcaccactggcgagccacctctacctcccagcatcgacatctcacatggtgcgttcaacgcccccgacgccaccagcaccggcacgccccacgccggtcctaccgcgtccgccgatgcccatggtgctactgccgacttcctcagcgtcctcaacgtcgccttccacagcgcgtctagcatgccccacgccgcccccacgggcgccagccgcggcgtcaccggcctacctcccgcccaaccgcgtctctacacgctcaagccatcgccatcctgaacatcaaggcattggtccccgtcaccctcgacatccatgccagcaactataatcgttagtgcggtctcctcttcgccacgctcggcaggtactccctcgccgacatcttccgccctgaccgaccagattggatgcgcatagactgtgtcatccttacatggctctacaacgatcttcggcgatctcctcgagtccgttatgtaagtcaccacaatggctcgcctcatttggtgcggcctcgagcagcaattccttggcaattgcgagcactgtgccatcaacctccaagtggagttccacaacttccaccaaggcgacctcttcgtcacggactactgccacaagctcaagaccatggccgacaaccacggtgatgtgggcgaatgttgacagttgttaagtgcaaactttaaccgtcaacttatgtataaaagatatcaaatatattatcaaaacttaatggtgggagtttactactaaccgtttccaccagttttggtaaatatatgtatgcaggttaattaaggagaaaatacaccataggggcccacttgactgttgaaaccgacttaagatgggaccaaactgtctttaaccaccataggagcccattgtcaacctcccaaccaagagagaggctaggaggtggggcccgcagttcggccgaacaggggattcggttgaaccgccatagtggtgccccatcctggccttccacgtgtaggtcccagatgccttcccaatgacagttattcccggttttcggcctggatgactgccacaagccacaaccgcaatatggaggctctataaggaggaggcttcacatacttcaacacttacaactttggtgggaaatcaaactctaaccattggatagaaaacctgttaccattccaatagtgtcaatttggagctctgtttatttttcttcttagcaaatttattgcttaatacaagcatcataattgcttaagctcatatatagctcctctactcatggctttggctttgaactttgtgcttaaggttatttaaggcttagaaagaaaaaaataaatttacaaatgtcagtgatactatacacaattgaacaagttaaggagaatctagcatagctctatgatgacaactaccaagaaggggacatatctggtgaaaacccgtgaaaatcaaacctaaaagttttgcaaattcatgtaaaaattactagagacaggtataggtatgaaatacattctcaccaatttcaaattcaaactcaactttattatggagcaaaaaaagataaattttgagcgaatagtaacaagactttattcacctgaaatttgtcatttatgtttctctcgtatgaagttatgtttggacttaagatttggtatgaatgtatttcaagcctatctcatgtaatttttttttgtaaatttacaaattttttagatatggtttcaagggttttcacttatttgatgattttcaatggatatttcccctaccatgaatttctatatattattctaattacacaactaattaagaggttcacttcttaatcactaccttgtgttcgtgggagtcgtaccagaaattgagcccatttggttggcttgatagtttccaatagttgtttctactagtttctaagcctagctatgtcttgcatgcatatacaatatacatattgtcttgtggacaaagaaagctagctaggaggcaggaaaaggaaggaaacaagctacacacatgagctaccttttgtacatgtaccaaacagatctcccagggttttggttaaactcaaggttatgtgctcaagaaaagaaaaaaagaaacagcattcatagctagttcaaacttggcgcgaactgatgacatggggttggctggacagcaccgatgtctagaagaggatatttgtttaatttgtttgtgcataatttttgttagttacagaccggtaggtgtatatatatatatgtatgtgtggatggatggatggatgcaagcaagccattttgacagaattgttgtggaaaaaacattcaccggtggagatctgattctggaacatcagaaaggcattatgcccagtgtttagagtttagacctggtaattcgtttgagctgatttttatattttttcccctatacaaacattagtattgtaccgtgctttgctttgcaatctcaaaactcaaatatataggtatatgcaactattctgagttaaaaaataactataatctactctaaattaggtcaaaaggtattagtttgtgactagattatagtgactgcaaacacacgcatggcctaggggctgttcaaattaatgttatttttaaccataccatttttaaaaatatttacgtttagtttgttatcaaatctggtaaacacataagaaatcctactaaaattttagtaagatggaattttgacaatgccaaaatttgataaggtttattttagctacaatataagcagacccctaaaatttatgatgccatggtggtgcatatttctggacgtaatacaagaatgcgtggaaatcaaagttgatgaaaaaccattgttgtggaagacgaaatatgctttcagacgaaaagggtatcgttcactgataatcagaatacaagattaataagaactatgtggaaatttgatgttggcaaatatgacgttggcaagtacgtaatttggacatttaaatggctacaactatataatttgaatatattaatgttatcttttaattgaatggttataattaacatcaacttaaaatatagtttctaacggtcattcatacagcaaacaatggcatgtttggttatattcaataagtaaaacataacagaatataagaaatactaaacaaagtcccaaaaacaactttggatagtcatcaaatacacatgccacgaacaattaaacggaagatggtgaattaatcgctaaaataattttttaatgttcatgaaaaataaatgtcgaccgtatcacgataacaaactgtttcattaagtgtttgaatctcctaaatataaagataaaaataaagattaaatgtttcacgcaaaacaaaatagtaataacatgtgattaattgagatttaattattacaaacttgaaaaaggattaatatgatattttagaacaactttcatatagaaagtttttgcatgaaacgtaccgtttagcagtttgaaaagcgtgccacgagtatccaaaagtttattaacttttattggagaaaagaaccggacacatccgtttaatcggtcggtacgactgttttccgcaacctgccaaaaatctgtgctattcttcctaagattcgcatggactcacacaactagctactcaattaattttaacagctgcagctagaggcgacaactgagggccctggcaggattcggtagaagactgccaaagagaaatcagtgactcaagaaatgagagattgaagcagaggtaagccaggccagttagtgtgaagtgagataaactaatccaatcatccctttaagataaaaaagaacacgcgatttctcattgttcggggattattgttgggaaatgattatcagcggtttttaacctctctttctcacagcatgaacaaaacaacttaatagagcggaaaacccatacacatatctacattcctttcaaagactaattatgatggtgaatctaccatcacccgccacagatatagtatcatcgtccttcatccactttcacgctgaccaatcaattgccacacctagcgcgctcttccactcaggtccgatgccctgatccgtgcagcttggaagacccaccgtgatggtggggactggggatgtgccattgctggctactccatcaccatgggaaaatccacccatcaccctgggcagatttgccatcgaggctgcgccagagagcttgttgatgtgctaccctgatctacaccacgttgccacaatgtgcacctatgctgccttgatccacgccacttggaggtcgaccggcctacggtgccctgattcacactacctagagctctgttggcccctatcacgctgaactagggaggaggggagctcgagaccaccgccgtgaatgtctctgagtgcgagcgcccaccccacacgactagctagagtagcttctcttgctcgttcttggtgcagcgtgatgggaaaaggagaagtgaccgagatagagagagaaaagaggaggggtgggattttatatcagtttctgatttcgagagtgtataaagtaaaatgttggacttatatatatctgaattgcaaaaaaaatctaataatttaaatacgaaatgtaaaaggttgacaagggttgtaacacaaaaattcattggagagtggcttgcattgtagacctagtatcttcacagtagtttcatcttaggtggcacatacgtaggagttacctccattgctcgtagcagtagcggtgacgtgttctctctcctcgagaccactagtaagagtagcctccattgctcatgcctaagaacaaccatcttgtatcatctatataaattgaattgaactataatactcctactttatttaaattaaagtgttgtaacattggacattgagattgtctcaaagatataatattaactacttaaatattgtcccactcatacaaactataagctgaaatattattctcacccctgattctcaggataataagtagaatcacatccaaacaggcaaatatttgatatctcaagaggagaatcaccccagagtgattcatgttttttgaaagaatcactggaaacccagcttcaaatataggacattcaggcaaacctaatatagaactcaccacatactttctaaaaagttaccctccttctaaaaaaattataggccaaattatgataagcagcggacactagtacaaaaacccttataggtgccggttgggaaccggcaataggtgccagtttcccggccgacaccttttggtcggcaccaatgaccgtatgtcattggtgccggttgtagaactggtacctttgtgctctcccagattcaaaaaaaaatgaagaagccggctccaagccgagccgagccaatgcttttgagccacaccattcaagcagatgcattccatcacaaatcacagatgcaattccccggttaacaacaacaatcacatatgcaattcaatccggtcaacaacaacaacaacaaaatccatcactaatcaacaacaacaatcacaagtcccaagtgaacaacaatccaatcaatcacaaatcacagatcaacaacacaagcaaatgcacgaactcactctgtcgtcgtcaatgtgctgctgccaatcacagccggggtcccttgccaccgccactgccaccgccatttcccttggccacggccactgccgcacgtcaccgccgcacgtcgctgccccgaccggagagggagaggaggagggagaccggatctgcacccggtcacctatggggaggccgcccgccacctcccttggccatcgccgccgccggacatcaccgccaccaacctaccaccccgacctccccctcccctaatctggccgcctttgataaagccgatggagagggagaggcagaggggaccagatgtgctcctcctcgtcgtgggccaccagtccatgcgtcgctgctcgccggctaggagatggggacggagggggagggaagcgtccggccggagagagtgaaggcggatggagagggggactcggcgggtgctggagggggagggagaggggagggcggcggaggagaaggagtgggcgggagggggaggaggaggggagggcggtgccgcggtggagaggagtcgaaacttctctctcgcgcgtggataaggccggaggagaagatgcgcggataaggaagagaagcagggacctacgcgcggataagtccggagatgaggccggctcggctcgcccagttcggctcggtttggtatgggtgccggttttttaattaaccggcacctataatatattattggtgtcggttttttaattaaccggcacctattatatattattggtgtcggttctttttaaaaaccggtacctatagtattggtgccggtttttcctaatgaaccggcacctataatccttaaaggtgtcggtcgtatattttttcaacgtgcggatgtgggaaaagtctcataggtgccggttataaatgaaccggcacctataaggccggtccctataagggtttttgtagtagtgggatgagaatctaaagttgaatctctcaacttctggttttagttcactttctagattctataactaaaattcttagaatccatatgaaaatatgtacttggggacttgcacattctagaagaatgggaaactattctaaactctcgcgaagggatgtccactcgttgtttgcatgtcactcaaatggttatgaaaaaaaaaattgagaagatgtattaacatgtgatatatcactccacaaatatgtacctttcaaattcaacttctacatctcgcaaaaaaaaacaaattgaactacagctagtaaacttatatccgcggtcaaatttgtttttttttgttgtgatatgtagaagttttaacttgcatgtttatggagtgctatatcacatgttacatcatctcaatattcttttaatttttttcataatcatttgaatgatatgcaaacaacgtgggacatccccttgagagtttaaaatgtactctcggaagaatatttcttaagtcaaatctattaatatgattatttagttaagaacgagataaaatgtcgtaaatatattatgattaattttgatgagtaatacaaatttagaaatgtctattttgagaaacacacatgggtcttccggctagctccacaaggtggtgggctagacgacctgggttcgaagcctcaccccttctaattatttaatactttaggttcacaaggtagtattagattcttcccctaatattcacgtcttttcgaaatgtctactttagaatactctgtcagggttaataacacttatcgttttggtgaaaactatatcaaactttataaactttggttattaataacatttaaaatatttatgagaccatatgtatagattagttttaagaagtaattcaataaaatcatatatttattaatatatatatatatatatatatatatatatatatatatatatatatattaatggtcaaaattataatggtcttttggagactatgttcttgtccaaaataacaagtattatcaatccagagagagtaacaaatatattatgcacataaatatgctaattagaaaagtgacaccatgcatagtagactaacaggtaaggggaaaaattgaacacactcaaataaattggttagagaacatagtaaagaatatgacaagctactccaagtgaagtgaaactacgaggtacatatatccgtacgtagttggccaagaccctgtggaaacatttccttattggttggtattgacgatcaagctaaggaaaaaaggcacacgcatgcaggtaatccactactacgtactcctgtatgcatccatccatgcaagaaaaaggcttccatatatccttgtcacaagctagctcacaaaacttcgaactgacaagatgacaaaagtcacaatgcttgaaattgacaacacctagtagctttacatgcatgcataggagcaaatctctccaaccccaaaggttgtgtgtgttgttgtgtacaggtagatatagatgttgtacttgaacacctgaatatatatactactgctatctaggagtatctgatgaccaattatttctagaaacgggcactttgtgttggaagcttgcgtgtggccatttctcccccatgcccacctaccacccaaaaccccacaaatcttaccactcacacatgcggaaaacccccgttttctccgtgtggttgtgacttgccgctgcgccgcacgcgctacataaagctttggcgagctcgccgcttcggcttcaacggtgcagcttgccaacctaaaccgataatatcgctcgctcgctcgatccatggcgggcgtggtgcagaccgtgcagtgcgaccagccgagcaagcagcagctgacggaggcggcggaggcagcggctgcggctgcggcggcggcgtcgctgaggatatttgggtacgaggtggggggtggtggtggaggaggaggcgtggcggcggcggcgggtgcaaggcgggaggcggcggacgtggtcgtcggggcggggaggaggttcgagtgccagtactgttgccgcgagttcgccaactcgcaggcgctgggcgggcaccagaacgcgcacaagaaggagcggcagcagctgaagcgggcgcgtctgcagctcgccgtcgccgccgcggggacgccggcgggcatgggcttcgcggcggcacaggcgccggcgccgccgccggggcacgtgatcgccgtagggcatcacgcggggtcggttgcctcctacgcgctgcccaggtgggtctacctcgcggcgcaccacctgcagcccccggcggtgggcctgccgttccacgccaccgttcaggcagcagccggcgcgtgccacggcggcggcgacgtcgagacgcggttgctcagcgtcgccgccgctgggcggggcagcagcactgcaggcagcagcgctcactcgtacgaggtgtgtgctcctgcggctccggcggatgacagcgacgaggaagcctcggcgatggggttggacctccatctcagcctagctccggcgagctcggcatgaccggccggtggccgggagtagtaactttatttggtgcaccgcggccgacttaacatgtaactattctcgtgtgtatccccttcattttcttcccatttttttagggcaaaccctgttattttcgttgtttgcacatctcgcaaaaatgcaagagctcgagatatatacagtacatgcttgatcaatcatcaagctaatatacctatgtatactcacacagttgcccccactgcatttggtgtaattatcgctaatttataattctctcttatcaagtcacaccatcttatgccttattcgatttagagcagattgaagaggattgaggggaaatatttccacaccaaaatatgtgtggaataaatcccctccaatccctcccacatggggactaaccgaacaaagccttaattatttgttagtcattcgatgatcaatgtaagacgtggattatttacctctcttcaccatcgtcaatattagtaggggtgaaaacaggtcgagtttggttggatcttacccttcctgtatcctaacccgtattttataattgaaattgggtcaatcacggatagtgctgaatatagatataaactcggataatatcggtcacaaatataggacgaatatatgccaaaacagatacgtacactataagttaaaaaacaactagttaacgtatatggtcaaaattgtttttttttcgttgtgagatgtagaagttaaatttaaacttgcatgtttgcggagtaatatatcatatgttaatatattttctcaaatttttttcataaccatttaagtgatatacagacaatgaggggatatcccctcgaaggataaaaatctactcccactattgttgtctgtatttgctcacaagctaaacgtgctagctcgagttaacaaacaatctaacaagaatagattaacccaagcaaacacaaattactagagggatggagaagaagtactgcagagggacagtgacactacagcgtcacaccgatcaacacacgacggcgagaaacaagcgactgaggtcaagctgaaatactggcgacgtttcatcggaagtggattttctaactcgagtgacaatccttatttgtacatgtcgttaaaaaaattattaagatagatcaatatatgatatattttttcacaaacatgtgagttaaaattcttctgatacaatttgaaacaaaaataataaatttgaccgtgaattacacgtttttatagtcaaatttgttatttttgtttctacttatataagttgaatttgaatttgcatgtttgtgaagtgacatatcacatattgatctatcctactaaattttttcaaattttttatgattttttaagtgacatgcaaaataaggggatatttccttaaaggatgaattgggtttcccgttatctgtaaatccaattttctttcctacgtagttccgaggacaataatagagccatcgatattactccctccgtttcaatgtaagtcattctaccattttctacatttatatggatgataatgaatctagatatatatctatctaaattcattaagatcgatatgaatgtgaaaaatactagaatgacttatattatgaaataggggaagtattagagagtcatacacaaattatgtggcggcaatctgtgtatgactatgactacagcttaatcctatatacatatacaagtcatccccactaagtgcaattaaaactaatttcctgttttgagagtaagccacgtcaccttgattcattccagccatcggattgctcataaacgtttggatagcaatcaatcaatcaactggagatagcaatcaaaataaacatttagcaatgactaattaaagaggcccacctagccatctcttaattttgaaacatacagttggaataccaacagcaacgcatgtagtaccccagcagttataagctctttaatcttccattgaagttattttatctcctgtaaccggtgaatcagatgaacagttatgcctttatatactctctcattcactaggactttgttcctgatcgatcatctgcgcttgacagtctttccatgcatccagttgatttatttgcccactcctctgctcatgctgatgcttcaacagatcaacatgcacaatccgctttggtcatctctctcttgcttgcttgctcatggatttatttttctttttcttactaatatcacttcttgtttagttgtagaatctgaagagaagaaaagaagtagcagtttcaaatatttcttattttctgttctttgtgaaggttgcagatcttatagagagaattgaagggttggtgcattactatattcacataccggttgaaataaataagaacattttttttgtttcagttggttaaaataaataagaatacttttttgtttcagtaggttattgacatcttcgactgaacttttgaaagtttctacttcattaaaactatagtttggaataagcaattacatagcatctttgtgtaatcaccatgacgtatattgtctaccatttttctttcttgcaacatagcatagaacaatctatgttagtaccattctatttattgcatctgtgttcaattggccttggttccagtaaaaggaattgaccattcactaaacaatcagcgtattctgttatgattcaaatttcagttgcttattattataacattgttggtgaagtgttcagtgtatatcaatacgatcattcatacctaatttttcatctttacattactcttatattcccacatcaatgcgcggggtgtcatctagttagagttcgtttagtgctcatatatgcgtggtggacgaaaccgagatctcgagtcagtctcagtcgtcgtggtcataatcaatcatgcgtattcaggagaaaataaaaaagaaaaaaaaggaccagctgatggactgccgctaccctctctttagtcccggttgataacaccaaccgggactaaagatctttagtcctggattggtagtcccggttttatctcggtttgaaaaccaggactacagagggttatgaaccgggactaaaaagcacttctccaccagttataagtgccgtgctacttacgtgtcagggtctcagggacgactaatatggcgacgtcgatggagctggcgcccggcgacgcgcggttcgcgaagctggcaaaagagctcgacgacaaggcgccgcccaaggccgcggccgcgccaccggcagcatcagaagaccaagcagcagcgagctccgggaagcccaagtacaagcacgacttctacaacggcgcgagcgaggtggtggtgacggtgttcgccaagagcgtggcggcggagcacgtgtccgtggacttcggcgagcagatgctgagcgtctccgtcgaggtccccggcgaggcgccgtaccacctccagccacggctgtcgggcgcaaggtcgtcccggccaagtgccgctacagcatcctcccatcgaagatcgaggtgcgtctcgccaaggcggatgagcaagtgacatggacgtcgctggagtacacgagcaaggccaacaacaagctcgcggcgacggcgacgacaacgacgaggaagaaggtagactgggacaagctggaagccgaggtgaagaaggaggaggaggaggaggaggtggacacggcgacgccggtggtgaacaggttcttccagcagatgtacggcaacggcgacgaggacatgcggcgagccatcatgaagtcctacgtggagtcctacgtgctgtccacggactggaaggacgtcggctctaagaagattgaggccagcgcgccggaaggcatggagctgcacaagtgggagtattgatagtgttattattatatatatagtcgggctaattaggaatggatattgtccgtgagttgcaatgagattttaattttaaaaatatttttaatccagtattagcattattttctatatacatcatatatactgtttcttacttatatgtggatgttctaaactctgcggggtaatttttaccttttcatataaagtagggagttgatagtgggggtggttgacatatagaccctctgaccctacatgtcttttcttttctaaaaagtagggagttagtggtgtcttttcttttctaaaaagtagggagttagtggtggaaatggtgacagattcacttttcttttctaaaaagtagggagttggtggtagaagtggtgacagattcacctatcactaattcaccaccatcattactctcttttataggtattataggtatataattcttgttatttgtaaccttatataatttttgttatttgtaaccttttctgtcagtatccttaaaaatgtggtactgtcttattaaggtatcattatacacatagtagtacatgttctttgttgggcgtgttactaatgtgctacaagtttaataaactcagttggaacttttattatgtgtaagttagcgattacggtggcagagtcgtgccagctactcgtggtagatggcaaagctcctgcctgcatgcctgaatggaccagaccaaatcatttaacatattgttaagtataattcaaggcgataatacatattgataagtgaaaatattgagtttgttctggtccattgcaaaacttaggttaaaaagtgaccctaagtgaaatttattttaaaattattgagcggataaattggatattttagaaaatatacttagctgatagcttaaaataagtgttctaagtaatgtaatgtagtgggaaaaaagggaaactatttatgatccctcgatgagatatctcctcgtttacttaaaatccatccaacagttatgaaaaattcttaaaagaaaaattgacaacactcatacaacatatacaactccacaagatcttaggtccaaactcaactcacatattgagatataaaaaagacaaattcagcatatgaatagcaacgtactgtttacatatgaatctatctttttgtttttcaatgtgtagggcgagtttgaacttaatttttggtggaccagtagataatacgatactcttcaatgtcatttttagaatttttcacaaccatttgtatcgaatatggaaggaaaaggtacatgaggggacatccccacaggagattagaatccactcctgggaaaatggatttttgagacaacattttctttaaaaaaaacataaagcacatagtttcgataattcgatgaataatctaaaaataacaagggctaaaaaattgctctcccccctccccaagataatatttttttttcgaggggacaaacagggagctcctgcaatttcactatagaagaagagagttgattcagtttgtaaggaaaaccggacctaaaaatcttacaacggcacggtttattaaaggaaaaccggcaaaaacctcgacattgacaaactgaacctaagtacaaccgtccaacaagaggaaagctcctaaaacgaagccttcaagaaggttacgccgacagaacagcgacatcatccgatcctaatgaatctaggttttcacccggagaaatctcttgaagtggagttgaatgagggctccagtagcaacgccttcaagaaggtgaacggcgcccaagggcgtcgccgttgctagcaccgagagcggagcaaggctttcgccttggagcacccatcaaccatagcatctacgacgggagccaccaaatgttacctgcacaccgagggtacctgcaatattcccatccccacccgaggacgcgccggatctgggcaagagagccagatccggccgttctcctcaccaccaatgccagccgacgccaaaggagtgccggagaacgccagtggcagccgcgggatgcctgcgtgcgctgcccaccgccggccgccacgccgccgccggatctgtggcctccaccaccgccgctccatcgccatcgccattcccgccggccatcacccacaactccacccagcgcaactcacctcgaccgcctccatcacccgtccccaccgccaccgtccttgcggccgcgcggctttgccggcggtgtggagattgtgggtacccaatacccacacggcatggttatccgactagttataggggataacttatatctatagaatatgtaacagatcatgacttgggtattatgtttccttgtatattacggaacggcctaaagtcctggtttgataatattgtaaagtagatttaggaaaccgataccgtattggttaaggtttctatcttgtaattctgccccccaccctatataaggtgggcatgaggccctctagggggcatgagcacatatgatcgtcagatctatactacacccggcagattcaaatccccaaacaggagtagggtattacctctcatcgagagggcctgaacctgtctaaatcctttgtctccgcatccatccacttttaggtctcgtgtgctaccccgttttattattgccaaattcatgtttcgacatttggcgcattaggtaggggtgcgtcgagtttcccgtcgaaaagtgtgatggaatcaacttgatgagtagctcgcttcgtcttcgctttgggagctttttgcttcctcgctgccgacgactacaacaaactctcgctctttgacttggattcaaaccagtcgggagagattcaatctagctaaggaggagatgcaacttccgtatcatcttcatcaacagcatcacgcctcgccaccgatcgatctccctccgatcataggaggccacatccacatctcccgccagcatcatccacaatgacagcaggccaagctgcagacggtggtcggccttgtcgccatcctctacggcacggacgcctgaccttgccgatctccccgatgcccatgcgcacgtgacccgcgcatgacgcccaagcgcgagcgtcgcctctgtgccatgcatggcttatggctgggagatccaatccttacactatagaccatggcaacatggccgaccaatgaggtgaagacacatcatcgccaggctataggaccatacaacaccttgcaacaggatcttggctaggagtgctttgcacgccttaattttttcatctacacatatacatatgctttaatctatgattgcttataagattgatttctccttttttgcatgtacactcggggaacggcgccgcacgcccgggggcttcatcctttgcgtggctgacgcggcccgactacccccgtggcacatgcgtccaaggcatcacgtcgcatgcccgggggcttcaccaaccggcttgctttcaccgccaccgactggtgttttcgcctatatggttggcggacttcgccgccgctgttgggcgtctacgacttcaccgccggtctgcctccgtcgccgccgactggtgtcctcgcctatatggttggttggtcacaccaccgttcatgggcgccatatcttcaccgaccagctggcctttagcgccgccaactggtgttttcgcttgcacggctggcctattatgccgacactgttgggcgtctacgacttcaccgccagcctgcctctgtcgccgccgactggtgtcctcgcctatacggttggttggtcacaccaccgttcatgggcgtccacatcttcaccgaccgactggccttcaccgccgccaactggtgttttcgcttgcacggctggtctattatgccgctgctgttgggcgtctacgatttcaccgccggcctgcctccgtcgccgccgactggtgtcctcgcctatacggttggttggtcacaccaccgttcatgggcgtccacatcttcaccgaccggctggccttcaccgccgccaactggtgttttcgcttgcacggctggcctattatgccgccgctgttgggcgtctacgacttcaccgccggcctgcctccgtcgccgccgactggtgtcctcgcctatacggttggttggtcacaccaccgttcataggcgtccacatcttcaccgaccggctggccttcgccaccgccgactggtgtttccgcctgtacggctggcctattatgccaccgttgttgggcgtctacgacttcaccgccgaccgcctaggctgcctccacggcgggtgtttttattgccattgatggatgaccttctccccacatcggctacttatgccatcaccaaggagaatattacaaagctaagtcatcttttattatatttctgatatgatattttccttttcctctgcctcactccatcaactggttctccgttgagttgttagtcgggggctatagacgttatgtcatattttttcaacaattttcataatatttatcttgatttgctcgcgacataatctgagtacaaaagtgcctatcgagttatggagttccatcttcctatgctttccgtttggtttgccaatggatagttgcctttgggccgattcctagcacccggaggctcgttggatggaccgagtaacgcaaggtgctaagtattactcggaagaaatcaaaagcataaagataagataatttattttctactcttaacaattgcaaaagtacccgagtagtaaattccaattcgtgaaacttcgttccattaatgacaaactcatgtcactcatatgcatgtttgggaagtgcctaggccgactcccgatgcttgggggctatgactagtcggacagagtgtttaaacgtaaggagtcatccgctcggggaaatcaaaattgacaaaagaagaaatacatatttataaatattttaaaatacttgaattttcctcgagtattatatttacatcagatactactcatcctatatatttgttctgcaggatccagatccagatatgcataaaagggattcatggctttaagcttatctcttacgctccaggaatggatcagtcagaacatcaccaccggcttgccgtcgtcgccgccgactggtgtcttcgcctatatagttggttgatcacaccatcgttgttatgtgtctacatcttcaccgccggcttgccttcgtcgccgccaactggtgtcttcgcctatacggttggttggtcacaccaccattgttaggcgtctacatcttcaccgccggcttgccttcgccgccactgactcgtgtcatcgcctgcacggctggcctattatgccgccgttgttgggtgtctacatcttcaccgccggcttgccttcgtcgccaccgactggtgtcttcgcctatacggttggttggtcacaccaccgttgttaggcgtctacatctttactgccggtttgccttcgccgccgccgactggtgtcaccgcctgcacggctggcctattatgccgctgttgttgggtgtctatgtcttcaccaaccggccgccttgtccgccgccgactagtgtctccgtctgcacggctggcctattatgccgccgttgtcggacgtctacatcttcaccgaccggccgcttcatatgacgccaattgatgctatcgtcttcacggctggccacgttgccgccaccacaaataggcgtcatcaccttcaactcaagttgtctatgtctgcagccgactggtttcttcacttccttgaatgcatgattctgccactagttattggccttattgtcttcaccgccggtcgtctcgtctgctgttgactgctgtgcaactttgtcaccatggtggagctacttcatatttattattttcgacatcggcaaactctatagcctatactttgcatgatttgccacttcaccaaccacgatgtctacaagagcgagcatctcggcatgtgtcacgaaatattatgccgtgttattttactacaacaagtggtgttccaatctccaatatttctactcggacatcttcaacacgtatcttcactcaagcaatgactattcgacgacaagaagctacagttctcgactctatgttcagttgtttctcaactaaccaaagagtcgggagctacacaaatacaagactctcaaaattcgacaagccttatgtcaagatgaagcaatcaatcaatcaacgaatcaattcggggagttattatcttcgtcttcgcttcagagccgacatttaatttcagcgactccaattattacatcggcaattttggcttcttcatgccgccacaatctactccaaatttcttaagtttgagatttaatttacatgtctgggagtttggagtcatcaaccaatcaactcagatcagatccaatgagttgaacaacagtttctactttcattcaagtgaagcatctacattagctataacactaagttttgcagtcatcttcgtaaatcaagaagctttgcatcagtcttctttatgcacacactcgaatcaaggaaactactcgagttttgatatcttctcaacaatttgatggattattgtcactgacatcatcaccagcacctctacttcatcggccctgacatctctaccgttgctaatggatgactacgttttcacctccggctgcttctgtcattgccgactagttatttcgccttcatggttgacctactatgcaaatgctgatgagtgtcttcgtcattatcattggttgctacactgctattgactggatcaccgacatcgtcatcttcatcatgtcggttgcgtttgtcgtcgtcgactatttttcttcatcttcatgattggtggatttcgtcatcgcctttgatctgcctcgtctgtcactgactgattatttcgctgccatggctacacaactttatcgctaggcgccttcatcttcattgatggctgacctgactgctgccgactggtttcttcgcctccacggctatgcaacttcatcacttttgattggtatcactatcttcactaccaccaatatttttgccacctctgctgggcaatattatctctatattggtcgtcttgtctctatgccaactgcgtcagctaccatcaatgaacaattgtgactacgtgcttagggcttactagctcaaacacaagtatcataccttcaatttggacttgctccgaatacatgcaacatgaattcatgatcatgggtctattttctatgctcaaagactggactatttattattccccataagggttatcaaccgaatacttgcgccagtcgggattcaattattatatctattttggagtatcccataagggataatcactcagatcagaaactattgatatgagctacacttggtctatatcacccggaagatgtattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgtccaataccttaaaatcattttataccgcagttactcaactttttaggagttagtacaatgcatcttaaaaggtgtcaaacagtaaagctttatatagctgcctcgctgacttttttatatagtcaaggcactgtttgggtttatcaagcaattgattggatacaatatcgttgctttttgccacgtaagtgtgcatttttattgactaatattatggcttaggctgattatacattgtggtcattttccaggcggttggtaaatcatttatgagtttatttactcagattttacaccacatatgccatatatttccaggtatggtgaaaccatgtgttttttagggacttaagcacatctgttaaagcagtgtgcgcatggcgtatgcccaatactttggaaatttctttattcgcagcattcaagcttctttatagctgttttgctatgtgaatttttaatgatgtaggcaactttaggttgtactcatcatagtttacaaagcagtcggtatatcacttggatcatgttattcggggattcacatcgcatatgctatatattgatatcaagtcatttggtttattacaattatcaaaaccactcagttagttagattatttattccttgactatatgcttggtttgttcaactaatcacatggtcggaggctacacctattaggtgcatatactcgatgcacctaaatttacattcaattatttttcagccctccacagtcttcatatttggtaaaagtactcgggagaccatggcaaagatgattgaagcacttggctttggagtaatctggttcgagagaagattatcttttcgtctgttaaggtcttaggggctactgtggagattatgggtacccatacccacacgtaggattgcaagtgggacgggttgcgggccgtcccgccccgccccacaaccatgccatgtgggccacacggcatggttatccgactagttatagggaataagttatatctatggaatatgtaacagatcatgacttgggtattacgtttccttgtatattacggaacggcctaaagtcctggtttgataatattgtaaagtagatttaggaaaccgataccgtatttggttaaggtttctatcttataatcctgccccccaccctatataaggtgggcaggaggccctctagggggtatgagcacatatgatcatcagatctatactacacccggcggatttaaatccccaaacaggagtagggtattatctcccatcgagagggcctgaacctgtctaaatactttgtctccgcatccatccacttttaggtctcgtgtgctaccccgttttattattgccgaattcatgtttcgacaggcggaagccgtgtggccgctcaagtgacggcgaggcagagagggaaggtgggggagagggtcggctaggtcgtcgcctcccgagccgcgggagagcgacgcgagagatatctatgacccaagataatattgaccttgcgcatctgcaacagcaaaggaggggtgctgtccagcaacgacgctgatcaacttgcacaagacgatagatgactagcgaagaggcgattgacagttaattccgccgcatcaacaacaattcattagttgattggctactcgaaactcttgtgctagacagcgccaccagtggcgtaacaatatctcgcatggtttcgcctttcacaagacctttttttttgcttggccttcacaagttaatcaggttaggatcactggcatatccttcggcaatggattatcgtgtaaaaaagaagagcaggagaaaaaaagaagagaacgcaagaataggatattccattagcaataaaggcaccgataagttacaaataaagaataatcggactatcatactcaactcgcgagaggcaagctgcagttagttcatgcacctacaagagaaaaatggagacatactctattcactcgcttcacattttcctttccccaatactacttacaacacggcggctagttcctcacataataaattaaaatgcaacctaaaattatccgaatcgcctaaaatcgagagagagaaaaattgtaacacaaagagcgctcacaattgaaaaagaaggtgagtttgcgggagctacaatggtggctgattgcaagtgatatcatagaaccttgacgccacttggtcgtttaccttccatggcatccttcttgtcgcggcaatcggaacaaaggaaagggccttcccatggcttagaggagctggaagagaagattgaaccagcatggactgatataccttcacttggttcaaggtccacctggcagatggcacatgtaaa

SEQ ID NO: 59044 - DNA, 614 bp, Oryza sativa
acagctattgcttatattaccataaatgcaattgtattttgtatacaattatattgatcaatttccgttataatatggactcgtcgtgattactaacatagatatttctcttcccccccccctgaataatgtcgtaattttgaggcctcgaagcaaaaatgatggctacttttggccttctcttcagaatactataatagatgccttacttgcatatgggcaaaaattcttggcaactaagcatgcaatctctcgtggatcatcttatttggtaagagttggttagcataaggagcttgctatagttcaaatggcctaaaagaattgattaatttgtttcaaaggaaggcatggctggatttcagtggtggcataaattctccatgttgatctgggtgattgcaaggatgattaacggcatgactattgtttttgttgcaagcgacggatcctttttatagcacatcatttgcatacatcagtttcccatgactacagtacagcaacgaagtttggtaatcccaacagtgttacagcatatggttctcagacctagtagctgctttgtgggtgcaagtgtcagacttcatgtttgagatcagtccaagctgagt

SEQ ID NO: 59045 - DNA, 4463 bp, Oryza sativa
cgccgccgtcttcctccgctccggtcgccgttcccgtcgtcgccgtcgacccggggtgagccgtagaccgccgtttcgcttcccccttccctcccctctctcgggcgccgctccgccgcgccggtggtcaccggcggcgaccatcggggtgcgggtgcgccgcctcccgtcggctgtgccggcgtggccgccttcgggcgcgtcccgcggctgccatgtggggcccggccgtcagccgcccacgccctcgggtgcggctgacgcgtggggcccacggcgccggccggtgtgagccgcgtgcacccggtccaccgtggaccgtgaggctgccgcgtgggccccactcccgtggacccggtccgcgcgccctctcccctcggctgacgcaataaatccgattttaaattaaaatttaaatgaagaaattcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattccgcgttatcactgttttatttagccatgcctatttacctttgttatgaccttattattattgttattgttattattaccttgttcaccctagaaccaacaaaaccccaactagtggacactctactaatggtaccactagtatgatttaaggtagatgcttcgctttaattaggtaacattaggtggttttataactctagactttgggaatattcatatcacctggacactttggaatggtttggttattgtggaattggcttcacaccgctccttcttttcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgggctgcggttcggtagtcgagatgtcatggcacagggccggtgtcctgctgctaggggctcagtcctgcctacctgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaagtaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacctagaagaggagttcctagaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtggtttttcttttgttttgtttgtagatggccggcagcgtcagccgtcgtggtctggacatgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgactacgccatcttccgggatgctagctcggaggatgacgctaccatcatgcacctggcgcgcatggtggaggcgtacgacgcggctcgtatcgacttccatcagatggtgcgccgtgggatggtcgggaacaacatgaagatcctggagctgcgtcaagagaatctgcagctcaagaaggacctagacgcagtggaggcgcagctgcatcagctcaagatcgcccagggagaggtctgccaccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtgctggcccgtcgcagcggtagacgaggagttagtaggcttgcgcgtgtgttctttctcgtttgtcttcttgttgggttgtgtggggcatggttatgccggtgtgtggtataactgtgtcggagcctatctttattttatttgcctaagcaacttgaactttaatgaaccaatttaatagcagtaataaattcaagaattatggtagtcgtgggtggttagctttaattgttagctctctctgtttgctggttctgtgtggggttttcagatggtgacgaccaggagaaatgctaacaccggtgatggcaaccaacctgaaggcagcaaccaccaccaccagggcagcccacctccacctcctcctccgcctccaccaccaccaccagataccaacgccattctcacccaaatcctcgcccagcaggccaacatgatgactgctttcctccaccacatccaaaatccgccacaacataatgctccaccaccacccccacaacactctaaactcgccgagttcctccgcatccgcccacctaccttctctagctccaacaaccccatggatgcgttggattggttgcatgccgtggggaaaaagctagacactgtgcagtgcagcggagctcaattcctaaatgatacaaagaacagttcagtaattatttgatcaataatgatctaattataattgttaagtgcttttatcgtttaaaatccttaaattataaattgttgtttaaaaggaattattagaaatgattttaaaagcttaaaagagaagatctaagtttaatttgctaaatctcaatataaaattgggctagataaaattttattaaatactttgcttgttcctctattttctagaattttctgggaattgtttgagcaagggaagtatttttaataattgaaacaacatttcaccatttattttaattaaaaagttccaaaacccctccctaaagttgttgggccgtttccggcccaactcttctcttcccgcgcgcggccaagccggcccaagtcggcccagccgagccgccccgccccctccttctctagccaccgacatgtggggcccacatgtcggggtcatccctaacctccagccggccggccgcctagccgagcccgagctgccgcctctttccgccaatttcgcctcttccggtcgccctcgagtccgattagttgaggggtttttatccccacatcctcctctatctttcccctcagaatcggagctattcgttgagtattttggccgaat

SEQ ID NO: 59046 - DNA, 4983 bp, Oryza sativa
attttaaaagagaagtttctaccgtatattaaaaaagaaaaaatgcacgagaaaataaaaacggtttaaaaaaacgcgtgaggaaaaaatgtcaaaaaaaagcgcaaaagaaaatgcgctagaaaaaatttctgtaatccgtaaaaaaacacgtgagaaaaaatatttccatcgtatgtaaaaaaagcaaaaaaaaaataaaaagcatacgaggaaaaaactgttagaaaaaaacgctaaattgatggacacttggtcggataggatccagtgtttttttcatctcctacacgacttgtgtttcgtcaatctattctcctatattggagaccttgcacatctttgtaggcaattattagactatttttgtgaagtgtagctattattcttgataacatattatatggaaataatattagaaaataaacatattttaattgttatttaaagaagagtgtacaatgactctattttgtgtatacttgaccatacgaggcagcgtaggatttgattggttgcaagaatgagattaaaagaatattttagattatatgcatgttgtcatatgaataatccaattattttaggtaaagcaaacatcgtaagattgccatcatcgaggttgggccattacatttaagatgttccaattttctgattgtcatcgacatggttatgcatgaaaaacgtatattatcattatgtttttttttacccgttgcaacgcacgggcatgcttgctagttacttgaaaaatacaaggttttaatcgatcgatgcagtacatattattgggatccacttaatattattcggagttgcttttagcaagaggatagtcagaccttgattacatcgaatctgcttgtatttttggatctgatggccatcatcaaatgagattttctaaataccttaacatgatggaatttattcaattagcagcgagcaattaggatagttgagattgattttttttacttaaaaccgagtgttaaattatgttctatttctaaattaccctttaagagattcccaagcaccttaagaagtactccctccgtttcgaaatatttgacaccgttgactttttagcacatgtttaaccgtttgttttattcaaaaacttttgtgaaatatgtaaaattatatgtctacataaaaatatatttaacaatgaatcaaatgataggaaaagaattaataattacttaaattttttgaataagacgaacggttaaacatgtgctaaaaagtcaagggcctcaaacatttcgaaacggagggagtatctcgtataattcccaagcaccgtaagctgaaaaaacttatagttctttataacagtaaaaaaatattcctttcaaatttgtttgcccaaaagacaacttttttctcatgattatgttgagtcattgcatcggttcaataaaaaactttatagtcttcaatagaaagttttctggaaaaaaatttatgttcaactattttagtaccccaaaaggtttttctatcacaggttaaaatttcttttactctttatgtgaaaattaaaagttttgcaactcactgtatttcggtaaatactgccatccagggtacaacccttctttttctgaatcttaagcgtaaaaataagaggaaaactcctttgttctgtcagaaatgtatagccaaataaaagatcaaaacgtttcttgatacctcatcccattttcttggtatattaccaagaagccggcttgctgccaaccgttggcctcgtcagctgatgtcttctccatgcgtctctgacgttgtgttcgtccgtaatgctgcatacttccttcagataattaaattgctaagtttttccccttctatcaactactccttccgtccagaatataaggatttttggggttaaacataagtattaagaaaataggtagaattaaatgggagaaggttgtaattggttaagaagtggaggtatgtgagaaaatttagtgatggaggattgtgattaattgagaaggagaatgctggtgacggaattattatatttttgggacaaaccttgagaactatatgttattattatgtctacgagtatcatctagccgcatcatgcatcacctttggattcagacatccagtccatctataaacaaaccatttgatgtgtacaagatgacgtttgacacttttttttacatcaagcacaaactcgtagacatcttaacctaatcggcgtcacttgacattaacataaagaatcctcgagcatatggctcattagttaattcgtatatttctccatataggccaagagcccaagacacaattgtaaactatactagaatagccttggttaatttaatctcagcatttttaactcttcagaaacagtgacagatcgatgatgaaatgaacaataaaacattacattgatgttgcaaggagcctgtagggtcaactcttgttacgacagattgatgtgcagatgaattatatatatgcacatatagtagcatcttcctcctcttcttctaccctctgtccattgtatctgcaattctgcattaagcttgaaagacagtaggtacagagctgtctctgtagctactagatagtcatcctcttgttgaacttcagtactgaaaacaagatctgaatttgtatttgtttcccaggttagattcttctgtgtttctgaagctgttttgtttttgcatgtggcttcactttttcttgtgttgatgccagcaatgcctttctccattttgttttaggttccatctatcactttatgcagtgaaagtttgtaactacaggaaattaagggcgtggtttgtataaaatgggctgtgtatcatcaaagcagttcaaaagagctgcacaacatgaggatcctgctattctggccaaagagactacatgtaggatttgattcactggatacaccatggaaaaatatttacaggttctcttttggaaaaaccctgaataataataattgtaatttattgctattcttcttgcagtttcagtgagtgaagtggaggccctctttgagctgttcaagaagataagccattccatattcagagatggtctcattcacaaggtacttgcttaaaaaatctgctcaaacttgtgagattgaccatgtagctctgaaattctgatgaaaaatatgtcaattgcaaacggccctttccatgtacaggaggagttccagctagctctcttcaggaacagcaacaagaagaaccttttcgccaatcgggtcagtagcagtgatacccagtccatttcatcagtggattttatttcaacatatagaccatgatgtattggtgcaaaaaggcattatctgaagaagcacagttctacatatgtttggctgaattgtagaacctgttcttatgtgaaaatgctgacagtgtttcaccacaagtgcagatatttgatctctttgatctgaagcgcaacggtgttatcgatttcggggagttcgttcgatccctcagcatttttcacccggaaacgcctttgggagacaagattgcctgtaaggagttccagctctttctcattatatatggtcaatttaaccatcttgattttgttttctttaataactaccttctgtttatgccattttggtatttgacagtattcttttttgtagttgcatttaggttgtatgacctgagaggaactggatgcattgaacgtgaagaggtatgcattttagaaattagaattacttatcatctttttagttccataaatcaaacatgctacccatatactgtgtagaaatgattcaacatatagtaatttccatgcattaatagtctacagaactgatggtgacggtacacatctataccatcaaagaaacataaatggtgtgtttccaaatatttgttgaatccagttgatatttaatttaaataaatccttacatatccataagaagcctcaattcaaactggctgagtgtgaaaaactggaaatttgtatgtgtaccgttggaaaataatatgcataccgtcttaccgttttaactgacagtcctggagttactgaaactatttttctttcttatgaatcaagcagttgcacgaaatggtgcttgctcttctgaatgaatcagatctattcctatctgaagaagctgtagaacaaatcgtggatcaggttaagtgcattcagattaaatactaccttcagtttttctatttcccaggcattttttagcagatttcagttcatttctttcacaaagttgccactgctttcatgaataaatcatatcattaacctttatgctaacttgagcttttacagacgttcaagcaagcagacttaaacgatgacgggaagatcgaccccgatgaatggaaaacgtttgcgagtaaaaacccggctttgctgaagaacatgactcttccatacctaaagtaagtctgtctacaagtttcaggtttcactccaattacgttttactgttttacatcactttatcactaaatataggggctgttcagtttgttaccattttcaaccatatcaaatttagcattgtcaaattttggcaaggtagcagtctaagtacatcccaaatactccaccataccttaccatgccaaaattttggtgattttctagaaacctctcgacataacactatacaagaatatttagcatagtaacaaaccaaacaacacccacacacttttctaccctaccaaacttggccaaattttggtattgccaaaatttggaagggttaattttggcatcaaagtgaacaaacccataaaatttgtaattctgatgcctaaattgttcactttgtgttcagggacataaccatggtattccccagctttattctgaactctgaagtttgtgaggaagagttgtaacatccatggtaccctctgtgctccatttatattcctcacaaaggggcatgactacatgggg

SEQ ID NO: 59047 - DNA, 549 bp, Oryza sativa
ttctctttatctcggagacattggatgtatgcatccatgacatgaatttgaggttagttcagttacattacaaatatagttataaaaggaaagtaggtttgttaaataggcgaacttacatcatcattcaagtattctggttcaattagtactttcattgatttccgattaaccttcacttcttcaatatgcaccatcactttgttatcctttgtcttattaatgtaggtaatgaaagggtcttcttttttagtcaactcttcaaatgtcgtacaaatttttaatatgtaaacatagaatctataatagatttatacaaaagtacaatgtttattacctttagaattttttatcggtgtctggcctattcgctttcttttcttttgaccacgtaaggcgttctttggtgggcttttgtgtattttttttagtaagatcatccttatcgatgtatactacaaaagggtaagtcaaatcagtaacacacaaacataaaatagaagtaataaaatttaggatgatgtagagagttcacacattcagatattt

SEQ ID NO: 59048 - DNA, 8771 bp, Oryza sativa
gggagggggtgggaatgagtcctagggttaggttttgggtgtagttatttaggttaggattaatctgtaccgtccattcgatcggacggctctagctgctcccgcgttaggccgccgaatagaccgtgtggtcgatttcaggaggatgcaaaatgaacttcaacagagaaaggaaacaaggcagatacataaaatagacgtaagggtttagaatataagctttctatattcagcccaaacctgaaagggaggatgttgattccttttccaattaaataattgttaaatgaggtttgtattattaaaattagcaattaagctctgaaatttctaataaaattacaaagaacgtaactaaacatgaagaatttaataataaaattaaatttaacctgttattttatttctcacacttgctttacttaaattgattttttacacaagggagggaatataaactttctacacaatgtaaatttttcttaactttccctcaaatttctggtctgtacacttcctgttgcaacgcacgtgcacttttaatagataatgtatgaatcggtaaaaaaatgaagagcaatactccctgcgtgttgcaatactcgagcgaggaagctagcatcggcggcaagtagcaatttccacgacaggttgacaggcaactttcaggcacacaccggcgacgcgctaggcgtggataactggacacaccctcatctctcccgatttataatcatctgtaggtagtcccggtaacaaaccgagagagggaattcggcactaaagatgacaatctttggcccagattcaaatacccagaagtaaagaaatatctttagtccactaaccggaactaaagggggttgcgccacgtgactggcacaaccatctttagtccactaaagattttttttcttttcctttatcattgtttattctgtttgaatattgatttcaaaccaaactcaactataaaaacatcctcattcacaaaatcatccacaaatcaacaataaaatcatccacattcacacaaacacctcaaaatcacccacaaatttacatcacaaaatcatacaaaaaacatctaaaaatccccaaatttacaacacaaaaacatctaaaagaatccccaaatttattcccgcagccccactgggcgctgccgcccacagtcgtgatggccacggcgccgccagccgcagcccaccgcgccgggcggtgccgcctgccaccgacggcgcgcctaccgccgcccgccgcaccaggtgctgccgcctgccgccgacggctgccgtgtcctctcgcatccggtcgcctgccggcaacagccgacaaagaggggaggggaggaggaggaggagtaggagggacgaggagaagaggataagaagataggagaaggatgagcactagtaggcgataaggttgagggatacacacacacacacacatatatatatatatatatatatatatatatatatatatatatatatatatatatatatatatatatatatatatatatatatattggcctctacgcacgtttttttctctctctcccccgcgcgagtttttttaatgtttagtcccagttggtataagtactaaccgatgctaaacatactagggtgcatgccacggcctgacactaaatgaactgggactaaagatgatctttatcccatgtttagtcccggtcgagactaaagaccatctagttttaaactgggactaaaaataatttttagacctgatttttgggtgaaccaggattattgtggtttttgggtaacccacgaaagatagtttctccagtagtgtccctcgctcgcttgcgcgcacacacgcatgcacacgccggacacattatggttcgttctgatctcgctcgcctcccggtcatcactcctacagaagaagagcgtcaccgccgcagcctcagcctctcctaaatctcgtgccgccctgctgctgccgagaaggggacagagagaggacgtagggaaggaagaagcgagagatgatgacacatggatctcactgtacttttttatttttgtgatgaatatattatcacgtggatgttgtatcagcgaaaaccactcgtaaaaactgccgagggagctactatgcatggttttagtgattgaagaaattgttatacctgatttgattttacagttaagagatacgaatcagatccgacctatgttgagagactctaaaagaactttttcctatggttcagtgtcattaggccggcccatattcagcccaaactagctgtgagaacacatagactgaaaaggaataaattcaccggaggtccctcaacttaacagcgagattttttgagatcccttaaccacaaaaccagaaatctccacccctaaactatactaaaccgttcactcaaggtccctaggaagtatatatggatagtttcgctgacgtggcatcctagtcagcaaaaaaaaatttaaaaaagtatatgggacccacatgtcagctgcacttttttttttcgccttctcttttcttttctctcttccctcttctgttcttcagtgagggagaccggcggcgatggcgacgtgcttccgctatgcgccgtccgcggcggcggtgtccggccccgcggggcccagcctggtggggcccatgtgggccccacatgttatctccctcaccacgccgcagcatgccgacgaaggaggagctgaaggcgctcctgtcagcgctgggctattctgcgggcgactgccgaccaacgccgccttccgccagtgctctagctgaaggtgcacacagcgcagcgtcgacgacttcggccagtctccggcgttcatcgcgtcagcgttcgaggagcaagggcagcgcggcgtcgatgatggctcgctggacgcgaccgtggcgggagcgcgattctcctcaactcctcaaggaggccatccatgtcgtcagctacgcgttcgaggggcagacgagatgggccaaagaggtcgcagcctcgccgatgatcacttcgccttctgctcccatggatcacaggaaaaatttgagaaactaccaatgtttcaattaaccatgatagatttatgctagaaattaaaattgagtatttcatgtttcgtttctttcttccatcgagaaaagctgctgctgcccccacacgtgagtgtgctgtgagcgtgggtcatgctagctgttgtctgctgccgatcgacttatgttccagtcgccaaatgcaggctcaccggaaggttcggcgccgtggaagccctcaacgtcagctagctgccgtcgctactcgctcgatgagaaacttaatttacacgaatacacaacgtacacaaacgggggagtgatgggccagtgggagtgcgctgggacggggtacgctacgtactcgcggttgcggccgccggccggcacgaggcatgcctcgccctaccgagcgctccgtcgctggtcgtcggcgtactgctcgccggcgaggccggcattcaggagctacacgcgggccagccccacggacgtcctcgcgggggcgtcgcggcgagcggtggcggccatggagatcctgctgagccggcggcacaccccgtctggaccggctggggcggcaggcgcctcggactcctgtagctgctgggctacgtgacccgcgtcgcctacccgcttgcctccctcccgctcaccgtctactgtgcgctcccggccgtctgcctcctcaccggcaagtccacgttccccagcgacgtgagctactacgatggtgtcctcatcctgctctcttctccgtggccgcgtcggtcgtgctcgggctgaggtggagccgcgtgccgctgcgggcgtggtggtcggacgagaaactctggacgcacgctctccagccggcagcgacgacgaggactccggcggcaacggcggatctcgtgtcccgcggtcgaggcagggacgggagcagcagcagggagaagagagaagaaaatataagaaaataagatatgcagttgacatgtgggctccacgtgttttgtttaaatttttttttgctgactaggatgccacgtcagcgaaatcatccatatatactgcctagggaccttgagtgaacggttttgtatagtttagggatagagatttctggttttgtggttaagggaccttaaaaaatctcgctgttaagttgagggacctcgggtgaacttattccgactgaaaaacagggaaactgggccggaaagtgtttatccgtcgatttgacccagtaaatattactagcatccaaaaacccatttagcgcctacatccctgctagtacagtttctccctcgatgcatctgatcatctgattagtatgcttacaaaagaattactacatcactagctactaattgagtagtactaatagatatatatatgatgaaagcgatgatgaccacagccgcatcaatcacttccgaacacagccaaactgtaactgtacctacatttatttgtcggacaagtagttctgactttttacatatagtgatccatacatatcacctgacagcatcagcggagattatgtgcattattgactctgcaataacagcaactaacgcatgacctactccctccgtcccagaaaaaacaatctaatattggctgggacattttataggaccatcttctctagctacaggccaagcacgcacacgaagaggcacgacgctcaggccatgtctagcagagcagcccatcggtgctcacgctgtagagatggaggccgttgagcgcgacgagggtgctccctggctggacacgctcctccagcatgtgtgcagcgcagagctcggtgtcctacctgcggagttccttcctgagcaaccatgatctcgtatcctccttcttcagccccgccgccccgttcaacaccgcaaaacatgcctccatctcggccgtggcggcgataagagcatcaggtcgcttcggcttcggatctggcgggagggacctaagtgtgtcgaagcggccggctgtcggggtcagcgttaaggggatctattgtgccgcgtggaggatcacttccacctccaccttgtcgccacaggagatagccgtcttctggccatagcggaatggagcggcagccatggcagtgacacggaggaagggatgggcgcaaggaagggatgggtgtggtttagcggatgaccaccatgtggattcgtcgccgtccacgaccatcagccagcatacctggagctcgctggccggccgtcctctggcgcaggctcgctacttggagatgaagatgactagtattgactgaggatgaagatgcctacgacaaaagtgtgacggagatgacagaaatcctgatggaatggtatggttctaattttagaagattgtagtggaatctactcaacttcacgagtagtactgtcatttttccaatatgtggcataaatcaaatcaaccctttagggtactgtagtagtggaatttatcggtttatttcaagacggagagagtaaggaggatttgttttccttgcacatgattttaagaccggtttatttgccagccacttgattctgctccaaacaagaatatgtatcctctacagtaccaagatcatatgcatgccaacggtggtggccatccgatccactattaacgtatcggatcaaatgcccaccgttacattacaaacagtgacaatgtacagtaaatctcaagaaactattgctacactgtgatgggtacagtaacaaaatggtacagtaatcctgttcaggcaggcatcgatccatggatggctaactgcgtcacagctcacaagacagcagctgctgcatatccttcagacacacaggtagctgaaacagtagtagtgaggttgatgatccaaaggacacattgctttctcctctctgttctctgatttgcgacctgtcgactcttgatatagttaattagtttttgtcatagtacaaggccaggtgatgaacatttccctgtctatagccctgaagtatgagaggatgaacagtagtgtgagttggaaacagatggtaggagtacgtacgtatatatagctgtgttctgcgctacgtacagtaccatttccgaatattcaattcacacagctaatgtactacagtactacgatctatttatatatgatatcttgcgatttccagttattgtctgacactgtttcatgtgatgtgttgtttctcaacgtcaaagaaaccgcatctagcttgtctccctcctctttgggaggaattacttcttgttatagttatatgtattctctctgtccacaagtcaagaaattctatttttccaatattacccatacaaaaatactatttttccattagtgagatagaaacgagcctaacttggttatttaaacaagagagtaaaaacataagctcagctatcagctcgtttcttggctcaagctggcacgcaagctagcctcccaacaatgattatcggagaggtgatggatgacaatagaacgacgacgtgagcgaccgaggtagacatagacgtaggatttcaagatggatcattaaagagtgcaagaataataataaaaaaaaagttgcgagtcaagaccaacaagataacaagaggaagtagatcttccaacttaatgtactcttattttgagtggctaatatttgagctccacagcttattggttctcagtgactcacgtcagagggcagtacgtcagaagatccctctccggtggcaaggccgccaggcaccattcacgtcatgctgtatctcctgatgcggcaaacccgtgacttgcaggccatgtccatttaggaaaataggcaaactactgggttacaggggaatgagggttagtttttttttccttcctagcgcttcagcttgtcatttggccaaactaatgggccataccattagctccggctcacctcattttaaaaacgagctgtggatgaggcttgggcttcattagttaggctctcgagtcgaaccgagcccgtgcgaccccgatccaagcccgagtaatatatttttccacccatagtgagaagcactttggtgttttttttcctctttactacaattaattaactattttatgatatgttaataagaagggttgattttggacagagcaagtatgtataataatctagtcaaaattttcctcttctggtatttgctaaggagagaaaggttatacctgcacattttgtcagccctagcctttggtttgggttccatttattgcgagctagctagaacacggggagttaactattttttttttgacatcggagttaactaatttcactgcaccatgcatgttataagagtaccggtattcaccaatttaatggtgtacacatgtatgcgcgcgctaatatatgcttcgtagcagcttgatggaaccaacattatggaagtatgttcatcagaggacagaggatgtatacatatgtttgcgcttatagattgtttaattatcatttctaatgcaacagattatatagatttataccaccatccaaatgattagtaatagaatatatagtgatattgaaactcataaatcaatggctgatatcacttttaatagtgatagaactaatagtagaatactaccagtagaccgccaatagatttataccaccacccaaatgattagtaatagaatatatagtgatattgaaactcataaatcaacggctgagatcacttttaatagtgatagaactaatagtagaatactaccagtagaccgccataagatactcgatcaaacttctaaattatcgtaagtagaagacatattgtgttttatgtgaaaaaggatgaaataagctaaaattaaaaacaaaataaatggccctataatatcttacaagttgtttaagaggttagttgtcaaacatggtaggtaagtaatatacagttacgattgcccgctgttaatcaaaaaataatcactacctcctcttttcctcttaagtatcatgccaacctcaataaatatatatgaatcctaaggacatgtataatggtgatgaacagtagactctcaacttggctaattaggaatattcactgacatggaaaagaaagaaagagaagagacaaaatatcattggtattgtccaagaggctgtactaggctctatcattgtacatgtccaaagctatgtctaccatagtaccatcattaaatttgactgaaatgtttacagatttctccaagtatgacatgccatttatctccacatatgacatgctatatattgccaaattttaattaacatgagagtatatcacagctgtcctaataataactgcagaaacatttttgtcatatcaatatgataccatacagtaaaaaaacatagggctccttcccccctacaaacaaccaaatgaacaacacaacaattaatacttgatacgatataaaacagtgcaataaaaccccacgaaacagtaacgccaacttggttgatcctcaaacagcaatggacgttccaagcttgttcacgtcgccggagttggcggcctccatcgccaccgcggcggcggcggcggcgtcgccacggcggccggcgagcgcctcctgcaccctacgcgccatgccgtcgatcccgtcctgcagccgcgcggcgagcgcctccttggccgtgccggccacgggctcgcactcgaactcccaccggagctcgcacccgccggcggcg

SEQ ID NO: 59049 - DNA, 11144 bp, Oryza sativa
tcatgctttactgagaagacgatggttttggtggatcagaagagaggacaatgaatggaaattggagatccagaggagattgggatggatgattttggagagcaaaatggacgattgggaagcaatcaagtcaccattgacaaaatcaggtcacatccggcctttcgaattaacgcgaatttatgggatcgagctctagttctattagaccgacttcacactactgctttattgaggtcaccacctacgccgtcgttcatctggttctaacacatcttctaatgacatgcaagagggaaagaggcaagaatgggacaaggtagatggagatgatgccatcaatcggctctccctatgaaaagaggaaaggaacttaggacaaagttagatagagaaaagttctccatgacaaaaggtaggacaggtggtcagagagaatgtgtaaggagggagaagcggtggcaatagggggtcatcgctggttgtggcaaagaaagatggggatctacggagaaagaaagcatggaggagaggaaaaagatgtttagagtagctgacagtgggtccttctcatgaggttaatcctttttcttttgccatagtaggatttaaaatatataaaaaaaataaactatgggtggtgtggtctatttatgaccacacaaagatgtcggtttttagatttagaagtgacatatgccaattaattaatatatcaaggttagatagatttaaccatacggtcttgtctgagatgcgctagtttttgttaataatatcttgcacgaattatatatatcatacgttggaactttgtatgagtttcatgtgagttacgaatggtactcatgtgtgaacgggtgttacgtgtgttcatcttctatgtgaccgtaaaaggtttttcgatatagtccatcagaactgataataaatgtcatgtgcataatttgattaggggatttaattaaaccgaaatttgcaccatcaaatttctgctgcatgaattgcatgtgttactctccttctcaaacaaccattgaatggactatgtgtctctaacaaaaagttggattgtggcttgagaccttgggttaaggttcatgatcgaagttttatagaattaattattatagtgataccagatagggttcagagggatccaaaagtggtagcatgagtatggtagttggctcttggctgtgggggtggtaactgataagagggagacaattaaggaacaaaaattttacaaggcaatgagagcatgcacatcgacccatggggtataggagcctcctgaatcctgatacagatgaggatgttagatggggtgactcagctagactgatcctcaccggagacaggtcagtgaggcagcaccatgtgcgaaaggctatatacacataattcctacaaaagtacaattgtagttaatttcagaatcactatattgataaaatcgaaagtaaattaaaaaatatcaagacaggttctttctgcttcgtaatacaagacatgcatgtatatgtgtaattaactaacacatcttataaaattatttttttaaaccctccacactcaagatctctaattccataggatgcatatgcattgttttattaggattgttcaaacgaggaactgataataattctttcttatcattacattaatgatagttacgcattatatgttggaatagatggagtacaaatttcgaagctactttaaactaaatttatttattatgatcttaatttagaatcaaacatcagaaaatagaattcacttgtatatgaatatttactcagcagattatatacaaaatttaaaaagcattaaatgcattatttatataaatatatgtaatatcactagcatgtacaaatgcacagattaatatctatgttaccatggttttcctttcagctaataagtcgttgtcaatatttaaattttaaaacgtattttcgtagttgattttagtttttcatcataatttattttactgaattactaagtacacaggttttccgtcaaaattatattttcgaccccctttgattcaaagaaatttcatatgaattttaaaggatttcattcctataggaaattttttctatatagcactttgtatcaaaggaatgaatcctatggaatgcctcttcccatgtaagttttggaggaaatttaacatgaggtaaaacctcatagaaagaattctttgagtctttatctctcctcaaatttggtgctatcaaatggtcatttatatgtttttcctgtgctttgcaatcctctgttttacacttgtattcctgtcagaatcctatcattttcctattcctctatttttttccttcctgtgattcaaagaggcccttattttttaataagcctttttacgggttatcctcagctgtgagctagatggtcaagttccttatcttaaatagtatataatatcttcaaagaaagtgctatagttgttagcatgattacatacagaagttttgtctccatcctaaaatatatgagaccaagcatgcatctctaacatactacataaatcagactttccaaacacctatatagccagctctgcaactgatttgtcaagccaaacctatggttcattctaacagactctccatttcgaatctatgacaccaggacccatttgttagcttatactactctcttcttcttccttctctttctccctccctttctatcttccctggggcgggaggcgacaataggaacacatggcggcaagggcgaggtggggactgaaggtggcggcaagggcatggcgggcaatggcgatagagcaacgggggatgggagccacgccaatgacacggggtggcagcggccaccgtggatggtggcgagtctttggtgatgctgccaagggaagaattaggggaggaggaggaggtggtagcggatggtgaaggctagcagctctgcgacgacttcagccagtggcgaccatcgatgggagaggcacgtgggcggtgctgctgctcctcgccgttgcgttggatgggtaggtagtggggggactcgcggtggcgatggaaattggcacatggaggagctgtgccaaggagaaggagcgactgaaataccatcaagtaaccgccgctgtgcccctctccatcgatctgagtcctggcccgtcgtgacgacgagacagtgcagaagagggaagagaaggtgggaatcacctttggcaagccaagaaggctggctagatttagccaatcggagagttgattcagacagcaaggtggcttggatagccagatagcaagttttttggagtgtgctttttctcttcactctccaaattttagcttggagagtcaaatagccattttcttggaaatgctcttagaatgcaaagtgaaacctcataagcttaaatgattactatatgaaaatattagaaatcagagtaaattttacaaaactatatgtattttgatcaaattattgaaaaactacatatttaacgcgttgtattacaaaactacagatttaaggctaagtatcacaaaactgaatatttagtattgaagttatcacaaaactatagcttttagagttcatatccctagcactattgtaatatgtttgagctataaagattattgttttgtgactaaattggttataaaacatgtagttttgtgataatttagtaactaattaaacatgtagttttatgacacttcatcttaaatgtataattttgtgataaatttgttgttaaatatatagttttgtgctgcatcgagttaaatctgtagtcgtgcgatggtttggtcatactatatgtagttttgtgaaatttattctagaaattaatatgtaaaaatgatattaatataattataatgaaaatactttctatagttatttttaataattattaaataaataaatagaaaagtaatgacataacatgcgcagtggggatattgtattagacattcacaacgtcaagtaaaaagatatagagcgatgtagtatttcaagaatgtattttgttctcttagcaagttaattatctatgagatattcaatatatataacacaagttaaaattaaggcttttgtgttctctcagttaaaatacacaataggacaaaagctgaccaaacagatcccggagtgggccacgggcgatctcacaatcagtcccaagttactagctgtggaccttgaatcaacacatggcctggatcggagcttacaaaagtcaggattactatttgatgggtcaagaactgaagatgcatggcaaccgggaccagccgattccatttcagggctagctcacttttgtgcgctcccaacctcttacatatcgatgctggacctggtaggggccgggtggtaggcctacatatattgcttgtctaattgaaattaagtttccaaaattttgggtttacttgtttgtcccggtaggatatgatgttcttcaggtgaaaattttaatattctttaattcagcaaaatttattaggaaaaccactcatttatttatttatttatcctacattttgtaattttctttctcaaaattatattaccgcattccgaaatggtgaaccacactagcaagtctagttaagcattcgatgttagagtcacgatatagcttacgtatgacctagaaaagtattaaacgggaatgcaggaggtgtcaaacagcagaggtacgaatggccgcataatatatcacacagttagggggccggtgtttttggttgccagtcacattttgccacaatttgccatgcctaatgttaggtacgtttgccaacatgggcagtttttcgtttgcgatgtgcgtgctacctattgatttgtcgcggtgcggtgtagtgccaactgagggttgagggttaaggggggaggctcactaatgagctggctgaactgccatggtgtaggaggaattgcgactcgggacatggtagtgggtagtgtctatgattgatcacatactcacattagtgtttggtacgtgtaggtaagcctgagctctcgatctcgatctaaagaacagtaaatgaattttggctaattttatgaacacatcaacatcataattgataaaaaagaaatatctgttttgagaataaaacaaagaaaggttaattagatcgttctccaacatgtagaaattctctttagtgagaccaaatctgctataggatcttatctgatgggtctatggtggttacaggcaggcaaattaaagcaaggtgtcatgggtgcttgctgcaccaggcatgctgcctgcaggctttagggttgtgtgtgatcagtttagccagagccaccatatataacactggaccccggccccaacctatcacgtcattagcaatattgcttgcatacaggattcctcccattaatcatgaaataatgcatgctgcaatggtcggggccatcctaaaccctagctgtgtctctgcgtcgtcgtcagattggctcgacatataactgatctcttccataattcatgtgctatgtaccaggcactgtccctcacctttgattcctgatgagtcaatcggtcgatcagtcgaaggtgtgtaacagtgatcaccatgcatccatggcccctcacattccggccatgagtgacaaggccagacaatatggctagcatggtcacaggttttgatacctagcgatagcaggaccatccccttcgcgaggtcgacggcgatcgatggattggtcgttaaataggcaaaaatgtggacatcttcaccaatagtgaaaaccggcaaatgtcacacctatggctaaggctagatgtgacaattttcccactggggccagtccccggcggataccaaccccaacggggtcatggtcgggtgggatttccctcccatagtgagcgggagtagggcctcataaatttgtggggtggggacgggggagagaattcacccacgggtgatccggcggggccccaaggtttgggctctcagtaaaatatagctaagttcaaggtccatctaacccatttcaatggagggatatataaactccaggatggagcactggtagcacagatctgtgatacgccggtagcctgcgcaagtgagtacactggtggagaaaccatctttcctcccggttggtaacccccctttagtcccggttttccaaccgggaatagcaatccgggactaaagatttctatctttagtcccgggtgaaataaccaggactaaagatggaaagatccatctttagtcccggttggtaacaccaaccgggactaaagagagggatctttagtcccggtcgttgttactaaccgggagtaaagagagaatagcggcggtaccaaatggtccccttttcttttttttcctttttattttctcccgaatcaagtggcatgcaaattcccaaatcaaactctaaatcccaaatcagagtaacatcccaaattcacatcacaaaacttagagttacacacaaatcaaatacatcataaatcctaaaaaattacacacaaatcaaatacatcacagatcctaaaaaattacacacaaataaaatacatcacggatccatacaataaatcacaaatttatacatctcagggaatcacaaattatatataaaaaatcacaaagccgctcgccacggccgctgcctgcggccccgctgccgccggccgatgggcacggccccgccacccgccgcccgccacggccgccgcatatggccgccgcgcacagtgccaccgcctgcagtggccccgccgcccgccacggccccaccacccgccacggccgctgccgcccaccgccgtgcacggcgccgccggccgccgccccaccggatgggaaggggaggagggggaggagaagaggaaggggaggaggtggaagagatggaggagaggggatgaggaagagaggataaatgtgagttgagatctgtgtgagaggagaggaggagaaggggaggagattcgatctgtgtgagttgagaggataagtgataggaattatatactacgcgttcaattttagtagatgatctttactcccagttggtaggaccaaccgtgactaaagtggtaatctttagtctcggttggtagtatcaaccgggactaaagatccacggcaccctgacatgcctctgacaggggatgaaccgggaccaaagatcaaaatttttttaaccaggactaaaaagactaaaaattatttttagtcccgatttttaatggaactgggactattgtggaatttggttgaccgaccaaagatggtttctccaccagtggtattattaagttatgctactgctgtagggttgtgattcatgtctgattgttactcgattaatttatggctgctagttctcggttatgttaatagattttctacattctaaacaggaatttgatcatgtcatggtttgataaatttcgatggctgatggcaccaacaattaaggttgaggaaatctgccaatagaatgcatgcttaaaagttaaatcaccaaggtatgaccatcttgactttactgttgtttgccttttgattatcatacaaggttaaatattctggtgtaatgtaatgcattcttagttcagaaaaaaaaagttagaagtgcttattcactcagaacgtttatgaagcaagtttttcaaatgtgtgtccaatccctacatttgaactttttctgtccacagtcaaaactgtagaaattcctaaaacttcaaattgtactgctcagaaaccttacttggaaaataaccccaagatgtcaagcagtgttattcaacaatgttcattgctgcttttaattactttgggcataatctgacttgtcatgtgaattaatcgtatcagatagctatctaaatcaagtatagctggataagtcgtacatttttttagtaacctttttcagaggtcttataaaagcttgttgcaggacagtgatacattttatggagtattgttaaatctacagcatgacttgaagttggggagcagatgcaccgatatctgcgtggaaacttagcagatgtattccaattagtcaagaaaatgccttttgagaacttgtagcatgcatgtccagtgcatttgcactttaattttgatgtaccattcaattgtaaactattggttataaataatattattgacatttttccattgctacgttattttcttatttttgtccaatataattctagaaaaaaggataactttgtatatttatctaagatatataaagtatttgataaaaatgttataatgttacgtgaagttcaccaaaagtgcttttagcttaatagagacaaagtaaagcatgtctccaatgatgtagggatgatatttgcagcgtctcaacgggtgtctcatttctggtttagacgcttaaatcgtctctatggttttgagacggtccaagcaaagacgttcctatgacgcttttttttaaaggtgtctctataatcatgtggagatgatctaaaatgtctgtattgcataaataaagtgtctccccaaggttgttttgttgtacgttgccccagtctaccgtcactgcactttcaagtttgaggatgttgcagtggttgtctcatggatggatggatggtgaaggatgaatcgatgatgctggatgaaaatttagtgacactgtgattatgtcaatgtttgagaggatgttgcagtcactactacagaaatacataaaagagatggcactatagatactagaacaactaaaactaacacctatagcgcttttgccatccaaacgcgcacccacggggcaccaatggctagaattggcatctttgtggataaataggtgccggttttaaattggaacttgcaccacactttcctatcagataaaggtgtcgattccaactgaaaaccaacacatatcataaacttataggtcacaatttttaaaaagaaaatagacatttgacccaaccaagcagagacgagcccattcaccctgccatccttattggcgcacagcgggaggtccaggcgcgtggatccggcggcaacgggcacccttgacccttttcctccccttgcgctctctcgcgactaactctctctcggctcgagtggatctggaggcggcgaggcctcgcgcgcgtggattcggcgagggcggatgccctccttcgggtggatccaacagcggcgaacgccctcctcagcgaacaatggcggcggcgagcgcctcctcggcgagctacggcggctttccccaccaccaccaccgcacgttctcctctccctccgagttcttgatttcttcgctgagttggggatggttgattttgggattaagttgtggcttgttcgagatgttcttagtttttgttgaaaactgatactgttgcttctgggattcagttcttggctcgaagcatcgaataaaatcgagccgatacatcaagccgtttttttttgcattcttggaacctcaatggtgtgttcgaaaccggcacctttaatccctcctcttctgtgacacctgcaaaatgtcagccgggaaatacgatacttatgtgggattcccaaccaacacctatctatgtttctgtagaagtgagtagttgtcttaattatttatgtgattatttccatgtgtgatactatggtgagtccatgtgggctgtggctattgaaattttggtatattcttattcaggatatatgttgtgttgtttcaatagagtattaacttcaatcgtgtgctgcggggccccgctcaccctccaggtcctttgcagggttgaggaaggttttccacccggtggtcaatgtggggctggggacgggggtgttccaatgcaacccggctccgcccgcctcgccttgccctgttgccacccctaactaaggctaccctaggagcgtttagaaagcgaaggcctaacgtgaggttttctgctgagaggaatggagacctcagcctaagaggagagaaacgacataagtagaacacactgcaacaaaaatgagttttgccaggcaccgttcgactgcaaaagcgataaatgggtaaccgcatgtgcagtacgccacgggcgccctagtcaaagaccatcaatagacttattttcatatgtaagcgacttaagtgaccgtttgtgataacaattattggcatcaatcttctgatctatatactataatgaggtgcattttttttaataatgaaaacggtttagtctccttcctctaccattgggcttacacccaacaagtctttaaagtaaaaaaaggaaagggcaacaaggacaaaccacccacctcgttctaataaaagattagcgttttcaaaatcacattggtacataattttttttgatgtaaggtaatatgcaatttgaactgttataaaagatccttgactataaattcaaagtatatagcaccatcgcgtgcagtatcatattgttcctacgaaaacatcatacaccaaaataatgaggtgcatgttcaatagaaaatatttgattgctacgcatgcatacatatatatatatatatatatatatatatatatacatatatatatacatatatatatatatatacatatatatatatatatgtgtgtgtatatatatatatatgtgtgtgtatatacatatatacatatacatacacacagatatatatgtatatatatatacatatatatatacatgtatacatatacatacatacatacatatatacatatacatatacatatacatacatatatacatatacatatacatatacatacatatatatatatacatatatatacatatacatatacatatatatatatatatatatatatatatatatatatatatatatatatatacatatatatatatatatatatatatatattggcctcctacgcacgtttttttctctctctcccccgcgcgagtttttttaatgtttagtcccagttggtataagtactaaccgatgctaaacatactagggtgcatgccacggcctgacactaaatgaactgggactaaagatgatctttatcccatgtttagtcccggtcga

SEQ ID NO: 59050 - DNA, 11971 bp, Oryza sativa
  unsure (1)..(11971): unsure at all n locations
aaaaaaaaagtgcggacgggaagagggaggggtgcgggaggggggaggagggacgggagggggtgagggggtgtatctgtgagggagcgctttagctattgcgcaccctagacgtggtttagcgtgtccccatacatacatacatacgtacatacatacataacatacatatgtatgtacatatgtgtggatggatggaaaagcaaatgtgaaccaaggttcatttgcacctataatctaggacgttggtgtgttccaagatgtgtgcaagttaaatgtttcctagtatgcatttgtgaaggcttactatagtgacaaaggacatggatggtacataacatcactgtgcctcatggtcttattttgcagccttcctactttacccctgagccttaataatatcgatatgatatatatatatatatatatgtatatatatgtatatgtatatgtatatatatgtatatgtatatgtatatgtatatgtatatatgtatatatatgtatatgtatatgtatatgtatatatatgtacacacacacacgttgatcttttttaaatgaattgatgcatcgcaaaagtaataagaactcatgtgaaatcaagaccaccggtaaatatcatttgtggtgaaccaccgaaacataaacatcatacacttaggcaattaagagctaggagatgttattattggtattactttcaagtgatttgtactccctctatctacttttgatagtcatgacttaattatgtacaaggtaagtagttgtttgtatttcttgctgagaaaggagaaaaagttattctgttataaaagaagtcatttaattaattaattctcaattcacaaacccagcgttatgttagatgttactaactttgaaggagaagacattttcacacatttgaatacctatcctgattatcttgtactccctccgtttcaggttataagttgttttgactctaatcaaagtcaaactgcttcaaatttaccaagtttgtagaaaaaattagtaacatttcaacccaagacaaatttattatgaaaatatatttaataattgatttgataaaactaatttagtattgtaaatattaatatatttgtctataaacttactcaaacttgaaacaatttgactttgataaaagttaaaacgacttataacctaaaacggagggaccgggacataaatagccatgaaaaagtttgtaaaatattgtaacatagtacatcttatactagctctactacaatctctgtcccaatatataccagggattttggtaatacaaatatataggcagctaaaatctctaatatttttggacggaggtggtaactcttatattactttagagtggcaagtctgctttttcaagaaaaataaaaaaaaacaaatagccttttctatgctgttggtagccaatcgatttttttctcaaatcaaatttggagtctagatttataaacattgtcaaattatttgtattaaacttttttgcacaactgtcgttattggttgatatttcaagagtgagaaactattgatgtaaaaacacgaggcctgggagatgtgcttaactccagtgcaggttcaaaagccagcgtttaggtggatgagcgtgaccatgttgatgttgatcattctatcaccaagcatctcttactgtgtaacgtcggttaaatccataaacgatagccgatcggctagttgccgatgacgtatcatttatctttgagccgatgtcatatgttgatcgattggcagtaatgaataagtaagaaagaactaatctattcgatcggctgtagatattaacgatatataatccttatgtcgatatatacttaaatcaggtgattgggatagatcggtcgccatgccgagatagtataaatcacttaggtcgaaatatatattaacaacaagactatatatattcatagcatagccgatcagatagatatagcatgtatcggctaatactccgataccactctatattaagatatcaaaggcaagtagaatataccaaacaaaaagcctaatatacttaaatgcaacaagatcttaacataaatagcagatttaacatgtcaatcaagtatataagataaagataattaaatcaggtaagatcggctgaaaccccgatactaccctaatcggcaaccaaagacaggctagagattgagattctaatatcgactcataagatcaaactcaactgatgcaactataagtatgaaaagaaggacaatatctagataatcaagccgttggatgtttcatagagtggtagatatcttatataatctagttcaatgtcaatatataacctaaccggctgccttctagtaacagatgctagccaattaaaggttagatagcgatattgccgaagattatgtaagatatatgataactcgatgaatcacataaacaagattagagtatcatgaagatggaagcactaatcccgagaacgcaagccgccataacaagttttaccttttgttgaagattgaaaccgatgcagctcaacccgaaagcaagaactcgtcgaaacaaaataaaagtaaaaagggcggcgatgcgccgagattgtattgaacgtgtgttagtttgattacatggggctcggggtctatttatacccgagattacaaaatatgtccatatcggacacgactcttatctctaacaaactctaagataccataagtctttgcggcagacttttgcccaaacatatctctaaggaaataaaatatcctaactaatagatacaattgccttctcaggattctatccatgcgtggccatcctcatgaagctcattaacttaacccgacaacatattccttgtcatattgtcgaattcggcttgatcggctaaccctgtccaactcggactctgccgatcctggtcgcagccgattcggacttcagccgatcccactctgtttccggaacgatctccatctcgaactccgctttgattccttcttcatctccgatacttagattaccaaatttggtcgttaacggaaacacatgagatcatatatatgtgcctaaggtataaaaatccacatccagctgccattaggatgtaggtgaaaaacatgaaatcctaagtgcttcctctagtcataaatattggatatttaggtcaaacttttaaaactttgaaaattaattatatatgacaataagtttataaaacctaataacttataataggatgattgtactttgtcaagacccaacggtgaaatttttaaaaatttgatcaaactatatcttaaacgtcccatagggagtacatatatgatttgaggtgaataatataatgtacactacattggtcctaaaataactgccattctaaaggcgaagggatgaattaagaaaaatataaaataacctatatgcccctcattctaggtgaatggagatgagatgggacaactaattctctaggattacacttattttcaagcggaggtagtgctttaccaacatgagtatctgatctatttctcaagagaaatagatgcatggttggaaaagaaatagatatatatccctctattttgtagtgttataatataagatcggtcgcgcaaacacaaactgaactcaaccaacgccatatccacaaatcggatcaaataaagaacatatatatatacatatgtacgtagcaatgttcgcatagatagaagagagtaacaaatttgaggggattaaattaaactacataattacacatgaaacgatcaccagcaacacacacatatgatccttccgcgaaactcatcgactgatcgaacaaaaagaaaaaaaaaggagatccaagaacatcatcacatcacatatatataaatatataatcatcatcatcagcagcatgcatataaatacaactaatcgattaataattagccaatatataataataatgcatcacacacacatatatatatatatatatatatataatcgatccatccatgcattcaccgaccgaatcaatggattggacgaattgggaattggggaatttggatggacaatgatgtgatcaccatcatcatcatcgtcagttcatgttgcgggagcagcgggtaatggcggagcagccgcggcggtagggattcgccgcctgctgcgacgcgcagttctggtagtaggtctggcctcgcttgttgcacggcaccttgttcgcgtccagcgccgagtagctgacgtaccggttcgtcggcttcctcgccgccagcgcccgccggagcagcccgccgtcggcccccaccgccgctgagcactgccgccccagcctgccgccgcacgacgaggaggagatggcgccgaggtgggccgtggtgaccagctggctgtagccgaggccgccgccgctgtaggcctcggcaggcgacgcgcgcaggcaggagaccaccagcgtggccgccaccaccgccgcagccgccgccgccacgccgatgccgaggcgagccatgggatggattcacgccgaattccgaggtggtggggggctggggaggttggcgtttggagcaatttggggagggggttctttgagcggggtgggtgtctctctctctttcaagcgcgggaggaggagacgagcggcggtgagagaacgcgggggagacaaacgcggccattcgcacaagcctccacggacggtaaaatgcataccattagactcatctggtcagaaaaaaatcggacgtccaatctaatgtaggtgcatggctaagcagttcgttaagagtacaagggagcgtgcatgcaagcatgtttcaaaacttaaatgattttttctcttaaactgtttatccagatttcaatctaattatattactggattcgttacaattaaatctttataacaagatatcacatgactatattgcgacaacttttctttttactttttaaatgttgcacatattgttaatgaaatgttccaacaagtatttgttgatgtttcactagtgcatttgcaatgtttcatattatctttttatatgttttggcaaatactttttttatgtttcaacgataactataattcgatgtttcaagctaaatataaaaaatgcttcagtagttgggacataatgtttcatgtaataacgattactgttgcagtcaattgcatcactttttatatgttgcacagtttatgaagtgcgttgaaacatctccacaggtgatgaaacattatatatatatatatatatatatatatatatatatatatatatatatatatatatatatatatatatatatatatatatatagtgcaacataagtttgatttttccagaatgcacatatatattttcccaaaaaaaattggatggtccaatgttagttacagttgaccaacaagtgaaacattatgttatatatggtgaatctaaaaaatcagaaactgaaacatttaaatatttatgaaacatagtgaaaatacatgttgaaacatgtcgctataacataagaaacaacaagtattaacagactgaaacatatgtttttctttcatcaaaatataatcatgcgatatcttgttctaaagatttaattacagcgaatacaatggtgtgatctaaccatagattggatgcgcaatttagaagaaaaattattttaaagcttgctaaaatagatgcatgtatgcatggatgagatggagagaggagagagggtagtagcacatagttttagaaattttgtgaaacacaatgaagacacacattgaaacatatcgctatcatgtttgaacatttagttttgacggtttgaaacacatgttttttcttttgacataatataatcatatgatatatgttgtaaagatcgatttaattgcaacaaatacaatggtgtgatcggatcgtatatccgataagtaatttaggagaaaaaaatatttaaagataggagaaaaggagaagaaatagttacgcatgcatgtgacagtgactgacaggtgctgccatgtgtcagtggcatgctgccatacatgtaagaagccgtgtgtgtagtgcttgttgcctggcttggcgtccgatatttggtaggatatcggacgtccgagccatagcgctttcctcacggacgacctcgtgcgtgttgcttttttgcttgggccggcacaaggcccagttcctatctgggttgggcttagctaaaactgggctggtgggcagcaggcttgaatgaataactgggcaaggatatagcttgaaaaggttactagtagggatgtccactttggttccctcaaatataggtctgatcagattaaactctttccatcgtaaaactggatatcaactattgcaattggtatagaatgactccattagcgtttctgaatgcggttttcactgatgtggctcgttggcctgatccaaccggctaaatcaacatgtggggcccacatgtcagcatccccttctcttcctctcctacttttctcttcctttctcccatctctttccccacacgtgcgaacaacaattagctcaagtggggactacgacaccggcacagtggtagcacagcctcgtggtggacattcattggtggggacatcactatccatatctctactcttccttcggcttctggatccacgaagatggccgcaaagggagtagtcaatgtgcctctctgatcctgctctgccttctggatgcaagaggccaaggtcgaggcaaccacagttgctcttcctccacgacaccctcgactagatctaggtcctcgcctcactcacttttcgctccctgtcgctgctgccctcactatcggggcctaccccaccnnnnnnnnnnnnnnnnnnnnnacagccacaatgaccctcttctagcatgaggatggggcatagcgtgtggtaatcgcaattggtactttacttttttcacatgtaattacacataagcattgcatgtgtcatgtgaggtaaaggccaagtcaacatgccacatagacgtttacatcattgaaaaccatcttcaaaactgtcaaggggtcattctacaccagttttaatagttgagtagtggatatacttggtttcagggatgcaagagcgggagccgtatctgatcgaatctatattgtgggaatcaaattggactttctagtaatagagaaaaaaacagacgaacaagaaagccagaccagcaaaagtgcccttattgggcctaatttcgagtggacctatatgacttctagtccaaccatgacaacaggaagctttgtgtaggtttgtgacacgtttctgatctgatcagaaacggtgacaacagcaacggcgggatggatagatgaatcaccggccgaccggccgcctatctacttgacggcccagcactgggtgccggcgtcgaagacggccggcgcagtggcgttcgccggcggcgggaaccatagacaccttgtacatgagcgtcagcgccacgctcaccttcacgtgcaccgtcccctccgcggcctcgcgctccagctccgccgccgtgccgccatccaccgccaccacgccgcggaacgccgggtgcagcacctgcatatccgaaaaaaagtcaaattaagaacatcatcagaacgtggagctagttaaattgtaaagaaaaaacgtgtaggaaattaattaatgtacggaacggttgtgttcttggggttctggcggaagagcgggagcgcgtcgtcggcggggccgagcttggtgtcgaggtagcggatggagaggcggcggtgcgcgttccggaagctgaggtccacggcgaggtcgtagacgagctgcctggagctcggctggtcctccgtggcgttggccgccggcggcggcggcggtgaggtggagggcagcgaggacggcggagtcgatcctggggtggaagcgatcggggccggtagagaagccatagcaggatgaaggtgatgctgaactgcgtccagaactgcacgcacatccacgcgcattcgatcatggacttgcagcagtcccacggcgacggctcgccatcgtcgtccattttctttgtttgaaactatgtccttctcggttgatgattagatcatactctacattgccgtcgtgtcctagctaagctttatcggacgtttggcgtgcaggtgattgatggagatcatagcaggaaagaaagaaaaacaatgactgcgtcgatctcgatccggcttagatcaattaatcttgtttcttgacccggccggactctccgctcaatatatgcagttcgtttactttgttttttttatataaattaggaaggaagctcacgctcaatatatgcacgggcaacttatttattgtttataaaaaaaagctaaagaaagttgtttgttaccttattcactataagaactatatagtactaccttataataataaaagaatgaaataactatatcaaaaaccatttacttgatatactaaatgataataatgtcttctatattgaaacataaattgttttatcatggttatatgtctatcaccactaattattatggtatggaaacctgaatgcatttttgatagatggaattgcatccataccaaaagtaaacctaatacgttgtaaatactataaagcgttcatttctacttcataccactgcatttctaatcaatagaatctgtatataatattttaaaatacctttgataaactaataggttaaaatcattaaaatatatatcaatgcacctctaacgggtgaaaccgaccgtagccacaaatgctttcttttcttatggcttataattaatatgggtctcatactgacataattgtgtctcttaagatcaacgtagagcacaagtttaatgtcaaattcactaattgccaatggtgacttctcactgggcatgcccagtgagaagatggatgtgatgcagatattcttttaaaaagttgagtcaaattgtgatatagaatagacaacggtacaaatataattttcccttttgaaaataagcaggagtgatccttcgacactactttaaaaaatacaaatataatttttccttttgaaaataagcaggagtgatccttcgacactactttaaaaaatctaatagggttgatggagccgtttgtaaatgaatataatgcccgctattaattatttgaaaaggatagagtaattgttaagaatatttgaatgagattgaaaaaaagatagaatattgttccacataatattttttaaattaaaatatatagttattatgggatgtaacgatatacatctaggatatatcctagtcaaatacctagtaaaacaaaggggagcgaaattaaaggatccacataggagtggactgaaagttaggagggaaggattcatagttttttcgcgattagtagtctcccggcaaataatagtctctctaccatatatagatgtatatatgtacatatttttttcggacgaatagtacaaattagacaggagattaggaggaagggattatttacttcaggagatataatctaataattgaaaataataagtttactggtttaagtgtaaattgatcgctccatgttttgttttcttccaatttttttagattttattgatcctaaattatcagtttaactacaaattaaattgagacattaaactgcattaaattgcttgcaattcctaggaagtagagagaagggagagagaggaaatatatgtcctgcacgtagcccatgtacgtatacaggtatgtacgtatgggttcgttacgtacaggggggagagagaggtggaggtggaaggatttgtttcggttaatataatggctgaatataatgggtccaccaactttaataaaaattaaaggttaatctaatggctgaatataacggtttttttctcagaatttcttggatttctctatttctatagagcgccacgtggcagcctgagagcgtttataggaagtttaatggacttttagtatataatagatagataatagatagatatggtatgaacgctcacatatggagtacatgacatgatcgtacacacatactttttccttgtatatcttgagattgatgaaatcattacaaagatcaacataaactacatacgtatctctatcgatggatacgtcgtctatcactgaaaaataataaggccctttttagatttcactcaaaaattttacaccctgtcacatcgaacatttgaacacctgtatgaagcattaaatataggctgtcgacgtttgatgtcgcgattccggtatttgcatagtatggggatcgttggtactaggatatatgcgagactgaggtaaaagagatggagacagggatttttatacaggttcgagcccctgaattgtcaggtaataaccctactcctgttggtcgaagccggtcgttgctcttattcaccataatcacaccagtataatatttggggtagcctatctaactgttgtcgactttagcggactgaagtatcatcacgtagtcgacaacagggtagtcttcctcctcgaatccgtatccggcgagatcagagaccgctagatccctacagccggcctccgtaggtaccggatagggtcgtccaggcatatctttgatgtcgatatccggcggcttgtcttggcgtatgtaggcttgtgttggcttgtggctttgtggtatctatgttgtccgtctcccctctcctcctagggggccttgtatttatatccataggtatccccttgtccaagtagaactagggaaaccaatatggatataatccgagtagtctttatcgtttccatgtagaactctagttgtctttccttatccggaactactcctatatccgaaggttgtttccgtataagacatggtatgtggtgggtcttgctgagattcagtcaactactatttggtatgtggtatccatagccctgacataggctaagaaacaattaattgcacagattacaactaatttgcgaaacgaatcttttgaacctaattactatatgatttaataatgtggtgctacaatatatatttgctaatgacggattaattagagttaataaattcgtctcgtactttactaacggattctgtaattatttttttattagtgcccgaacaccccatacgacaccctatataatattcgatgtgacacgataaaactttactccccgatctaatcaccttctaagttgtaaatgcgtctaccgtactggttaggtttttttttttaacaacctgtccactcaggttcaattccgagcggttgtttatttgacggctctgatcgactccagtctccggtccaggtcaacgcttcgttttcttgaaggaatctcagcagtctggatctaacaggtgatagaaattgatagaggagtttagttggagattagatcattaataaaagggtttgttagaaccatgccaccttaattttgtaaaatttaagatatgctacccgtatctcaatgacatgtagaacccacatgagtcaatgacatgtgggtcagggtggcatatcacattttctgtaaaatttatgtggcatggttcaaattttcccttaataaaaatggttgctgagatttgcttagacaaagtagaggaggaattcccttttaattatctgtccctacccaggtattaaaaaagagggagttccttcctcaattcctcatccccatcccactaaaattttcatccccatccctaccttgacgtgagggtgaagacgacgctgacgtacaggttctggcccaccaagaccacccactactacgagtacgactgctggctgcagttcgcaccgccgccggggaacggtacgccggcggtcaccggcggcgtcaagtgcggcaagcacaagtggtgcatacgctatatat

SEQ ID NO: 59051 - DNA, 11518 bp, Oryza sativa
ctcgctcccaagtggcttcttcttctgaatgattactccactgaaccttgcaaaaccgtataacgcgattcctggttttcctctcgcttacttccaagattctgactggcttctcaacataagttaaatcttcttgaagctctatacgatcaggatctgcttcctccgtaggtacacgtaaacatttcttcaactgagacactgaaacacgtcatgtattcccgccattgacggaggcaactctaactgataagctacttcacctcttcgactcacaatcttaaaaggtcccacaaaacgcggtgccaatttccctttggtttggaaacgatgaactcctcgtaacggcgtaacccgaaggtatacataatctccttcttcgaaagccaaatctctgcgacgattgtcggcatagctcttctgacgtgactgggcaacacgcaacctctcttggataatctttactttttcttctgcctctcacaatatgtctgtcccaaaaacttgacgttcatcggtttgatcccaaaggagcggcgtacgacactttcgaccatataatgcttcattcggagacatttgcaaactagcttgataactattgttatatgagaattccgcgtacggcaaattcttatcccaacttccaccaaaatctagaacacaagctctcaacatatcttctaaaatttggtttactctttccgtctgaccatctgtttgagggtgataggcagtactgaaattcaaacgggtacccaattctgattgtaatttctgccaaaacttcgaagtaaactggctacctctatctgacactatcttcctaggaacaccatgcaaacatactactctggccatgtataactctgcaagcttattccccgtataggttgttatcgcgtcccaaaacgactctaaaatacatcctcaaaattgtgccgagaataattaaaacccatgtgaaagcctccaacaattaaaatgtgcaaatttaaaagtcaagtaaggcttggaggatttttgtatatttcctaaaagcctaaaatgtgtaaataaattttagtggaattttcagagcacaaataataattgagaagaaataaacaaagttaaaaaggttttataaaaagaaaaaccctaaaaagtcttcttttccccccttcccttcttgggccggctcggcccagttctctccctctctctcctctcccccgcgggccatcgggcttctcccccgcgcgcgcgccgcagacagcggccccgccgtgccctagcgccggcgccgccgcggattccgccgcatccggccgtccccgcgcgcaataaagagggggaaatcactccccgtgattcccttcctctttttcccctctttccctatctctctccctcggattcgctcggatttaatcccgcaaagttcgccggcgcatcaatggagcccgagatcgccgcgccggtttccttcctccccggccgccctctctcgctcccgtccctatataatcgatcaccgtgctccgctcctccgtttccgccgctcaccgctcactctcccagtcggaatcgtgcccgcgccgtcgtcctctctctccgccgtcgccgccgagctccggttcgccgccgtcgtcgccccggacctcctcccgcttcggcatcgcccccttcggcttcgccgcgtcctcgccgacctcgtccgctcctcggtttcgcccgccgaccatcggagcgccatcgtcctcgtcgtcccgagccgcgccggcgccttcctccgcttcggccgccgttcccgtcgtcgccgtcgacccgtggtgagccgaagaccgccgcttcgctccgtgttctctcctctctctcgggcgccgctccgttgcgccggtggtcgccggcggtgaccatcgaggcgcgggcgcgccgcctcccgtcggccgtgccggtgaggtcgccttcgggcgcgccccgcggctgccatgtggggcccggccgtcagccgcccacgccctcgggtgcggctgacgcgtgggacccacggcgccggccggcgtgagccgcgtgcacccggtccaccgtggaccgtggggctgccgcgtgggccccactcccgtggacccggtccgcgcgccctctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacctatttttgtgctttgtttctgctgttatatggagttatttagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcattatcactattttatttagccatgcctatttacctttgttacgaccttattattattgttattgttattattaccttgttcaccctagaataaacaaaacctcaactagtggacaccctactcatggcaccactagtttaattttaggtagatgcttcgcaatttaattaggtaacattaggtggtttttcaactttagactttgggaaatattcatatcacctggatacctcggaatggtctggatattgtggaattggattcacaccgctccttctattcaaaatccccaaaatggttttgggctgggctcggggtgcatggttttgatagtagcacctcggccatataaggaccggtcttcgggcctctgttgcaaagcactaccgtactttcacatgtctagtgggtaaggcttagtttgtggctcagtctagttataaacaaaagtacacggatggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttgcacgtgaggaagatgtgtcttgtgggtaaagatgtacacctctgatcagagtataatctatttgaatagccgcgccctcggttatgggcaagccgagcaatgtacccaagttagtgttttaattcttaaaacctgcttaacaactaaaaggtggaatggttggcctgggttggcttgggacgagctgggaccctgggtcgggttgccagttcggtctgaatcatcataggccttgggttaaggcaggttcgtgtgggttcacggccttgtttaataatatggtatagctctagaatcgtgtttaccaaatagctttgagcaactaaatgtctttaaatgctgtttactgcaacatgctcaaagggttgtttgggatctgtgtgacttgccttgggcttccgcaaacgcttcggaaccttcctcaacggaaacgctctcctctggaacgtcggaaactaaagcaaataaacaaaatcaataaaacagtacaaaacaagcataaacagtacatgtggatatttttaacatgtagatcttgattttaaaaaaatttataaacttgaaccacctaaaacggatctacggttatttagttatgattttctgaagttttaatctattagaaaattgggaaaaaggaaaaagagagagagatgacgtcagccctaaggatgatgacgtcagccctggcgatgacgtcagcatgacgtcagcacgacggccggctcgggtcgacgagctcgccggcgtttggttgatcggccgcgggattggagaccatctacgcgtagaggacaacgaggcgaacccgttggttctcaccacgacgtccaacggtgcacgacggcggccggcgacgagaagaggtggcgcgacggttcggcttgacggcgacgagggtgctccggtggtcggcggcgaaaaaggatgggcggccgagcttcctctcaccacggcgcacctaacggcggtgacggcaagcggcggcgacggcggagacggcgcggcgacgttgccgaagacggccggcggcggcggcggacttgaaacacgtcgcggcggcgctaggaggcacgggagagctcgggagagggggcaaacggaagaggacgacgaggagaagctatatatgagctcggattgaagagatcgaactccaaacgagaggaatcgattcgggaagatttaaaactcggttttagggttaaaaacaaaacgaattcgattcggttaaaatactcaacggatttctttgtttcttgaggggaaagaaagaggagaccgagaggaacaaaacccctcaatcaatcggaagaatccgggtcggatttgggcggaaacggcggcgcaaaacggcggctcggcggcttgcgcggcggcggccggaggtaggggatggacctgacaggtgggccccacctgtcggcctccacgagagggggagcgggcagcggcggcttgggccggcgtgggccgcgcgcggggagagagaggaaagagagagttgggccgaaaacggcccaaggaccaaagaaggggttttttgaactttttcaaataaaacaatttgtgaaatgttgtttcaattattaaaaaaatacctcccttgctcaaataattcccagaaaattctagaaaatagaggagcaagcatagtatttaataaaattttatctagctcatttttatgttgaaaattttcctagaaaattagggtttagcttgtaggcttttaaaaataatttctaaaaaattccaattaaacaacaatttatatatttaagatttttagggcgtgacataaccacatgattgtatattagtggatgtaaactaggatttgagtgtatattagaagcataggaattgagtgctttatatttcttcttccacttagttagacttacctattatgaggattgaatagctttgcttcgtgtcactctaccgctatattacatttaaccattgtttaggctttgacaattataagtagtatatgtataaagtgcattagcgaggttcactcttattatcttctcttggtattaaaaatgcgataccttggaatacttccgggtaaaatgctacaatggtatatccgtgcgcttgcggattagttttgtaaccatacatataccatgactatttctggcgccattgctgggaatgaagatttctagtaatgtcgttaagaaatatcaacaccaactatgtccactacttatgctacattagagcaacgcatagtggaaacaattgttgaaatacctttgtcataaaacaatttgcttgatgtttcttgtgataaagaatagttgtgtgatgtttcacttctatccatgccacaactagtgaatgaacatgttagttctatagtagagccaccatgtgttgagttcaaacatgttattcacattgctagcgagaataaagagcttaaattgctatcttctttaaatacttggggctatattcaatttgatgatgtttgtccactcaactgcttacagaagaaattatttgctagatttgaattgccatgcccttctgatgtgatttttcatgttattggcaattatgatagtaaaggagaatataatgtgcatgaagtatatgtttgttcgaatttgactatacctccttttcatgatgaaatgtattgtctagaggaccgcatgcgtataagtaattctctatctagttcctctagttgtttaaatgagctacaggttggtttgcaagaagaggagtgttgtggtttttcgactacaaagattttaggatccaaccaaatggccatcaagaaatgttcctcaccagatgttgtgatagataaagataagttcaatacgctccatgacaaggcgaaatcgaggacgatgaggatgatgaggacacaactagcttagatataaccatgaataccttatgtattaatcaaccaaaggtacatatgttctatgttggaggtatgtcataagggccttcggccgacctgccgaaaccatccaaaatagcaaacatcggctaaatcccagacgtgtgccattggcgaagccaaggggcaaagtccttgggcgaagcagaatgacgaagaccaagggggtttcaccatcatgactgggtgaagccatggaatgaagaccgaagggttcggctctaggctcattgatcaaccaaagatccaccacgggcgaaggctgtaagtcgaagcacaaagccatcgcccaaagtagcaaatgccttcggctaaaggcttaggaggcccagcagcccatagaggcccttcgctagctaatgggccggcctaagggggccgcctcaaggtccatgaatacaaaagacactgtatacctattataatgtccctatcataagggtaaccatgtaaattcccctatactaaccaaaccctagagagtatgagcctatacaaggattataaatagccccctagggccatgtaatggggaatcccaaaaatttttatcaattaatacattgctttactattccaaccacacatcaagtttaccgcgtccttcgacgtgaagcagttgtcattcgacaacacctggcgccgtccgtggggaacccagagcaaaaccacagatgccaccaaaaaagaccgtgaaagagagagttgtgcctaggcgaaaggggggcgaaggcgaagaggagatggcgggtgaagagggagtagagcttttgaccgcctaagacggtggcgtaccgccaccgagggcgatgcaggctgtccagccttcagccccgccgcggccccaaccgtaccagtaccgtccaaggcagtggcttcgacctcacatgccgcggtttgaacagccacaacggcgaaggcccctttgacaaccaccgtcatctagtctcaagcatggtcttcgccccttgtagtgcttcggacacaaaatacactagcttatggcccacttcggatgcttgtaccagagccacactgaccacatgtcacgcccagaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacatggataccaaaggatggcataatatagggctcatttgtaaaagcagcatttagcaaacatttgagaattataaaacaatagagtaattaatcatcaatattaatcaacactgaacaacacacccatgctgcacaggtccaaccatcctgaacagccatacccggctgtacagatctatctccaaaccaggagctaatcaaattattacgagttataacatcatttattatggtgagaagtgtgagactaatcacgaaagacattgttagacctgcccataaccgcgggcacaactattcgaatagttttactctggccagaggtgtaccactgtacccataagacacagccccacaacatgtcaccatgtgcctcaataccaccacggtacctcggaaaggagctgtgacagtacccctcgcacaacacaatcctccacagtgcaccgttcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtagttggcacggttaatgtttcacaaccgaaaatcgtaaaccggtccttaattgtcatgagcacgagtctcaaaaccatgtgctcacaacccaccattatcaagttttagttggcaatttaattaattaaccaatcacgattgaccatcgtgaactatcattaagccatcattaaataatagtgaatcataagttatcccaatagtgtgctaatatttctaagcatggctaagcaatcatatctactatctagctgaaccaatatataaagctcaactagtcaagttataataacccaaggtatcaaggaataaagtaatcaagaacgaaagggctataacaaacaataggttaattccacccaatgacattcgaaaataaatgcaataattgaatagaaacaatagctttaaacgggatcaacatgctcaaagggttgtttgggatctgtgtgacttgccttgcaatattcggtcttcaattaatcttcttaatacttccggcgcactcacgaaccttcgcaacgacggaaacgacaagctatcacgcaaaacgaggaaaaagactaataaaaaccaaatagacaatacataaaaagtaaacaaacatgtagatcataattttagatgaattatgagacttgaacggccttattcggacttcatatgaatttattacgaattttacaagattaaatctaattaaagcctatttaaaaaggattaaataaatttaattcaatttatggataattttaatatgtagatctttattttatacaacttttgcaaattgaaccacattaaactgagttacaaagaattagttatgaatttttaaagattaaaccggattaaagcatttttatggattttaattgaattatgacgcaataatgaattatttttgaaaaggaaaagggaattattgcatcatcggctagggttcacggaggaccgggttaatggcgatagttcacgaaaacgaacggccgagattcatctatccaaaacggacggccaagatccatcggtccacgaccgggccacggggaacgacgacgatgacgtcagcggtgacgtcaccaccggcggccgctcgggcgtgcatgctcgccggcgaacgacggcacgacagcgcgaacggagggaaccaacacgtagagggcaacgcggcgaactcaccggtgaccaaaacaacggcggaagatcaacggacggcgacggcgacgaggaagagcggcggcgacgatcgggtcaacggcggcaacgatgctctggcagctgacagcgacggcgaaagggcggacgaggacggcgacgcgacagtgaccacggcagtgacctccccgagcgacgacgacgtctggagcgacggcggcgcacggctggagcggtggcgacgacggcggcgcgaggcggcacggcgctagagctctaccggctacgagagactaagacgagggtggaggcgggtagaggggagcttgggggtcaatttataggagctagggagcggcggcgaaggcccacggcgaccggcgacgggaatgaaggtttagggttcggaggagagaaatcgatccgaatcgaactcaaatccggcgatttccaaagcgatttagacgatgtttccaaaagggaaaaggtagagtggatcacagggatcctttcccctcaatcaatttcaccggaaacggaaagggacgaccggatttgaaaagcggcggtggctagggtttcggccggcagtggcgcgaggtagacgatgaccccggcatgagggccccacctatcagtggcagacgcgcgtgcgcgggcggcttggctgcaggccggcttgggccgagggagagagagagagggattgggccgactttcggcccaaagccaaaggaggatttttaaaaacctttttgaatttaaattattcattaaatgcaattccatttattaaaaatacttccttagctcaaataaatcccagaaaaatctaggaattatagaattaagcaaagtatttaatgaaattttatatggccccattttatattggaatttaacaaattaaaattagatcttcttttctaggcttttaaaatcatttctaataattccttttagacaacaatttataatttaaggatttttaaacaagaaaagaacttaacaattattattagatcattaatgattaattactgaactgttctttgtatcatttaggaattgagctccgaaaaatccgggaaaatttcagagagtataattaatcatggagaatttaataaaaattaaatccatccatgctttaaatttaggaaattttatttcccacatttaacttcacttgtaaatttatgaacatttaatataaattcttttaatattaaattgtttataaaccctaaaacgaaaatctagctgtgacaacaacccaaaagcttgataatgttattatgcatcatttgcgattggatgatcacttcatttgtgaaatcatcctttcgagcttcatttacttcgattgacgtcttcactgcaaccgtagtattgtcttcaagagtctctttgtacaccttaccaaagcttcattgaccaagaacttctgaattattctttgtgattttctttagctcatctttggtgaaaatcttgatattgtccactttctgtagcactgaaccaccattctttttgaaatattcattcatttttcgcttttggtgcatcactagcgtgaaaagaacaacaacaattaggaaggaaaatcccaaagtgatgcctacgaaagttaaaaaaacttattagcatccccgcaaaaaaaatacttattagcaaacataacaaatccatatatgagttccagtattattttttaatagaaatactccctctatcccaaaatataagactcaccactcgtaacacaaagaccaagaaataatttaatcaccttcttgattggatcacatacatacatgcaagcaatgtgattggaggatttaatggtagatgattcaaaataaaacaaatttgaagaaccaagaggtgatggttaatgtatgcatgccttatatcatgagacgtgggaaaaaagtggttgtgccttatatttttggtagagggagtatgaatgaagactcattttatttgataaattttattgtgaacaactaatgttatattaatattggcatgcacaatatatcgctgtaactaatctttagtgcagtttccttacacaacatataattttctgtttatgtttcaaaatttcctgcatgttttttttttttgaaaagtctttctatgtggcattagagagaaatctcctacaaaaaaaaagaacaaaaatattttgtgtagcacat

SEQ ID NO: 59052 - DNA, 1382 bp, Oryza sativa
cttgagacagtagtcatacacatgcgcatttgttgtgcatggatggaaattttgtagtaggatttgtgcaaacttattccgaactgatcttgtgacgattttcaagctatgtttgatgtcgcattttcttcatttagcaatgttgtgttacagttacataataagtaatgtccaaatgcatatttaatgtagaagttgaaactatttccattattatgaaatgttctattccaccgttgctagaacgatgacaataggtgacatattatattccacttgttgaatctttatgtggttaaaaaatgattatagcattggatcagaagctggttggccagagatagcactcaacccaatagggtttaattctagactagcgctatagaaacacgtgtcattacttcgaggagcaaaacattttttttaaaaaaaaggagaaaaaccgtactcctaggggtggtatttattgatgatttgacattagtatccaccaattttaggactacgtgtgtactgcatgtgtttggtttgagaatgagctgagatgggttggacttatccctgtttttgagatgaaatggtcttatctattcgtttggcatatgggatagggtgatcgtactttttaagagatggcccgcatgtcagcaagagaaaaaaaaggtttggattggtttgccggttttgaggaacaagatgaactcagatcttagtggaatattcccttttagcaatcatcatgttccatctgtcctccaaccaaacacactgaaaaataggttcaacacaatccgatccatcccaacccttaaaccaaacacatgctaagagatggtcaacatgtcagcaagaaaaaataatgggttggattggttcaccagaggaatattccctatcagagaccatcccatcccacatgttctctagtcaaatatgctgaaacataagttcaacccaatccgatccatctcaacccttaaaccaaatacatgctaagtggatatgcatatgcctgagctctacaagattttgatgcctccgatgatacttcaagcttatgtaaagaacatgcatatgcttacgcagtgttgggtgtgcactaaattgtagtactctaaaaacggatggtttggtgatacataggatgtgatatgccaatatggcacacacttaaaaaagtttgtcttcttctctaaatatctttacatgctttggactatcgccatgaaatccattggtttacacctttttttttaggaaagaactgtaggggaagcccccacagttaaaggatattattaagatataaaaaatagtattacaattggtttaaccaggagattaaagttgatctctcatctaattttaagcaaaaaacaaga

SEQ ID NO: 59053 - DNA, 45176 bp, Oryza sativa
cctagccacagaaatgatgtatgaagcattcatttgcttttcttcatctgtacagaaagtgtaaatttttcaggaaacaagatctgaccagcatgcaccagaagcagatcataatagccaatctagcaatttgtacataacagtggtggtaaaacaatgaatacgcatacaagaacaaaatgcatggagcatgacaatggggtaaatttaaacaggtatgcaccaaaggagtaatttaaaacaggtatactgggtgacaacaataattcaaaaggagacccactagtttatatttccacattaaagactgaggaaaatatgaatcacagggaatgatggaaatttgcaatagcatcagggaaatgacctttttctcctttggtaacaaggctccaattcacaacccgaggttccacggcaccaagtaaattgaggaaaaatatgccacttgaaaggcttctatcctgtaagtattacattcagttaaaatctgaaactaaaaggcaagaaaaaatagtagagaatgtagtcgaaacttgaaaccattgtatattagtttgataataagatcaggattgcatatttcattattaacaaattatacaatggcagacattgaagaaaactttgcggctaactaaccaaggaagaaacagtaatatgacattatcaattaggaaatatatcaaagtaaaccaaccttgaaactctccattcgagaatgctttccagaatcctttacttttttgtttgcccaaatcagtatgtcgttatctgtgatctctttaccatttgaatggaatctcagattctttaacaattgaaggatattgtacctcatcaattgccacagaaaagctggggaaataaagtaccatatgattaccaaattatacaagtgtctatgcaacagaacatactcattgttgagttaaccagcagtttaacaagaatcactaatggagcaatctaaatgccctccaaaaaatgaacagttcagcaaagcatcaacaagtaagtcatataaaattatcaggcgtcaaagtgataacaattatcagacaataatgaggtcctatgtaccaaacttgattgctattatcaggtacttacagacatttataagcatagtccaatttgtttcttacatgtttatgcagatctggtcaagttatcatttgcagactaccaggacaatgcagcaatgccaatatgactaaaaacacattgtattaaattgatgaaaataccacttacctaatatcagtttcttgtttccttgcacaatatcattaccagcaatattcaccaaggaaaattttagttctttcccaatcttcagaacttgattgcaattttccactttcctgaatggtaattttattgggggcctatttgccattttccaattaactgagccaggagcaatcttgtcaatcacctcaagaagcacccatctgtcatccccagaacaaaatatcagatagagcatcggcttgggtgacgattaagatggggggagataactttaatgtaagacctacccatttctaagatcctcaaacacattgttgatgtatgtagaaattccaaggctattaatccataaccggaatgacctctcttccctcgaaacttgagcatcatcagagagtccgtcgacaaaggaaacttgtttcatttgttttgacagcccattcctgaagtaaaaggagcaaaagtcaaatactttcatgtagttgttcccctgaaatttttctggttgctaacctgacatttcaatccctgatactaagaacatcaattttcatgcaggcttcaacctcagtacaagacaacaattttttggtaatcatacagcccattagaacagtcaatctcattttgtgacccaaatgacttattactacatatgttattgttggctatagcatatctgccagaaaagtaatactgatagtccattgtaggtcagttcaaagaagatatgttgccaagaaaacaattccagaatttctagttgaatccctttctcaacctgtttcacgccatcacactgacaaggatgatcatgcatagattgcattcctttgctatgctatgaacaatacatattgatgaataatacacaaaagaaaaatcataaacctatattttatggaagcacacaaggttgaacaaatcatgcaaactgaaaagggatttttgtgtttcaaattgacagttttccgagggaaacaccactctagcgcacctttagtgagtgataagatgaaggaaacatgggatgctaacataacattactagtagcttcacgaagataatctttttccaaataattatcatatgttaactgtagtatttacacaacaatggataccatcatgtctatccctatgtactgcctttatttcatattataagtcgctttgcctttttttttctttagctttgaccaagtttatagaaaaatatagcaatatttttaacataaaacaaagaaactatcaaaatatattcaatgctagatttaataaaattattttggtgctataaatgttgctatatttttctataaacttggtcaaactttcaagaagtttactttgaaaaggtcaaagtgacttataatatgaaacggagggaataataaaaaaaccaagcagaaattcaatttctttgaaaaaatattaaattaaataaagaaattatgagaactatctataccttttctggaaaatatgagccacaaaagcaagatttagatttggtaaaccgtcgacaatgtcttttggggtcagatatcttttgcagcccatcctatctgcatgctcaagaactaatcttgctctatgaagaagatctttaactgacattggggatggtttagcactgcattcaggtgccaagacattcagtagacaagcatatgcctcactatcctgcatttttatgttacaaaaatataagatatgcattcttcatactgggatgtagatggaactaaagaacagataaaccaatatttatccatcaattgactatagtggaatttaacaaccaaaaatttgataaccggaaaaaaaaaagtattcatgatgttacatgaactatgagaatgaatgcatcatgatgtatgattaattaattattgaccatagtgttataaaataaatttaataacataaatatgtaattcgataaattaacatttttactgcactaactacattttctggcaaattagatgcattcattctatacatcagaatcctaaatgatcaaggaaaactatcgtggcatgtgaatgctaacatgtagaaaagatgtcacagctagcaacaactaaagaagactggttcatattggaaatcaagtgagcatacttttatatctgatgaaaaatttgttactgttctttggaaacctcctttcttcaattgaaagttcatccatctgagtaatattttttcaggagataagctcataagctcctccatctcctgcaaaaagcacagacatatgaatttgagttattttcccatctgacacaaaatcagtcaccagtgtattagaataaatatgaatcatgaactaccttgctgtcttcaactaattctaccaattgaggtgtgctcttcaggtttacatcagccaaaagttgtatctggtagtcattatgttagcacagtcagtgagatacatgaagaaataacagaacttcagttcttgtgcgcaacaaaataacaacaggaacacaccttaattatttgtgatatcaaacccaagataaggtgaggctgcaagcacataagagagttttcataagatccatgcacaacttatatgaatgcttgagtatataaatggagtgaaagcaggtgtaatcaatgaaatgcacacaagaacaagagcagacataaaaacaatgcaagtatagcagaagatgcaaaagtatctgtatttactagagcatgtaactagtaatatgcgaatctattcaagagaacaaaaatggcataagttacaagtattctgaacaaacaacaaaattcaagaaagtgaaacctatcacacaacatatatttattcatgtagttgattctttctttagtggatttttcatggtattatcgaaacaatttcaagtatttgatcacaaacaaaatagaagggcagatggataaccataccaatcatatgccaccatttaagcttttacagataattgtgccatggtgttccagtgacaaccaccaagaggtacagatataaaactaattaaagcaaggagaaccaactcataatgctttacagttctggccatcacatggactttcagtctagtgtgtcccaacatcccctacttgaacacacacacgtgcgtacccgcaactaaaaagtgaacaaactgaaacattcagctttattctgaatctcatactgtcgtaaatacgttaatgtactaatgtggtgatcacacaaaagaggacaaggaattgaattaaagaaacaggcagagtccagtgcagtcctacccttccctcggcgaggtcctgcgtgccgatgttcacgacagtgcagccgatggccttggcagaattgaggcagagggtgtggttctcgttcttctcccacaggttgagcagcttcttggtgttgatggcgcgctcgtcgatcgtccccggcacggccaggttgatgagcttgctgaatcaaaaagcaggggggaaaaagagaaagaaagaaagtcagatcggagcacatgtgagtggatcggagtcgaaaaggcgatcgatgagatgagatgaggaaatggaccataggagcacgccgtccttggtgaggtggaagaggtgatcggtggccggatcgatggggagcgcggtgttgaggaagggatcctcggcgaggtaggcgttgatgtggccgacgtaggaggccttctcggactcgctaatggtgtggagcagggtggtggtggcggccgtgaggaacgccgcggccgacgaggaggaggagcgcgcgatgcccccgccgccgccgcccgccttcttcccggcggcggcgcccttgagccgcagctgcatctcggcgtagacgcggaggaagagctcgaagccgacgccctggtgcggcctctcgtcggcgcgtgcgacggccttgagcacggacgcccactcctcctccgtgagctgcgccgccgcaggcgcgctgttctccttctcggcgtcccctcctttcccggccccgacgccggcggatgatagcgccgcaggcaggtcccgcagccgcagcctcccgctcggcgccgcgtcccgcagcgccgcgtactgtaacaccaccaccacacaaacaccaaccagaaacgcgaatcacgatcaatgcggcggcggcacggcggcgggcggcggatcgagccgtggccatggacagggtcgtcgtacctgggcctggagggcgcggaggtcggcctgcgagaagcggcgctgcaggtaagggtcggagacgacgaccagcccgtcgagccccatggcgcggagcggatggatcggaggagagaggcgggggacggatcggtggccgcctctctctctggagtggtggggtggcagctcagaggagagagagaggggggatgggccgaggaggagggggaggaagagcgttagttggtttcaaaataaagcaagaggaggaaggagatgatgaactggtgtgtgggtctctgggattcggggggtaacggaaagccttgccttttgcgtgcctacagagtacaaccactcacacagtcacactagtggggaggaggaattcaaattccgtgctgggctttgggatttccacgctcgctggggtagcagtagcagtagcagtagcgggcagtggctggctggcaggtggggcgcgcggggggcgtgacagctggtcccgaccgttgctgtttgggaaggtagcggggggaggagaggaggggggcgagttctcagcggctcattcgctgccttggcttcaactgatcatcatcaatggcgttggctgcaaactgatcgtcagtggcttggctgcaagtgattactgctttgactcttcgagtttgagctcaaaagatgagagggagcccagtgctcaatattagaggcaatttttttatacgtaagttgctttaaaaaataatattaatttatttttctaaaaaaataataaatacttaattaatcataagaaaatatatcgttccgttttacgtgtgcggaaggtgagtttccaaactatcctcccaaacacagccttacttcataataatttgttggtttgttcagataattgaaacttaatcactacgatattgctctaaatcttataggttttgttgtacagtgttagtgcataattattggggggccaagctccaccttgcccacaatgaagctctgttgttgtggggattgtcagataatagttgaatttgttttttttctcaccccagagaagccaccatttacacaaaagggatcactggattttatctttgagtgagtaccctttcgttggagggacgaaagaatttctcattcatttcggaggaaaatcatctgtaccattttcatgccaaccaatacaattttcacgtcaaatgtgttttggatcgttgttttcaatcaatatgggtattatatatcaaagtaaatgcatatatctagctaatttaatcctatttattaactccaggaaatagacatctgggagcatttaaacaatagccagttgtagcgtggctggagtgttgaagtctacatatgtagccaagtgcaatttttatgtcgaatgtattttgcaccgttgatgtgtatacacgtaggcaaaaaccaaagtagatgcatcaattgaaggaatttcgcaggaaatttagaggatttgaatccttggaaattatttctaatgagatcctttggaacataggaatgaaacttctgaaatcctacgaaatggtttcctatgtccctcattccatagaaaaacaaacacttcctctctctctctctctctctctacactctctctaattcctgaaaaaattatgtgttttatttcctatgaaatattcaaagtagggttcaactttctaactgagtgttggatctcaacctccaacaatatgattttttttgcaaaattcaatcaaattttgataaaatttattgtttgaatttgaattcccaaataccattcaaaatttcactcaggcttttgttgctcgtcgaaacctcaaaacttcatggtttttcattgaaaaaaaaaaaccttgattaaagacactacctctaacatttcgttgttttcgaatccgataggattctattggatatgacatcatattcctacatattttttgtccctgtatttttcaaaatcttgcattacaaagaagccataatcatatcctattcacttacttaagagttcatcagagtttgttgtttggtagagctccaactcctaaatttaggtcctatttagcacagctctagctccagctccacccctcctagagctggagtttagcctaacagttcagctccaccaaaactgggagtggagttgggtgtagctttctcacaaaatgtactggagttgtggagctgggtttaggcaactccacaactctactccagactcaactcctggagttatatttaggagttggagctgtatcaaacaggcccttagttccaggagttgggtttgaagtggagttgtggagcagcttaaacctagttccatctctctagctcattttgtgagagcgctgtgctcctattttaggtggagctgaaactatttggctgaacaccaactctaggagaggtggagctggaactgtgccaaacagaccctaaaacagtatgatgaaaacaataagttgcaagtactggtcgagtattgtggattggaatatcatgtcggagtgaatcacacatgaatttaaaagatgatgtatttggatggctcatagaaaaacaattcggttttttggatggattctagagaggagagacagagaggagttgcattggatttctcaaagtaaaaagaaaatgaaggttgagctcatgtgctaagggcatccacaatgtacatgaaaaccagtccataggaaataaaaaattccattcagctatcttaacacattgtgcaactagtctatagcaaagaaataacaaaagttgtccatagcactatgggtagtccatagacaattaaaaaatcatagttatgccaggtgcatgcatactgcagcctgcagcttcagctccggctgatttttttttttgcctttagtgggacccaccttaattgcacatattgtggtggtttctaaaactatgactctcaggtgtgggtcccacatctatagactagtttgccaaatacattggtgttgccctaatttcctattgaattgaggtataggaattgaatccaaaggaatttggcaacatccaaaacctatgttctaaacaacctacttagaaaaaaaaattccttagtatttcaatctgccaaaattcctacggaactctctaagatccaagtagccctgaaatcaaaagcataatgttactgtagaaatttcacaatgttgctgcagaaaagcataatttacatatactatataaacagaacgcacttaatgtttactgaagagaaatcatcacagatcttccaaatcgttagatggtacttgatgatatatcaactattcttccgtacgtacccaaacgaatcattttcttgctatattggactagtcctcagtaagatttacgattctgattctccatattgcaactgtaatcagctgatcaatgttgtaacatctctttatttctccttttctcttcttctttcttatactggaattctctcttcttttgctgtatttttattttctttctctcatccctcctctccatgttaccttttctctattccttttttctttcaatttctgtatctttgacccaccgttaaatacaggttataaggtagagtctcttcaccattttgcgtcaaaaaaaaaagtcgtgtgacaatgtggcggtgccgtctctgatattaccagccggacaaagcacgcaatcttaaattgattgcgatcggccaaagtatataaaacacatatatttatatttatgggagataaaatatgtcacattgtgtaatacaattatataataaaataatctatgagtaaattgcacctgcggtacacaaatttaagaggtgagtgcaatctctactatttaccttttgaaccaaatatatcgtttatccttttgaagtagacatattgtttatttactattaagcaaactattttccctccttggcccttgctaacgatgcgttgccaacttaagaagaacttgtttttcattgccaagtgatcagaatctacaaggtctcatcgatgtcaagcatagacctatgttttacaccaagatacatgcttctgagaccattgcctttttctaacaacttaatggatgtaaagaatataatgatgtaaaagtatgttccttgacaaattattctagtaatgtcattttcgcttaaaaagccttttttttttgggggggggacaacattatcaagggatttatatggcattaacttcaagtaatcaatatttacttataaattaccatagcacaattgatggcgatgattgacaaattgcttaaacctccaagaaggaaaacctgtttctttagctacaataatccagcatgattttttaatgagaaaacataaatgcatggctacgaaaataggcatggtattgaagcaccatatgtaggaactaaaaaaaaagaggatctgaatcagttccattgatcccatcattaccaaagataaaatatacagtacttgcaaaaaccttttcgtctaacacgtgaatgttaaacaccaggcactgtacgtgtttgggactttaggtcatgtgctacccattgattgttttttttaatattactgatactagctttgtcgaaacagaaaatactgaactgtacggatgtaccctattctttgcttaatagtgcttgcttttctagcaaaagctgagcaacctcacttagtgagtccatttccaaacctccaatagttttttttaagagtgttccaagagttcgtgacaaatattcatgcactttcctctttggcactgttacttttggtctggagtttattgttctaattctgcatttactaacatataaccataatataaaatctatattagaagagagaactgcattaactttcatcgttcagtacaaccttcacacgctggttacagataattgcttgtgctggagctaatgaacacctaacaactatgagagtgacacataaatgatgatgtccattatggtatcaagtactgaattaggccgttgatgacctaccagagaaagctaaaagggacgaacctccgaaaaaacttcaaaaggcagggtttgcctccaagtttggattgagaaattgctcttgtgaaatcttcaattcaggatattcattcaatccacaccttgggtaaaatgctcttcttttgtttcaaggagctttagggtgttgattacctgtaacaagaagcagcatgtccctcttgatggtggaggaaatagacatgttgcatagaaaagattcgaagtgtaccttgcaaatggaaggatgaaagtttatgtgcagttttaatccgcaaagggaagaaaagatgccgacatatttgtaatatatggctttgatcatcatcaatttgcaacttagaatgtagttgcaattattagataagaacatgagcaagatggatgtgtggcgtcaaccagcaaggactaggcttttgaactctcttgatgtgatatttctgatatcatgatgtatatataagcatatatgcaatgcatatgtaccaaacaagctgaagtgcatgcacacattatatttatggagggcccttgaggtgtggtgcaaatgatatggcaaggatgctatcagagacagttgtttcttcatcctagtgatacaggaaatggcatacagcatcatggaagtgccccaaataccaatggaacttcttttcctctcttgtgggaaaattggaaaaaggggatctgaagaaattaccttcgtagatgattgaatgcaggctttatccctgaagttttaaactgcaaaaaaaaaaaaaggtggcttctggttttcagacctttcagacacaacacaaatgaaacagacattgtggaaactgtatggagcaagagatggggggaccaatgtatgttcctgcaaaagggaagtctcaacagcccatcacttagtaggcaaagcagcagcaacatgtgggggcaaaggaccatgcccattgacaatgagccagtcatgtaatgccagggaccaaatggtactgtaggtctctcatacatggatgcacggtgtaatctcgaagtatgccaatcttcgggtggtaggagtaacatgataaaatacatagagttgagaaggatgacattgcacacttgagttgcgccaatggcctacagctacaaacaaaagagtgaaatgttgaagaactaaacacgataactgcaaatattacattggactgactttggctcgtgatccaccattgataaatggtgagaaacagcaagcttcaagcaatcaaaggtcgctttcatgagctaatatgatcaaagagtaatcaaccagtatgcattagggtttctttccagctggcacaattttagcatgtcacttgtgggaccaagaaagagacatgaaaattcttcttgagattcagaaacctcagctttaccactatcattttctggaatagcatggatggaggtttgcgttagaagtgacaacacaaatatgaggtgagtcctatcaaaatattcagcaataaacgttgagattgatagtgtaaataaaaatatcacaactcatggtatgtaaatcactgagagaaaaaaaatattgaaaatgaaatttcaaaaagtggagcagcaggtgcacatggagatggaaccccccaattaggtgcaaagaatatgaaatgtccagaatcagcttgacaagattgttaaagcagaaaatcttcatactgtgatactacgtagcttcttatatgaaaagatctagggccaccatggaccacacctatttagtgaccaactaggcttcctatcatttgaacctaaaggaaaagaacaataatggaaaaactggagtcgaatatcgaacataacaaatattaagtcagacaacaatgaagtccgatacttttacgattattaacaggtaatattaacaaggtttggactttctgaaagtggtaaatagatgatacctagtgaattggaatttgggaaagggaaactccgtgagggcagcaaattcttcaaacaaatacgcccatcgtatttgcatcatggctttgatatcacaagccaaaataagcacaaggaatatctgaagcaacaattttcaaatatcgggctgaagcagttaagtcttgtgtcttacactcctcgtctctcgagttttgtggactactactgaaaaatacctctatgtgttacgtgattcatcaatccattgaggtttaaaagatgagtgttaacagattgtactaagtcaaaaaccaagaatgggcatggacaaaactatgccaagaaatacaaaaagcatacaccccagaataaaaaagcagtaggttggatgaaatatttaagccattacaaccaccgtttacatttccaacattgatgcactcattgtatgattagctaaaagcttgaaaatacaaaaatgagaataaattgctagaatgcaagttaaaacataaagtccacaatttatttacaataaaagggcaaagaaaaggtcttacccttatagcaccatgggtgtggtgagtatttctgatttcatttgggagaactacgggattatttatggatgaatagagaatatgaacttggttgttatcatcaatgcaacacaatacttcttgagcatacatatcttacttgactatttcttgaaaactttcaaaaccaacttcatgcagctccaggatcccttaggaaagcctggaaagcatcttgagttcttgacctagtactgcaaacctgcaatactaggatttcagtcggtctgtgcatttttagaaattgcaatccaacacatcatatgataaatgatgtttattttacattttacgaatataaatctgaagcatcggttgttcaaaaagctttgggcaacaagcaatgaacctaccaaagattcaaatatagtttctgtacatgattgcagctcaaaagattatttagttataaggaaaacattcctcagcaggaactaactgatcaatgtcaggactgggaacacattgaagaagtatttgatagtagaaccattcttcaatatacattgaataagtatttggtagtagaaccattcttcaatatttcagtcatactattgctcaaaggaagagaccattcttcgagtcataccaatttaagatctgttgctaaaaggaagagaatgtgcagaaccttgttcatttaccaaatttaatcagaaaaggggtcccaaaatggggcactacctgctaaagttcacctccagtgtctcaggcagaagtagcagcatattatttccagtagacagttcgttcagtgctggcagactctgtcaccatagaactagttcgagaccagtctttcctacaaaagagaacagttcactgatctaatcataattatcagggataattgactacagagaaccaagcatcataagtgctcctctaagtaatagaaaaaaaacaagtaatctaaatagcagactactaggcttggaatcttgtatgtgccccttaaggaagctaataagaatttaccacactaccaaaacaaagtaatcaaaccggtatagcatcttttaacaatatatttgactatgccaagcagtttcattacatgatcatatcgtttagtctttatttatcattcagatcatgcaacttcaatagttggccaccttcctatgtttgctacatctgtgctgaagttggtgactagaatactccaaaaatttaatcacataaaaaattaatatccaggttaaaaatgaattatgctatcaatgtcacatcaagtgatctcagttgtttgaacaaaatttcagaacaagaaaagcctcaaatgtataaaaagataacaatatgtgaaatgataagacataactggaattgatctatatatcagaggatagttatctgaaacaataaaatcatttttaaaatcttaaaacacattcacatgtaccgctagaggatagagacatattttatgtcactcttggaatattttagtttttgacacaaaacaatgtgtcgatgttaaatcgcacatattttttcatcatgtccaatggcacaactgttgtcattgcaacaaaaaatccaaaaatatttaaggatgaacaaaagtaatgtagttcatagcatatttactaacatagataagctaagtacaatgcttaatttcatatttctcaagatgactgctttacaaacttacactagtgcgaaaaaaaattggccctaccatataatctcgtacccacagtaaaaaactgaaccgaattgttccccttccccacttattgcccttgtaagtccatacgacaatatcactcatcaagtcctaataccatgagttgaagtcgatcagctgtactcccagactacccttgtccaatataatcctccttggttcatccgattcagaccattgtctagcaacagcatgaaaatttgatattagcacatgacttcctggattttctgggtcaacctccagaaggtgcagagctactttgttgcctctcaacacatccatgttagctttacatgcattcaacatagccacacagatggaaccagaaagctcacttcgggttataatgaaactacaatagagataccatgcctcatcattctggcctgcacggcctaatagatcaataaaacatgcatagtgctctggtcccggattaatcccatattgtcttttcatcaaatgcaacatagctcccccttcatccacaagaccagattgtccacaagctgaaagaacagcgagaaatgtaacttcatttggcaagaccactggtgcaactttctccatccttttaaacaaacctaatgctgcttctccatgaccatggcaactgtaagcatcaatcatactggaccaggaaaccacgttcctgcaagccatttggtcaaacacaatgcgagcagccattgtccgcccacattttgcatacatatcaatgagtgcattacataagatcgtctgtgaagtagacccatgacggacagccttgcactgcaccagcatactgtacatcaaattcgctgtcgctgagcaggcagtgagagcacatgtcagcgcaattccattaagctcaatcctccccagaatcaagaaagcgtccatgaatgatctgctgttctccacacagcctgaaaaaacagcgttgtacagaacaacatccttttggcaatccgtgcacagtgcactgtgcacatgaacaacctcatcgcttcctcaacaaggacatagctcatatagagatccacaagcgccgtcgccctgatgacatcgtcctggcatgcaagaacgcagcgcgcgtggacctgacaggctgacagccagggcggagggccatggtgcagagggtcgcggccgtgggcgcgaaccgcgcggtggccattccccggaaggcgtacgctgcggtgccggggcgcgcgttccaggcgacggcgtcccgggcgggcatttcgtcgaacaggcgggacgcggcggctgggaggcccgcgttggcgtaggcagtgaggagggctggagggcggtggccgggatagggctggagagggaggaagacttgatgagggtagcatggactacgggagagtcggacgggtgggaggagaggcggcggagcagcgcggcgagcggcggcggccgccgcattgcgcattgcatgggatatctatgacgggataaacgctgtatttagctccggttccagccggcagccgctgccttccgagtcgtggttagagcaaggataatggattaatggtgagttctttctcccaacttttccctgctcatatcctcgtgttccgcgtacgtttttcaaactgctaaacagtatctttttcatgagaaactagaaagcaaacacagcctaatagtagagctcacttcctacaattagtttattttaaagccaacatataaaatatattagctataaaattggctacaattttcttctcctctctatctcacttatacatttaatgtatttgtcctgaagcttgtgttaagctagctcttgtatgagagccaacacccttgattttttctgttacctctcttatttacgtaagcttataataggcttatagcttactattatccttgctcttatctggctttcttgaaacatgttgttgtgtactctttcttctcgattcctgccactgcgaccgccaccgcaaggtttggtggactttggagttatcccgatactggcgatatgaatgctagtatcttacgattatatcaagccgaaacaattccgatctcacatagtatcttaattttcatagtatctcaagacaacatggatagatgacacaaactcacaaaccccacgaggcaaaccaaacaagaatgtagatttaaacgcaaaccaaaccctttttttttaaaaaaaaagaaaataaatcaatagctctggtcaccctatatacttatagaaatccccactaagtgtagttaatgttatttttctcttctcttattaagccacatcaccttaattatttttagccattggatgacaaatctatagttcaaattgtctcttctttcttctctcataacaccaagtaatctcaatcatttttaggcctcaaaatttataagtatcaatttgttttagttttaatattcatatttcatcttatttgtacatattatgcaacttaatttcccacagcaacgtggcagggtattcatctagtttatagatatagtaaacacatactctctctttcatctggtcaataccagtagaaatgtagaatctcttagctaacattcaaatctttagatttggatttactccgtgaagttatgcacctgcaactttgtttagtgcaatagcgtagtattgaattttcggtaatgttaatagcaaccatctgcttctagtcaaatggtcattcatcttaaaacatacttatggattccctttaagaatctcaagattatgaggtctccttctgagagcatgagcaatgggtggctctgggtcgtagtcctagctcacaccatccggctttcattgcctttcgaacccgcgtcgtcccctaggagagagccagagatgcgcgcttgctcgcgggggaacgcgcccctcggccacttttggcggagccacagagccaggctccgcattgggcgcaccgtggctagggaagtagctcgtggacaacgctccctacccccgtatttccctattcaccctcgcccccctccctcgccgtcgccttgagttgcgtcgcactcctcctctttctctgcctcgccttctcttctcctcttccatcctcgctgagcaagaacgcaaggattagatctgagattcgatcttccactcaccctgccataaagagcaagaaatcggagcaggacgagagcagcggagagtgaagaggagatggagatggagtgggcagtttctttcacttctccctctctctctgtacacgtctcatcactttggactccgagccaacaaaatgcttaaacaagtccaaaatgtttctctctctcatttctcacctctcccttcctcttcaatgtgactgcacagagggcaaggagaccgacaaaaaaaaacaaaaggagcaaagagcaagagaagtagtactccagtgagggtgtcggtgggctcaaaagaaaaaaatgtaagagagaaaatatatagcaatggctacgtggattggttggattggtgcacactgttatgggttaggccatctataatcggtaccctcaacgcgtacccttgcaaacggtgcctcctttccaccgccgggtcattccctgggaaagaggcgcaacgcctggcagaggaatgcgtgcctcggctgcttttctggagccaccgctcgaggctacgcgttggaggagggcgtggctcgtggacacggctcctgctccacaaatttccccttccaccctcggtctcgttgctggcagtggggaggagtcggaggcgacagcgacggcgacgagcgacggccgccaccatctccttcccaatctggccaggaggggggatgcagatccgtaggcgccggatctgctgccccccgaccggcgacggcgcgaggtggaggagattagggaggcggacgacgcgagaagaagagaggggtagtatagtaaaatacctacgtgggttttttttggttagggacactcgtgggctactaggggtatcattcattgtgaggggagtttccctacaagtatcctctagtgaggacactttaggagtggctcacattgtggatgcccttagagtatctccatccagttgcttcagattttgaagagtccagctacaggtatcctccattgggatggagtggcttcagttagtgagagtaccaatggagtagctttgattgtagatgccctaagtgctgaactcaaggttcatgaatccatgaacttaacatgcagattgttacaaagaacattgtttggcacgtataaatctgaacaagtctatgacagcggcactctcaaagaagacaaccgctgactaaggtggtatttggatccagtttagttcctatcacatcagatgtttggacgctaatttggagtcatgaaccataaacgagtaactcagtgtaaagtttgcattactaaaactgtactctgatcagaatgtacaacatgatttacctgttttctatacagaaagtttgacctaggattacaacaaaaatatgtatgctttactctcagcaacggaaaatgtattttctgtctaccgtgacctccccgccttaccaacaatgaataaaaagaatttccaccttgatggttgtgaaaaagcacatgttaccagagaaaatggagctggaaaaaaatatgaagaattaacaactgggcatgtatttgttaaattttaactgggctcatcgctgccttttgctttgcctcgtaacatatctccaaaaccacccagcattatacgaccaaaccttgtgttctcttgctgagtttgtggggtaggctgagagggggtcgtggcagcagtatcatgttgttccccgctctctttcttcacaaggaggctgctctcaccaaagaagctgctcatcgatgatgcaatcccaagatgtgctcccattaccttgccaaggctctcaagtttacctcccgacctttcgcgggctataacttctagtgcttccttgtgtgcagggtctagagcatccagatcttttaacaagttctgtattgacggcaaaagcagatcacgtacgcttgtagcaggaagatctgcaacaaataagagaaaacacatgtaagaaatggcagattaaactatatggccaagccaaaacagacttatgactatgggttttactaaatatcatcaattaaagtccctagttaaaccatgactgggcagtgctctactaacaactaataaactggtgtgaatcaaaagccaaaggagttgttgattctgtcaacactggtaacatgttctacccctctaaacaaaatataattaagttttgttcaaaaaaaagaaaatataattaattaatcattccattcattttgttcacttttataagttgtattttgatttcaaaaggtcaaccttttagactttgacaaacaattagccagattataagtactttcagtatgaaaaatacaccgcaaggatcatattcaaaatgctttcacacaacgctagttttacatcttttataactacatattatgagacatcaatggttaaattttaattttgaagagtgtcaaactaaattgtcttatggaagtaaaccgaaggtacaatatatgcttgtaaagatttaactacaacacagaaagggcatgattgcttcactctcaagcaacagcacagctgtatttacttataagtttatgccttaattctgccctgtgatgttgaaaactgaaattatttagaatggatttgcaaatgaaaacatagtctattgttcaaaagcttctgttggcttcatcaatttaccatgtacaagatggtactccatctctatattaggtaatcaaggatacagtcaacctttcaaaacattcaccattaatagacatgccaaattgtatggattaactgtatgaaaccaatgtatttgggtttgtcacacaaatacttccgttacatagttttatttttactagtatgctatggtaagaacccatagttatacctaacattggacattgtaaaaactgaaaaatgacttgatagtttaagacagaatatgacagtaacaagctaatatgggatcaaagttggatatgcaagtgaacaaactaatgtaaatggaattcctgatataatatgtcattgctaaatacttttcaaacgcatcttgaaatataaacaaaatatactgaaaatacatgcagatgccgacttgaccaaagttacagggttgtggtataagggaaggattagctagttttggataaggctaacctgtagcatccacagcacgcagtgcttcacagaatacatttgctatctcacgacgccgctcaatatcatttccagtaggtggggcgctcgttagcttaaatatcttagttaaaagatgtatgtaatgtcaaagaaaacagaacacacaagcaatctaatgaatcatgaaaaaatggtaaagactttagaaattaaatgcggttgataggatatattcacgtagtctatctgttgtatgtggcactgccactgcaagtgcacgaataacagaaacagtagcttcatgtgatccatcttcaagaaaagcatccatttgaattcgtatcttgtcaacaacctgacagcaagtctttaaggcaatgcacgaagtacataaagtatcaaagaaaataaatgaagatgtatacataccatgtcatttttaaaatgctgagcaacagctccaaatgcttctatactagcatattttaccgtcaagttttgatcagaaccaagggttataagtgctggcaaaacatgagttgatgctactttcacactgatgtagggtacctgtgtgttaaaacaatcaaggataccatgaggaacatatggaaccaagaaggcaaaggtggtcaaccctctaagaaactaccaatgcattcttgtaatgaattaatgatacgcttacaagtgctttcagtagagctgcagcattggtttttaggttggcatcagagatcacaaccatctcccacacaatattaaatacagcaacatggtgctcctcaaacatgctacataatgataataagtgagacacattaacatagagcatatcaacaacatcgtgacactggctgcattatggattcagttagttaaagcacgaaccaaaggaaccgaactgcgtcaatgatctcagcagtgtgatgcatagaaaatgaaccatccttcgtgttctggataagtaattttctcaaatattcttctaattgttgacgttttgaaggataacccaaaataccagataacaacaatggaaggacacacacaattccaagtttttcggcaatagaagtttttggacgcaaacctgcaagatttaaacacaatacatacaaatgttgaacaaaggaaaatttaaaccaaacagccttgccatattaatacaggatacttaccacgaactctagactgggttgccagaggaaaataggtgaaatcactgctgtcaatatcccccgctgctacaagaaatacaggtagcataacgtgttccagataatctatgccataacgtcccgatacatccaataggtactaaaaaagtttcaggaaatgattggtcagaattttatacatgataccatgatggaaggatatgcataggtgttgatgtgatctgtagaatttaccttcctgatcaccgttcttaagttatcctctttagcaggcaacaggcaagcaagcttgatcaaatccggtagacactcagtgtgcatccattcaaatgctgaccactctgtgtcacctctgtcaagtgtcccaggacacaattagttgatagaagataaataaactctgatggttcgattaaattgatcgtgcaataaacatcctaattttgaccactgatataactaaacctatctagattagccattcgaaaatgatgccactgcatatactttgaagatatcatgtttttacaagttccttcatgtgcataactgctgaaaataatgatcaaatatacactttggagaccgttcaatttcaaaaacgtcatacatttaagaagagagggagtagtaaagttttcacacaatattacagaggaagacaacttacgctgcatacagttttaggcaggattttgagaagtagctttctggcatagtgcctgtagaaggatcagcagcaaacgggcaagtagatatagctttctggtgaataaatggtagcaactcggtcaacatgcggaggaggacatcaatgttccaacgctcttgctctcctaaaacacggagatgagagtctattgcaccttcaacccctgaaacgggcggacagcgctgaagcataacaattgtgtcagaacacatgtggcacttcaaagaaactataaggttcccaaaatttacaaacatgtatacctgagcggatgccaggatatgtgccagtaagattctcaatatctgatccagtttatctccccatcttacaacagcaggaacaagttccttgagagcaacattcacaacagcccccgaagggtcacagaccaactggaacattagctcctcaacctaccaaacaaacaggaaattaagaggacttccaaaataagtattatgtttcattgatttgtagcgcagcaagctttcaatcaaaacatatattctccactaaaaaaaggaagttctgacgggttaaatttaactaattataagaaaccaaatttcccagttattggctctaagcatttgcaggacttaccttataatatttatccagatttggaaacagaggaagcagcaatgtgaggttatgtgttgcagcttcccttacaaccgttgcagaatcttcaacaagttgttgcacaatggataagataagggaatcacgtatctcaggacgaacatatactgctaattctccacaggactgggcaacaagcaacctacgctcctcatattggtgatttatctaaacatcaaccaatttagcattatgtaatattatatacctaaaaaggttaaaatatctgccacaaattgtcaaatacctgttcccaacattgtggaagtaactcagtttctgtcctcatctcacctacactcttagcaagctccacacaagcctgcgtgaagaggaaaacagttatgtgaataaccacaatttaacctagtactataagtttgcaagctgcatcatgagaagtgcatgtgccatgcaccaattattgcaattgtaggaacttacatccattatgatgcgtctctgttgtccatcaggacgtttgattagattgaacaacgtatgagttaaggaatcacgtacatcactatctggatgtttttctatggcacagatgatcaacggaagaagctcctacaacagtgcagcaagtaacataagttatacttatataaagattgaaacaaactacaagggttacaggtaaacctcacgatggtttataagcacataaggaacaatctttggaagagcatccgaaactattttgatagtctccaaagcctgcatggttggataaaaatagtttgcttaatgaaatttgcaaagaaataaatgtgaaaacttcatacagaccgaatatatatcaagtcactaaccatcttatctgatgatttttgtttataaggactctctactttctcggtatgaactttatcgtcagttagataaacagatatgctatctgaatccccctggctattaccagatccatgcagattgccattgacagataaatcttcaaagcaagtgtttgtgccagatttatcttctcctgaagtgccatagccactgttctcagcagttgagcaggaaacttctgcttctggacctggggaaccttcaaggctactttccatattttcatgatctttctttttaccctcagctagactcacctccgatgctagcttacttgttatggattcggatccttttagattgtcatgttcactgctcagcactactatttcttccatagaattggcaggaattaaaccatcagtatctccagaagataatcgtttacttgacctagtcccttcaatatgcatcttaagggacgtaatttcagctctacaatcattcaactccttcctctggacatccaatgattgcttcaagtcttgaacctttcttaaaatgtcagtgtagcaatgttcagaagaattgaagtataagataactgggttatttctgagagatcattaccgttttctccttctcttttatgtccttgtgtgcagcttccaaagactttcttaaagcagcaatctgactattagccacttccctgctctttatcaaagcatctttttcagcaccaagactttcattgtccttcagtagcgtctcattttcgcggagaatagaaatcttttcctgtgatatgtaataaaagtgatgacttaagaatatatggaagttatgggcttgcaaggaaaaacagagtctttaatgctcagtcatgtacttctgtggtgcctgttttcccaattacgaagaatgaccaagtgatcctaatcacgttggaccatgatacaagtcttggataagaatctaaaatgcactagaaacccccaggtttatgattgttactgcaataacatctagggctagtcaaatattgtgatacctcaaaatggtcacagaaaaatgttaaacatatcaaatgcatcgaatgctaaatcctgctacttattgattctcgaaaatcaattttaaaatactcttgcactgcactttatgaaatgaacattgactcatggcttatgcagcggttttatttcattttgtgtcactataactggattgcacattgttcatgaataagataaatgtgtcaactatatgcatactccatagaatgtaattattactaaacttgaatatgatgtaggcccttcctattagcacgttacttggattctgtcaaaggattgcatgaagcatatgatctagttaccacaaatttccagcccttttcattgaagtatgttggtaaggaaaagattcattccaatatgatttggagtaaatataatgtgtattcttagcacacattgatggaattaaaaacaaacatgtaccaggatctaatattgtcgcatgtaacactgtaatgcatcaagctgtagtcagtaaacaattagcagcttttgtaggaacattaagcaactccatggaatcacctctgcagcctctgtggtagatgaaagatactgatagtagtaacgacgaagggcatcaggcacacaagctgaactgttaatccaaacatcaaggtcctgatcaggaacctgcaatcagaatgatctagtaagctttacgaaggtcgtcaggcacacaagctgaactgttcattctactgttttgtttgattcataattgatttgccagcactttttactgttggaactttgaagcacttatgggacccacctagtgttcattccacagaatgaagcttctactaattatgcctatcaaattttcaagggataggtatgtgtgaacagatctgtagaaattacatttggcgatatgcaaacttcatttgaaaatttacaaccatgaaataaggctgggaaaggatcatccatatatgttcttttaaaagataactttctgtacatacattcccatgaattttttgtgatgctactagatacacatcctatcaaccatgaacagaatttgcatgaatttattttgttgagaaaaggacgtgactttgacgtgaagttccataattttgactttttgcatgagaaacagataaacaaaccctaataaacttaacaacaagaggaagccatgaaagaataataaattctaagagaaaatatgatacagacctcctcaatgaaagtcatggctgcaagtcgatacccagccaaaagcaagtattctttgacagcacagttcagatctttccgttcattatccttaagaggacctaatgttgaaattttggcatcccttttgtcatgatggctagatccttcatttgtcaaagcatctgaaagaggcccagcatgccaaatggataaatcatcttacaagcacaagataggtctagcatggatttgttttcatggaaactttttcagcttcttaagctcacataatcaacaaattaacataaataaatacatgcatattgtaggtcaaaaaatcatacaaggatctatgttccagtgccagtagatttacatttagcagtacatagttactagcataactcaaactgtgcactctccagctggtatgtgtgccctgatattgatcattacctcataattaaggtacagtgcaaaaaatgctaaaaagtacaatttattgtctcaaaaaccagttaaaagctatgatgcgcgctgtcagtaggacctcccctcttatatatgtatgtctatcagttagcaatgaacacgatgaatgatgactcactttgaattatctagtaaaagctagataattagatgtcaccaataaatctgcagcagagcgctcaccgcaagctagtggcccttgaagaggcaagtgttttacttaaaagtaactagaatatctcaagcttgtttgtggaaaactgatcaaagccaatgcatcagttctgttcaaccttattgaattgttgagtgtaaaagttcctacagatacccccagcataagccacattaatgcttataaccttcaaatcagacctgtcttttgtttatttcctgttaccctttatgtccatggtacttcttcttatttcctttaaaccatatagcctccagctgacaagcaaatgccatgacaacaaggacaatattgttcaatacaatcccaattcccaaagatcactgagataaacaccctctcgcgtatcacagccatatttcatcctcacatgagatggaattttcaaagttcaatatgtaagccacagaataatgagataattttcacttttggcacttatctgagtaccaaatgctttaactattgattccacttcaatcaaagaatgtaaaaacagaaaacaatagtttttgctccatgccatcacatgaaacacaatatcacgctatatttgtcatttcaaggttacataccggtagcatttgagccatcaggagaagattctttctgcttttgtaactcaagcttcaacctggaaagatcttctctggctagccggagatcataatcagtgagggccaacttttcttctgccgctattttctcttccagcaagctctgtggatcagcacctgtcaataaaaacatagagataatcacctcacagactcaatgacagatgttagaacattagattgaacacaaacaccgcatctagtgtacatggataagcttgcacaaaaaagtgagtagattgttgagttataccaagaacagacccaaacatttacctgtaatttatttgttctgatagcattgcttggcccataatccatatgctactcaattttaatgatattattaagtagttgcaaacggtgacataaacaatgaaactgccacgccttgtgtggtctaagtaaatttaattgtactgttcaaattaataatgccccttcaactgcgaagtaactaaccaaccaaatcgtctgtagaatgtaagtcgagcaccaaggcacatacacctaacataccaacaacaagatgaattcaacagcgccaattcggacgtaatgcagggatattatgaacataatggcaacacaggaagcagggagcgccactacgccgcgagatccagccagctgaggaaaagggttgggggggaagggggggtgcaaatgcgggggacgcaggggctcaccgggcggcgcggaggacgcgcgggcgacgaggtcgggcgggaacagcgcggggtcggagaagaaggagcggaggcggagcgcgtgcgcgtggcggccgtcctcctgcagctcctgcaacagctcgagcgccgtgaggtggtacctctcctccagcaggaagttcaccacgcagttgcacagcgacgcccaccgctcctcccccgcccccgcccccgtcgcctccatcacctcgggatctggtggtggtggcggtcgccggcgccccacccggtcaatcagccgccggcgacgaggcgcgctcccgccgcatgcggtggtcggtggatctcgagagaggccggtgggtcgggtcggaaactcggacgagacgagagaggcgaaggcgtgtgatttttggaagggaagagaggaggaagaaagaggaggagatcgacggagaggatcgaggcgcgcgctgacgtcagctcggctacagaccgctggtgtgtctgatgtggacacgttgcaaatttcaaatgggccgaaatgacgaaggcccatcaggtgccggcccatataaagcccggcccttccttccacctgctagtaatctcacgaacccttgcgccgtcggtctctctctctcgctctcgtccccgccgcggcgccgccctgctctccccctagggtttgatttgatcccatcctactctctcgtggtccgcggccggattgtgcgagctccgatcggagtgtgtcttaccggtggtttcttgtgtagtgccgctgcgatttcggagggccggtagtccggcggcaaggaaggaggcggggcgcgatgaggttggagaagtgctggttctgctcctccaccatctaccccggccacggcatccagttcgtccgcaacgacgccaaggttcgcgcggtcatcctgccttttgctctttctttctcattttcatgtacagtatgttacgttttacggtggagaagcgcgcccttctgtgctcgggttttcttgaggaagaaattatcctttctaggatgctacagaatttgaatacagcagtccctgaagggatttaggtaccacggttgtacttgcttagaccaatctgtgtgtgttttgtagtactttgcagcattttttgtttgcagtatgtgaccctcattgtgtagtcacacctcgcattgcctgcccatgtcattagcgttgaaactaacgcctaaactacacaaaccaacaaagatatattggtctggaagggttgaagaatagaagctagaaagacagaaggaatttagaatttgtaaaacgttgggatgaatgtaacagctgtgggctcaattttcagaagaacaagagttagggcagaatgcagatttatgtaacccaaaaaatatgattatcaaactacaagatttgttgttacctaaacacctcagttttcattgccatagtatttataaacaaatatatggttatccaacccatggtggccctactgcatgtgtcactggctctctctctctccatctcttttgctttgttcagagtctcagagagctagttgtcccatttccacccaatgtatagagtagtccaatggtggtatatacttcttcactttcttccacacctatgtttatccatccaatttaacaatgtactgtgtcatgttcctgtcttttttcttgtttttcatagtaccaatgaattaactggagtagtggacaaaataatcgttgttaaatttattactttgacacatatgtttctcattcagtatttttctcctgctttatggttttaatagtggtggatgctaaaagctgaggtctgttggataacaacgctgctttcgtccaaaataagctgctagaacatatgaattttttagaccatattatagtaaaagtaattacattaattatgtcagtcatcaaagagatgtgggccgctagattctcctgctggttccattatattaattattgcactcccaaatggactgaaatgctatgtcatttttctcaaatcggaatcatcacaaaatatcaactcaagagacaaaatatcaacacaagagatgattgagaggagaggaaggagcgagtgggaggccaccactgcccctcgtcgcctcgctgccgtggaggtcccgagctcggggccagatcctgagccaccgctccatcgggaagatgctgcgccactgaggatccaccgcgcagccgctgtgccggggagcagctgacccgccaagcggccagggagccgtcgacctgccatgccgccgggagccatcgacccaccggatctggcgaggagcggggcggcggcaccctgatgagaaggaaagggagcggtgagatgctggtgggggagcaactccccctgccacctcccgccccctctcccccactacctctagttgtggccgcagccgcttctcgccccaccgcaaagccggcaggtgaagaagctaaggaggaagccctctcggccgtcattggccctagcgccggcggcaaagtgactggggaggattggtcgcggtggagcacatcctcgcctctcccggccatggtggctgccgtcgttggcgagcctctcgagaggaggaggtgcgcatgaacggagagtaggaggatggacgtagcaggaagggggagggaagagccggattgaggagggggaggaagatgcgagaaagagagagaacgatggagaaaacgagaataggagagaaagaacgacaaaggggatcgatatgagggatccctcgatctgatccgatctggtgaccttatctggacttagttttttactatgaaaaaaccgaccggtctattttaaagaaaaacatgaaaaccgaataagtgaaccaactggtgaggccataaattttgcaaaagcaccactcatcttttaaattttagagcgcagtccaatttttgcaatttcttctcccccaaatatacctatataccaaattaaaaaatttaggtccttatctatatatatctctatctctactacttaaaaaattgaaaacgtttccgtcatccgcaatagcgagaaaagggcaaaaaaaacatgaaaaaaaaggaaagtccgattcaatctatctaaaattttccaccgcacgtgcgatcgatggcaaaaaatgagtctgcatcaaattcaagaacacaagaaaacactaagaaaacgctgacgccgaaaggggagggtgccgccgaaccgccaccgccattgcagggatgtcgggccgccggctgctcccctcccactggatccggtggaaggggccgctgggacgctgggccgccaccacctcccctcctggatccgtcggaggggaaagcgccgcccgccaccgtcgagccctcccgcggccccatggcgagggagaggaggtgagggtggagaggcgccgctgcctgcggaaggagagccgcctcccctcccgttagatccggcggaggtgagggagctgcccctgcctgccgtctccctcccaccggaagggagggcgcagcccctacctgccgcctccatctcccgccggaagggaagagggggagatagagcggtgccgccggtggggttgggaaaggaggagaggcggagggggagaggcgccgccgccaccgttgagagagaagggggaggggaaatgtttttagggttagggttgggctgttgaacttttatataggtcgggatcaatcaggaccgtccatcagatcgtatggctacagcttctcccgcgtcgggccaaatgccactcccaggccgccacatggaataagttcactttaggtcccttaagttgtcccgattctattcctaggccgcccacactattgggccgcctcatggaccgcgtttacgctccgtatgaaataagttcactttaggtccctttagttgaactttttttatttcattcattttgatctagagaaatgaatattgctgccttatttctcgtgtttcatagtaggggggcagaggggtagttagggcttgagccctatgccttgctccataatccccattataatcttatgaaaatgctctgtaatttgtgataatatttgagctcctgttagctgaacgcatgaagattttctggctccaccagtagcaatgaatttaagtggacatgaacaaccattgttaaatttgatgcctatgtttctcattcagtccttttctcttatattttatggttggaatagtgatggatgcctaaagctgggcctttctgaatatcaacactgttctctttcaaaataagccacaagaacatatgaattcttttacacaatatataagtaaaatcaattaaattaattatgtcagtaacaaacattttgtcggtatgctgtaacaacattttttttgtcggttataggaatgtaacattttttttcccttgcagatcttcccttgcattcctataacaagctggattttgtcggtatgctgtaacaacattttttttcccttgcagatcttccgcttttgccggtcaaaatgccataaaaattttaagatgaagaggaatcctcgtaaggttaaatggacaaaagcatacagatgcttgcatgggaaggacatgacgcaggtatttgcttgttctattttcgttcagtattaagtagagagcacattttctatgctgtgaaccactttctatgctgtgaaccacatctgaatcgtttgaaatcaggactccacctttgagtttgagaggaagaggaacagaccagagcgctatgaccggaatgtcactgcacaaactcttaaggctatccctcttattacaaagattagacatgaacgccataaaaaacatattacagagaggttggcatctgttcttttggctcagtctgttaattcttgaaattatctctttgcttaacatatgcactgaacttttaacaggcaaaaacagggtaagacaaagcaaagggagagagatgctaaggagttggaacaggatattcaaatgctcccgaagaaggataccatgctgtcaacacaaaagacaaaggtcgtggtcaaagtttctcagcagcagaccgaagaaaatcttatggaagagtaatgaaatggaatcatgttgcatgcgctctcattttgtcatctttatgcaacacttgtgtttctaattgttactttgcaagttgtatttgactgattaccagcaagttttgcacgtactgtgtgcctgtgtgctttgtgacttccatctatatttgagccttgggcctagtaatggtgtctgtgcggacttgcgctaagcccaaggtggtgtgcaccctagggctaaccctaggatatctctaatcatatttattttatttagtagccattattgtttagagttggattttgcttagattattatgccaaatataatttcgcagctaattcgatttgtagaactccaacttcaagtgcctaatcatttatttgcaattgaggtgtcatgtaccatggtgctgcaatcgctggattgtgtgtgtaagtgtttgccaaatcgatttttatccccacctaatggaagatcgggtagcccgttgtcatcaataatctaagaactcaacctttttttatcagatctagaggaattccttcacatctattctaccatcctctatgcagctggcgcaacgacaacgttttggtaaactacctatccactacattgaaaggccctgcctgctcatggctcatgcatcttcccaaatcttcgattggatcatgggcaaagctctatcaattcgtggccaattttgccaatttcaccaatttccagggcacatacaagaggcatccaaatcgaggatgaccaccatgcaacaagacagagaaacggtgaaccccttatagcaagttcaatagtatagcctggctccaaatcatctatagccaatctaatagcccattcatacaatagttacctataaaaatatacgacatcattaatatccggtcctatctctcatacactcataacgtattgcagccggctacaaatctgtagcccgctttcttctctcttttctcttttcttctcgatacgtggttatagctggcttatagcctgctattgtacctgctcttagggacttcatacaacgctttaatgagtgccatagcactattcccaaaatcaccaaagccttcatcaacacggaagagttatcatcactcaaatatggagtccaagatcgttataccatccaagagaacatggaagaaaacttcagcaatgaagttgttcaaaatcactgataactcatgcagacgaggttgactaacaaaactaaaaggaagatgtctgacgagaagttactcgccaagaaagaagaatctggaactagaaagacgctagaacaatccagaaagcggaacaaatagcacaagccaaaaggagaggtcctcgttgtacagcgagaaccacaatattttctaactccgcgagatcctggttcctgaactccatgtgttcctgtgagaaagagtggaaatatctctatgcattctttaaatgattcagcctttaaccacatggcaagacgaacttttgatcatcaatttgggggcaaaatttggaacggaatcatttcttaacactacttaataaagaatatgagaacatccaagtctctctacactggtgatgaaagaagaatacaggttcaagagaagattctacacagactgaagcatgttggcaccatgcttgcatcaattcaccccctgtcaatcctggccttgaccaacccagaagctcagccacttcacctttggtccagagcaccaaaatttttatgagattatatgatccttctacctcatcttaacaaggaagatgggcatatctctgcttaccaaagttgtgtcttctccctgatcatgtttgaaatgggctgccaacccatcagccatggcttcctacttgcagggactgcaaaattgagctcaaacatctccttgctgatgttaccaccctcacagaaaccaaccagcctggccactatatcggcgctctcatcaatgtgagcttggtcattggggtctgtccagagcctgttcacaagctggagcttccgctgcttcgcctccaggggcacctgccatttgatgaagaggcgctctcgctcttcttctgtcagccttgagcccatccttctcgcgaggaattctcgctcattcctcaatgccttgatactgcaacatgaaatcagataattggtttatatatcacgattcgatatcagttatgactaatgaaacatttgactcggaaaaacattcatgttaaggcttttctatcagataactaagctccatcttcactatcaacatataaggtttctcagtaagtgttcttttacagaggataaaactactgtgagaaaacagattacaaggttttgcttccagcaacatccattttaaaggcctaggggacatgactcttttttagaccttccaacactattttctttttctggaattaactaacatagcccgtaaaactcaaagaagtaaaggctaatatttaccttgaggctaaagaaattgtggagtcatcaccagctgcaggacttgcatcgcccacctcagcaaaatgctgttgcaaccatgtcagtcttctaacttcgacttcaatatatatctgatcagccctatcccccctgaataataagtagaactgggtcctgtgtatgattgatacatgacagagatcccacagttggataatgtgctgcatctgctccttaaataatctgtcccatgaatcaggaccatcctgtagagatcctgcattttcctctgaatcttcttccatgtcatttgtcttgccttcattcgattccaactccaagacctgtagtaagattacaagaaaacatattttagtggtgaaacaaagtaacctttgcatgaacaaaacttatgtgtgcaagataaacgatcataacctgacagacaagcagctgcttttggtattgaagttttgcaactctctccttcagttcagtgacataagcccggatatttctaacattctcctcagcagcattttggaacatcttctgcatctttttcatgttcactgagctggatcgcctatagcgtggggtttcatcacgcgatgatacatctccagtgtcttcactcttagtaggagtagccctttctgaaccttcatgagacacagtgtcaccctctggagccctattctcaacttctggctctaaaggcctactagaagagaggggagagcatggtgctcttatcagatttggtctgtttatgttgctcacgcccagtggaagaagcatcctcttcttcttctttgctctgttggactttggtgtagtctcgttacattgtgtgccaacatttggaagtgacatcaccaatctatcaatagacctctgtacattttctagtttagcctcaagttttgcaatatcattgtcttgcatatgaagtctactaatttcttctttcaaatcagatccatttccttcatctgtgatcatgtcaacatctctgtcagatctgacagattgcatccccctgatttcagcctgtagtttagcaatagtttctgctgcatcttgattgccatgtttatggcattcgacttctttgtgcagtacttcaatagctcggttagcctcaacctcaagctgctgttgtagctgctcaagcttgcgaatttcatgctttaacataaatggagcagtggctgattgtctaatcgagctccgtatcttcattttgttacttggctgtagtgatccagaatatgtgaggcatttccgtgtcctttgtggtgagtcaaaaggattccatccctaaaagaaaacatgggtttcggaaagattaggttgacagtaaatgaatgtggttctgactggctgatatcctttgaaagaaaagtaaatttgcaaggaaagggcaaatactcactggctgattatcacccatcttcttctgtaattcttcaagtttcaactgtgcattgtctctttgcttcttgagttcctccatttctttttccatctgcagtgttcacttaattaggtcagttacaaaatggaaatgattccagtgaacttcatccttgagcatagacattacctgtctaatcttcctgtccctttccattataatgatctcagaagaggaggcacgatcaggggttctcagctcagcttcgagtctagcaacttccatctgtaggtgcttcaccaattgcttatctgataccacctgtacgtaccaaggcccaagggatgaagatttgcattctcataagtaaataaatgatgcatcacagtcacagatcttaccatattaacttttgcattattcgtaacctccttggcacaggttgcaaagaatagagtatttctagattgttctacatgtgtttgcgctggactcatggtacagatgatggctgttcttgcatttccacccaaagaaagctggagaatgcgtgtcaacttcgagtctcgatagggtatgtgtccacttcttttatccgagctgcattgaaaatttagagtcagtctgctaatattcccaataaagatatacttcattatagtttcctgttcaaaccaagaaacggtaaaaatacaaatatgcagtaaattatctaagtagaaaagaggtctcaaactgtgtattagcatgacactgcaaataaattatctagtttaacgtgttcatgacactgcaaataaattgtctagtttaacatgttcatgacactgcaaatacacaatgctgcttattagtcctgccataccaatgtcacttagccaacacattcaagaacttacaattaactgtgttgcagctatgagattttaataaaactcactttagttctaaatatgcagaatgattaaacagtatagtggcaataggacagagtacagagcaattgcctcccacttaaacaaagtggcctgggaatattttgatctgatgaatctcattagcatgttttagaaattcattaggagataagatacatcattaacatactgatatcattacaaatcaacagataacattagaactgagactaacccatgagtgcatcgaggtaactcagcgactactttcaagattggtgcagataagagataatagacccagagttttttctttctttctttagaaaatcataccttagctttctgatgacagtagtaagagtcagtaagctgcgatttatatggcagccttctttcagtcttgcgccaactgcatgtgtttgtgcagctcgttcacttccagcaagatcaacaaaattctgtgaaaaagcaacacatattattgagattaaaaaaacagcatgtacaccattgcaaaatgaggacgttatgcttaccagattagccacaaaagatttaacacatcctgacacttcacggagcctactctcaactgtctggatagagataatgcacaataattatttttctcactttcatgaaaaagatctaacataaacatggaggcttatttttatatataccagcctaatgatctggtgggaacgtgaactggtgtcatttagtgcagtctccccaacctgtctttgttctgcagtcataaagacatcataagcaataggctaccgcgtcaacaaaaaaaaaagtaaataaggcaacccatttcttctggttcttcttgaaaaaataagttaagacaatatatacagatagtagttaccttcacaaatactgattagatgcctaagatgttggctatccttggcaatttcttcttccagtttttctacaattgttcctttctgtcaaaccataacaatttattaaaggataatcatggcatgcaagagaatatgtgggggcagtgcatagactctgtcgaactggaaacaaacctcaggatcatctaacaagcgaagattggtagactcaggtcgtagaagatccttcacaatctcattgtaaatttccatagcagatatcttgatgataaagtccctctcaggagtctatgcaatcaacaaaagcaagaaacaattatgtgttatgtgcattttagaaagcaatatagatagcatgattttgttgctccatgtataaaaaaactcacattttctatgtgcctgtatatatcatttacagcactctctgtgacgcctctcatggtgaatgtcttaccactgctggtttgaccataggcaaaaatggtggctgcaaaacaaaggaaggtaaagaataaagagtagataaaggatcattcaactttattcaaactactgagtgagaattaatttaccattaatgcctgtcaatgcagacatagcaacatccttagctccctcttcatacaccacttctgtctgggaagctggtccaaacaccttgtctggaagggtaagatggaatttaaattagtcaatttagctactgaggtaacttcaaacttataggattgagatatgaagtcattgatcaagagtgtcactacaaacataattgcttgagatatgcagtcatgaatagatcactgaaaagcctaccgaaagtgtaagaggtgggtgcagcccgatcctgtggggggcccttgtacaaaattgtctggttatcatcgcactcccatgccacctgatccttcaaggccagttctttcttgctcaatggtcgcaccctcactgtgacaaaaatcttctcctccttgaccctagtgctgccaccaggggttggggtcgacatcggtgtgcgctcaatctttgatgcaggggtgcttggaggtcttgatacacccattttcgctagtaaattgcagattccttgaagtctggggaaaacagcaagaacccagccttctcacgaagctggcacaaggcaaaaaatggtcagattcaatttatcacacagttgcacataatattggcaaacaattccgggaagatagctctgcagcaacaatgtgctgacctagccaacacaactatttcactattacaaaggaaataaattacatagtcaacacacaaatatttcatttattacaaacggagtaaattgcatgttttacttcaccattatgagtagtattacaaggagatctattaccaccattaatgttaaattttaaaatgaaaaacgaatgaatggacggcactaaacaaggcaagcacatctgcacatgtgcgggtgttttttcctaaaattatagcgtggggcgaaaattactcaatttcatacataaagctgtgccaataagatgtaatcttcataagaagaaatgtgttatctgcatcgctcgggtcacattcagatacaccccaatctaaattacgaaatggtaccgaattcaaaaacttcggatcccctctccccacctccaaaaaaaaccccacaatttcagattagggccatgggccgagaaaaacacgcaaagcaaaattggtaagaaataaaatgagagggagacgaagtgtattaatatttggaaagctcaatctagcaagtagataccgatcttaaaaaaaatctagcaagtatattcatgtatggaaattgcaatctggtaaactgagttcacaaacaaaaaattccacgagttagcgccaaaataaacagcattcctttcatggacgaacccgccctgtaacctccgagcggcaaacccgaccaacttccgttctccatccgccgcgccgcgcgaacgcacgggaggccacagcggcagatcggccggttccgccgccgccagcatctgcaccccccctccttacggactcaccacctctcggctactccgtcgggcccggcgggaaaacggcgccggccgcaggcagagcagaaccagggggctcggaagagagggagacgcacggggacaagcagaagcagctgaggaaaaccactcaccagcgcagcccggggattggggatccgaccgcgcaacccgccgatcgaggccactgccgctgcctgctgccgccgagagccgccgccggcggtgggcgcgcgcccgacgacgaggaggcggaggcggaggagcttctcgccgtcgctggtcaagggcggcgcgtgcgatgcgccgctcaaccaccgctcgctagtgctagcgctagtactactacgtagtacagtttgaattctctccggctcggtgtgcgtttcagcgttcgtttgtaggggagagagagatagagagagaaaataaaaagaaaaataaatcgagggggagcggagcgagcggggtgacccgtgcgatgtgtgggggagaggccgagtgaggccgcaacggctagttttggaaaggggcatccgaagcgccagtttctccggggggacgtgcggctggcaggtgggccatggggcggagttcggtcgtcggacccaccagtcggtgactggtgtattatggtatgctttgatttcaggtgtttttgtgggggggttttgctgctagctggcatcggtagggttacacagtagagtggactagacttggtttaaattcactagcattgtttttttttggcatacatggctagtgttatcagatgcaatggacatataaagtttgtagtcttttggattgtatatctactactattaatgtactgatttcttatatattttgaataatttgacggtttctttttattttaaatggttcaatcgtttcttttcatttccaacggctataattactaggattttgaatttgtcaccgttttgttcagtgatttgtgcttgtgacacatcgggccacatgtgctcagacgagtttatttagctttcgtgggctctagctagatccctagccaatgtgggctcgtgggttgtatttcgattgagctgactaggtgtgggcctatgtcaatggttttgtgttgatcgatggccattcgattttgctttagggtccgtgctgagactcgtagtcaacatgaggctcatgtttcactatttccgtgcctatctttttgtttcgttgatgttgagaaaaaaaaggacatacttctttttctttctagtgttgagtaggtccttttgagcatttttctcttgtgttgctcttataagttcttttttcctagatatgcctatttgcaagcatgtgattgattcatgagagggcaatctacggcgcttctccagttagtgtttctatgttattttgtgtgtgatttgaaggtaatgggaagagctcgcattgttgtgctcgtgttgatgattctccgagtttgaatcgattggtatttagcgagttgcgcttttcccttatcgatttgaattgttagctgcgagtttgacaggattaacgtttactcatcaagtctaaagtggtttgatccactattctaggtatatctctatgtacctaagttaaactaagagacgacttgtgaattgatacggtgttctggtgtggttgatgattcagtgttctgatgtagcctgtgtgctatagttaagaggcatttgctgattaattattggtatttcttaacgacattagcagaaatataattcccaataatggcgcagaaatactcttggtatattatgattacagagttcatccgcaagcgcacggatataccattgtagcatttcacccgagagtattccaagggtatcatatttatttaatcccatgggaagatcatagtagagagaacctgactaataatttatatgttacttgtaataatcatagtctaagcagggattaagataaatccaagggtagagtgacacataagtaggaagctactcattctcatactataatatctaaactaagtggaaagaaaatagaaagagaatatattcctatacttctaatatacatagtttacatacatcctagttatctgacatactagctaataccctatatccgatgccctcctgggactttgagaagccacccctgacttccgagttccttacgacagcccatcatgactatacaaccggggctaaatacgaaggagtatcatccccaggaaattaacttaggattatatacatatgcggaggattaccgtactgagctgtcaccatcaacggcccacctctcatccgcagcatataaccccaaataatgatatcccataatctagacaccacgcctaaactaccagatattactctaatatcatcgtcatgacatatagtaattgcataagcaaacactacacacgtaccaaagcatctcctagataagctagcagtataatcagtataacatgaacatagtgtaaatttggcattcatatacttggaaagtattccaataccataaatgtataaagaagagtattctaataaaagtacaaagcttacaaaagagaacagaagagctactagagccatacccgaactcttccgaaggcttctggactccgatttctactctattcctattccactagcttgagaacactaaactaacttgagagaatatgagagaactcttgcttgaggtgtatgtacagagtgaggaagtgaagtccttttatagcctcccaatgacggttatggcagttggaatggtcggaaatactttctaaccatcattggggagcaatcctggacgtccacgccaaaccctgcatccaacggagcagatgagggttcggccgaaccccctggttctgccgaaccatgggctggtccaatccaacccattttcggctggtagcctcctagacttctcctctctgcagacttgtgaattttggcccaattggtcgtgccatttctgagttcttggcacattcatacataagtccgatcctcaacatcgtccgattgatttatcgtctggtttgatgttgattcctctccattttatggttattctccgcaaaaggttagtgatccaaatactagttgtcagggttatggataccacatacctaatagtagttgactaaatctcggcaggatccaccacataccatgtcctatacggaaacaacctgcggatataggaggagttccggataagaaaagacaaccagagttctacatggaaacgacaaggactactcggattgtatccattttggtttccctagttctacttggacaaggggacacctatgggtataaatacaagcccccctaggaggagagggaggacaatcaacacatgaccacctcaatcaacatacacagaagatcaacatccaacacaatcaacatagaagcctagatacgccaagacacgccgccggatatcgacttcagggtaagcacggctagtaccctacggtatctccggatactgtcaggagagacgaaagcgctatctttgatctcgccgggcacggattcgaggagaaaggctaccctgttgtcgactacgagtcagatcgtcagaccgccatgtcgacaacagttagataggctaccccaaacattgtactggtgtggttatcatgaataagagcaataacggcttcggccaacaggatgtagggttattacctgacaattcaggggcccgaacctgtataaaaatccctgtccccatctcttttacctcagtctcgcatatatcctagcaccgacgatcccca

SEQ ID NO: 59054 - DNA, 3967 bp, Oryza sativa
attcgtctcgcagttttcaggcagaatctgtaatttattttattatttatctatatttaatattttaaatatatacccgtatactaataaaatttggcatacgaagtaaccactgccgagatctaggaacaaaggggaaatggacatccggccggagattacgtgtgtgcatgcgcatgcgtgtgctgtcagctgccaatctggagtactccagctacaaacatgacaagttcatcatccatgacttgacgtacaacatgcacgcgcatgcatgtcagtctgtcgccaccaaattaccaggagactattttagcgattgcagtaaaaataaaccttggtgtgtttaattcacgctaaaattaaaaatttatttgaaattgaaacgatgtgacagaaaagttgaaagtttatgtgtagaaaagttttgatgtgataaaaaagttagaagtttgaagaaaaaatttgaaactaaacaagggccttatctaattttagcgatttcaaaattttaatataaattaataatattatcaaattttaacgagatttatcaaagttcagtaaaaatactaaatatatgtatatctttaatagccttgcttaaaaaaagatatgatttaaaatggcatcaatcttaataaccttaataacctctaggagtacgatagatcaactgtttatacagaagtatcgccatcgccgttggaacacgcacacgggcggccatcgcatcgcaacgacggtatcgcagcatggcaggtaacggtgtactccctcatgtttttttcttaaaaagaaaaagtaaaagtaaaatcttagggacaaatctatacacacatagacacacgtgtatctaaaaattatctataggatttaagttattttttaaacagagggagtaagtggcaaactcacaaaatctatttatatagactaaaataaatcacgaacccactactttgatctataaataagtttacaagttaatcatttaggccatatttagattacaccctaaaattttacgccctgtcacatcgaacgtttgaacacctgcatgaagtattaaatataggataaaaacaactaattgcacagattacgactaatttgcgagacgaatcttttaagcttaatttctgcataatttgacaatgtggtactacagtaaatatttggtaataacggattaattaggtttaataaattcgtttcgcggtttacttgatgaattctgtaattagtttttttattagtgcccaaacaccccatacaacactctatataatacccgatatgacacgtcaaaattttacacccctgatctaaacaaccccttacacgtacagcaagacgcattaaccagtgcgagtaccgagtattacttctgtttaaaataaaaaaaaatctaacacataaacttaattttacaacgagaggagtacgtttgtaggacgtgtgtagtatacgtatgtgttcaatccaaatggacaacggacgtttgctgggcttgttttgtattgtggcttgcatagcacagcacacaacacagccgccaaatggaacgcgtaaacggaagccttcgcggcaaagcaagaactacgaagcctctagatcgccggatcgatcgatccatcgcagccgtcggatcggatcggacgtgtccccctcctccttggccttgctggttacgccgcgctgtcgtccgcgtgacgacaccctccacgcaaaacggcgttcgccccccacggccccacccaccccacccttccttggaccccaccaccgcatcccctatgaacccatcaactctgtggccatcttaggatgtgttcatcacttccctaccatttttaactatacatattttcttttgtatttttaaaatttagtaagctatcaatcccaaacatatcataaactctctacaatatcttgccataacaatatttggtgatccagtctgtgtatttgtctaattacataacttggatcctctttactatatttatgaatggcgatataatagacaatacatattatatttttaaaataaaaatattaatgtgcaccatcgctagtcacatgctttaaagtaacgcttaggatatcgatatacctttcgatgaatatatttaatcattactcgcatagcatagccacatatattaggcgtgttcggaaggccaggccacatttgtggcagcagcagccacatgttagtctgatgcttgcagcactgttgccgttggttacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagccagatccaatctctccccggagaagatatgagctttgcctgtaaataggggtgatagttggcataattgtgtggtctttgtaaaattgataaaaaaaactagcccaaagtaaaaaaaattagataaaggatggtccaaaataaaacctaggtaagaaaaggtagaacaaaatggaaatcactcaaaccatatttttagaagcatttactaactaaaattctaatgtctaatgctagtatgtacttaaaagaaaatctttaataaacatttactaactaatatttcaaccgatagattttacggtcttatttaacatgactcaaaattgctaaatttaactttctagtagcatactctaaagtggagtgacttgaatcctgcttcatctctttaattaatcatcacccttttaggtgaggttgaaaccattttgttagccgttagctcttaaacagattaaccgtaaaagagatcctaagtagaaacagtaaaacaattagaaatagaaagggtttaccacatcactcactgtaaagatgtttgtaaacaagtttcttattacgtgtatcgaaatctacaaataaacaagtttgactattgtgttgtgtgcattccatctctagaggctagacgggcatgaggtcatacccagaatccaaggaccgtagtactagaccgcagaagatccagatctgggaagaaaagcagtgggaaagcaagccgtttccgcgttgaaacagatttcctcctctcctcttctctttcctctctctcctctccgcccaacccttgacttcccattctattccatctctctctctctctctctctctctctctctctcgatcgtcttctccacttcctcctcgcatttcccactagtgaggcggaggccatagccatggatcccttccaccacctcaactcctccttctccaacccctaccacccactcctcgcctccccgccccaccaattagcccccgacccactccccccacctcctcctccgccgccgccgccgctgctccccgccgacccgccgtcgctcgagcgggagcgcctcccgcagtggtcccacgccgagaccgccgccttcctcgccatccgcgccgacctcgaccactccttcctctccaccaagcgcaacaaggcgctctgggaggccgcctcggcgcgcctccacgccctcggcttcgccaggacccccgatcagtgcaagtccaagtggaagaatctcgtcacccggttcaagggcaccgagggcgccgccgccgtcgccgccgcggggacggatcagatgcagggggggcagggcggtggtgcggcggcgagggggtcgtcgtcgtcgttcccgttccatgatgagttgaggaggattttcgacgccagggttgagagggcgcgcgcattggagaggaagaaggttaaggggaaggatcctgatgatgaccacgacggtggtggtgatggggatgaggatgatgaggaggaggcggatcaccacgtcgacgaggaggacgacggggcgttcggggacacgacgagggc

SEQ ID NO: 59055 - DNA, 12618 bp, Oryza sativa
attcctgcagcccaatctatctttcatgaataaccagaaaaatactttgtgtttttttaacatatgaataaaatgttgctactaattcactaccttccctgcacgctgcctcccatcattccttgctagcatggctcgttccccgtgttagagtataagtgaattactaccatctttctttgcaattgccccttcttaattagtttaagctcttattttgaattagttgttaatacttatatttaactccatatgttatcggagtgaagtcccaaaatcacaaagaccaaaaccattcgcttttgagtaaattttagaaagagtaaattgctcccacggtacaacaacttggcatgtggatgcgatataatgcaagaacttgaaaattgaacgtccaagtgcaacaacttgacaagtgggtgcgttctagtataagaacttaacaatttagtatttttgtacatcaacttggctaagcatatacaaggtgagtttttttcacgatgtcaatatgccattacatagtaatcatatggatattgccttataagcacatagtagtacaatttacatccaattacctttaagattttttttgttttcttcatcttatcaaatatcaaccgaaatataataatttctacatatagtttaattggctttcagttattagttattatgataaaaatataaatacacttatcaaatctgtgaaatatgcgctagtatattgtcaaaattagtacttaaaaattgaatttataaaaaaaatgctccaaataatcaagttgtagcataactttttaatttactgtatcaaaatcgtacctaccttgcaagttgttgcatttatacgatcacttataaagttcttatactaaattgcacctacctaccaaattattgcactagaacgttcatttctcaactcaagttattgcactaaattgcacccacctgccaagttgatgcaccatggatgcaatttactcttttagaaaacttcgtgttgtatggtcaaagttgtagaaaccatatgtattatgacacgcggcatctaacctcaagtattgttgttttcaaagtttcacaaaactccacccttatgcattttgagcatgaatttacttaaaattaaaaaacgtagagtgcaaatgaaaatttaattattaagttattgactagattgatagaagctttactgtactttcaaaattttatttagatatgctgaaatttattaagatttaaataaagatggggttttatgaaacatggagaccataaatcttgtggtgtgccacacatcataattaatacatatggtttccacaactttaatcatacaatatggagttttctgaaatttactctttagttttggacaagggaataaattaaacggtttcaaaagttgaggagtctgtaatacccgatattaaagttaaggggtatattttagactaatacaatcttggcggggttaaatggacttaaacctttttaatgtactctatgcattttaatcctttttgttgttttatcattttaggtttgttcaaagtctatgtaacttaaaatggaatggagggagtaatagttttatagatatatactactcagtactcgtaaaggaagtcgttttggacagcgatacggtctccaaaacataactttaactttttatttttataaaatatttattgaaaagtgatatatgtatacttttatgaaagtatttttcaagataaatctattcatataatttttacatcttcaaactcaacaacttaagggttattcatgatttatattcctaatgtttgacttaaatattgtccaaaacgacttcctttacgagtacggagggagtatatctcgttccaattccgtattataaacgattgatcacacgtggaatatatacccaaagataaaaaaagccagtagtaagttattttaagtttttatttgcaataggctaatatatgtagacaagtgcatatccaattatccatgcatatatatcagcgtatgcacgtacagtggatttgggttcaggttgatgtgatggattgcaagcatgcatgcgtgtagcgcacaagatgctggtgcatcttgcccacaggcccaggagacctacatgcatggcccatccatgtttcagcacgcgggcaggacaagacgtagcagtagcacttatagttggccgaaaggcccggggtccaatggctcggcccatagtatggggttttggcccagcctaaacatggcacggtccgactggcagtgtcgggcccttgcgtgggcctcttcctcggcacgatgggccagtttggcatggtccggtccaacaatcaaggagttaaatagatgagcgagccaaaataaacttattccggctatataaggtatatatggcacaaatagctgcggcgcaaaatagacttaatctagccaatggcccaaatagatgaggaacgcaaaatataatttttttccaaggttgagcacggtgggccttcatgcattcaggctggtccggcacagcacgagtcatattggatcgtgcctaggccgatggtacagcaagtgggaggggtacgacgtggcctgacgcacttctctactattataaaaattgaagatgtttttgccggtactttgatacgtcattcgtgttttagtcggtttttaagtttattcgcttttgagaatacaaaaggagttgtataagaaatctctttaaaaaaacttgcatgaaacttgagaaaatcagactcctaactgcgggtcatgattttataaaaaagaaaatcgagcaaaatcgcacaatgaattttaccttagttaaacctataacaataataagattaacataacttcacccattgcaacacacgggtatttttttatagtagataaaagaagctattttccctttcgtaaaatacttaaattatattatgtttaataatgttgcacagtgaaggaggaatagcttatatgcatacaatgcataatctaccctataattcaccaactcactcttacacctacattactcattcatcaaatccaatggctcatattcatctaactgtgatcgaacgtgccagatgagaccccctcccctccgcgctcctcccccacgcggtcacgcccacgcgcggacgcgccttctctctctctcgctaactcctgttctcacgcgcccccttctctctcgcgcaccgctattctcgcccgttcccctcacccatcgccgccgcgattcttgcccctcgccaatcgccgccgtacccaatcaccaaacactaccccaccgccggcatgcccctgcccctcgcctatcgccgccgcgccgccgctccaaatccccaaaccctaccccgcccccagcactacgggttacggatgccaccgcacctcctccattgagacgagccaccatggaggccaccgtctttgctccccaccaggtcgccatcctggcactgccagcggtggaggcggaggcggccggcgccgctgcaccgggaggatggctatgaatggcatgagatcgatatccaaggtcggggctgtaatgaggaggtacacccatggaccctgccggaccggtgtgtgcggtggatgcgggcaaggagggaatcgcgcagctggtcaaggaaagatcccatctctctctgttaatcccgatctcctcatgagattgctcttgaggagagggagtacgtccctgaacttgattccttgcatcagttcatcccttctgttgaggctttgagtggctggggcttttgatgctatgtgctcttggtttgactcgatttttgctttgttttggtgcatgcagcaagatcatagagttgagcaggaatggaccagaagctatggctcgctaactggcatattgaacaggtaaattcccatatgctagcagtaagttttcccctaaattatatcccggaaacttcaatgtttagttgccaactgaaatctgtgtaatgagttattattcgtttcacgcattttgttggtgaaacttgcttattgcctcttttttgttctgcaggagcacaaccttaggagggatagagtcagatcatggctctctgatgattttgtaaatcctgttaagtaacttttttattgatggcatatttagcatgctgctgatctgtccccaattttttttccatgaagctaaaatcattgcaacatcagtttgcttgctcgagacctataatcatagccaaaatatcagaattggaggtttggagatgctcctatagtggctggaaattcatctggtcacggctggtaagttgaattattttctattgtgatttgccatctccagattaccctgctccttgcaataaatcaatctcccatggtattagatttttttctactcttccatcaataaaaatgatggcacatgattgctggagctgtataggtgaacgtcggcacacatgttcatacttcataccggcacaggggacattgcagaaaaaaaaagagaagtagatttcaggttcgatcgccactgcaccccagggtctcacgcatcgatctgcacgcttatttgtagtcaaactaatgcagctccaaagttttgatttgatttgctagatttagaaatagcttaacaaattgttctgttcaggtgtctcagcttctgcctttgtttcaaatgtgtttagctgttaaggaaaataggttaggcttcacttccgagattatgcactagtttagaaattttttacgatatgatagtcccagtttctgcctttgttacaaattggctgcccttccatatgaaggaatcacaaagtcaaaacactgttagattgaatggaaaaatcatttaatttttcgaaattcttctatttgttattacatggccttaattctagcagctaaaatcaagatcatcttgcttatcttatttgtcttttcatttctaacaaagctaatctcaaccaaatactccttttttggtaggacagatcgtctttctcgtgcccaaatgccgtcctcggtcttgctacgcagcccctccaaccgtgcaagtttggatcctctcgatggcggaggacgtcaggcggtgggagatggatctgctccccccgccgagtgcgtaggtccggtcctttccattattttccctgctctctttcttgatccaatttgtggagaatttgttgcgtgctcgacattattacatgcaacctgttctgtatatctggaattcttaggtgctgtttgttcctttcgtgtgtgattatgcgttggattgtcttctacaaccgcaggagaagctaggctgagaatcgctggtgagtggcagggaagaggaacgtttaattgcttagagtttcttggatgggagattctagagagatcgcagcaggtttataaaatgctatgatctagatgaataggtttcctgactattgttgttcatttaaaattgaaccaaatatgctgaaactattcactgaaaaaaggtcaaacagaagaattctactgtcacactgcactttcaaaagtgtttgttgatactggattttattctctttatgttccttcagtattttttcttatatatcagaattaaatagtttacaagaatatgagtgagaattattctccttctccttctcctgaaccacatcatatcattcttaattttcctgaaatgttgcatgcatcctatggtttttttggactgctttccgtggtgcctagctcttggtgctgtgcaatattgatgatttatgcgtcctgtgtattcgcagggtataatgaaatttgatctgaacatatgaaatttgacaaatgcatttccatgatccgaaaagtttatctgcagatttaacatagtattcatgtccattttacctttttcaactcatttacacgaacaaaattgcagccatgtaaaagcctagcgctttcagttaaaataaataatttattatcatttgctattaaatgcttaatgcctatatatttgctttgctacatatttttgccttagtagaaaccgggatgtttttccaaatattttgggagttaaattactaatgctaagtgatgaatatatctttataagcgtgtgcctcgtggtaggcgaatacactgtcttcaatatggtgcttctcctgatatgcgttcgatagagaagtttatgtggcttcttgaggtgctctataaggaggaaggtgaccagtgaggagcagaagttgctgaatgtttccaggcgatgcatgttttgaaaaaatagcacctgtagaacgtgcaggtaatatttgtatatgtggtatagaaagttagataccatgagctattgtttgtgttttgaaaagtttcactcacagtgatgaaaatattgcagaactctattcatggccaattttgggaagttattaacagtgtaataacattcatgagaacaatacaaatctctctatcgttattttattcgtgaatcttaaatattaccttttgccttttacattatcaattatcaccgttgcgtttcaatcaaaattatcaccgttgcgttagcacggacatattattactagtgtattagatatgccaataaatggaggtactacacaagcacttctgcacgaacttaattttattctcacacacatcgatcgatcgatctcacacagtcacactctcctctcacatctcacaacttttattattctgcaccaacaagctgacctggaaattaatcatgcaagaaccaaaaggattaaccaagccatgaaatcaaacaaaaaagcaagtgtggatattgatggaatggatgaattaaaaattcagctgtgatatgccggccggagggctgggagccggcgccgcagctccgccaccgtttgccgcgccaccaccgttcgccggcgtcggcttggggccttggggtctgttgtagaaatagtcgaagaaggggcacaggaacgccgaggtgcactccgccgacgacgagtagtgcatcctcttgccggcgacggcgacgaaggtgttagccttattgccgccgttgtccgtcgttgatggcagcggcacgatcttggacggctcctgcccggggcacggcgcgctgctcgccgcgctgtgcagctgcgcgaagcagccggcggcgccgtggaggtcgtcggcggcgaggggcacgctgaaggcgccgtcgccgtcgaggtcgccgacggccttgctctcgtactcgccgtcgctgttcttgcacttgatcgccacctggagacctgaacatcaccaaacaattaatcaacgacggtgatatatcgatcgcaattaattatcgatgaacatattatcatcatcatgcatgatatatatacccttgaaagcatcctgcgccttgatgttcttcctggagcagccgccgcacttggccaagccgacgacgagcgccaccgccgcctcgccgtccgcagcggcggtgacagccatcacgagggcggcgcagacgacgacggcgccgaggactagtgctcgtgctacagctgccattgctgaatgaatcctagcaaactcctccttgatatttggagtatcttactgctgtgtcgatgagggaagaagcagcagaggccatgcatggtttatataggcgtcagttaatcatattacgttccctcgaaagaaaaagctaattatattacaacatgatcagcaatttgcgcccaatttgcaggtttaaaatcattaacgccgtacatttgatcgatttaagagtagtgcactgtgaacgtgcacattgcatatgcagtgtttcacccttgatgctctgttgtttcccatcggtggtgtgtgtttagcaagcaaagttatgctttaatcgagtagtactcctgcagagcatagtactactaatctgttttatagaaaaggataatagtataggacagcttcaaccaaattgcatgattaagattctattgttctttcttatatatattgtgtgggttaatttggctcttgaatcatttgatgtttaaatttgtcggcatatacatgcctactagtatttggcagaagggatcacatatatatttatcgataaattttcttccaacgatttaataaatataattttaatacaatcgtggtgtaatttccatcataactttcatgtaactacaatataacttgtatgtaacttttaaaaatcccttcgaaacatgctatttccataaaatggacatcataggagtgaatcctctcacatgtgcatgcactgtaattttttcgcttgcacgaatcttgaaacgaatctaacaatttaaaatgatgtaaaagttacattgtaattacatacaagttacaatgtaactacactacataacaattacatatgtcaaatttttttaaaaaatttatcgataaatatataacaaattatttgcagaaatagtagcctgcagaagtttaagtaaattgttgttgtttgtctccgtctcttttaccgtatgttaaaaaagaacatagtcatgagtgtgtgagtatgatgtgtgtgcatgtggtgacggtgcgcatcttatctatataatgggaaaaaaaatcccttccttcgatcgaatccacctaagcaacctagtacattccagctagcatatctgcctgcatgcacgactctgacataggatggacctgaagcttatggctcgtttgcttccttggctaatttcatttttctaatgagcaaagctggccaatggcatatgcaagatttctatataggtgatatatatatatatatatatatatatatatatatatatatatatgtatatatatatatatatgtatatatatgtatatatgtatatatgtatatatatatatatatgtatgtatatatatatgtatatatgtatgtatgtgtgtgtgtatatatatatatatatatctcatagatataacaagagttacaagtataaattgatcaaaggtgcatcataatatagtaataagcactggtggagaagtgttttttagtcccgtttgtaaccccccttagtcccggttttccaaccaggactacgaatccgggactaaagatattttttcttttttttctctctttttcattgtttttagtattgaatattgatttcacaccatcccctatcaagaaatcccaaatccaaatcatcacatatcacaaaacatccccaaattctcaaatatatcatctccaaatacatcacaaactcttaaaaaaattacatcacaagttctaaaaaaatacatcacagattcggatcacacacaaatcgaatacatcacaggataaatcataaattgtaaaaaaaaaaaaaagctggccggccacggccgcctcccatccgcgccggccggctgccgccgcgccgctgcgccggccgctggcccgcccgcgcgccctcttcttcgctagctgtgaatggaaggaaaaaaggaaagagaagaaggctaggagttagagataaggaaagagataagaagttagaaggaaaaaagagatagagtaaggagtttgttgtatggacgggaaaagaggatcggtactagggattatatagtatgctttgatttttattcccggttagtaacatcaatcagaactaaaaatagatttttagtcccggttggtgttactaaccgagactaaagattttagggccctgacacgtcctgacatggaatcaactaggactaaagatgaactttagtcccggttagagttatgaaccgggactcaagatgatttttagtcccggttggtaacaacaactgggactaaagatctttctctcataaaccgggactaaaaatgaaaaatcatttttagtcccggtttttaatggaaccgggactattgtggatttgggtcgaccgaccaaagatggtttctctaccagtgactgggagttgttttttatgttacccggatacgaggatatatacggatacgcgatacggggatacggcatttttcaagaaacatatatacggggatacgtctatatatgtaataaaaaattaaaaactaataaactctcttaacatattgtgaaaaccaatgcattcacagaaaaattaataaacttgcggactgctacctgctgattattcacagaaaaatcaatgtgctttctcctatacccgctcttgtctgccagactgccacaatccaccgaggcttcttttcattattatctagcagctgcactagttcttcgagggtaggatgttaggaaacgataggcaaataaacgataaaaaacaacagatcaatcacagaagacactagatttaacgtggaaaaccctcccaaagcaggagaaaaaaaactgcgggcgccagccagcaaaatatcttcattatatcggggtgaagttacgacgctaaatggtggcttacaggaggtatatatatgaaggtgaaaccttaaaaggataacgaatagtgaagatatttttcactccggcccaagcctccggcttcaaacggcctccgcttcgctccagcagaagctggcctttattatgtgcaaacaaatttggatcacaactcaacataggagcattggatgcatggatgcactagctctgaaacttagatttcagatccatcggatgactgctaaatgaatcactgcagtggagctacattcatcggcgttggtggtagcagcgcgctgttcatcggcattggtggcggcggcgctacaagcctgtaatcgtgtggggatgctgtgcctcgagcgagagcacaaggaagacggtcttggccccggcggccaggcagggcatgatgcacgatgggtgcgggtgttgtgtctggcggcggcagccctgcgcttggaaagggattcggaggtgggcgtaaaacgtatcagcgacgtatcagggtttgttttatttatttggaaattacgaaattgttggatacgtatcccgtacgtatcggcacatatggaaacgtatccatatctgttcacgtatctgatatggatatgccacttgactgccatatccaggtattctaggttgttttttctcttttcacatgtgtatatatgtattgggctaggatttttttgggtggtcctgggaccacccctagatctgcaaatggagctggtattttagctcgttacgggtaacgtgccagctcgaactggaatgtgtgttttacgagctagagtagcccacagctcagcaagtcacaacccatattcttataaggccctagaacatcaaaagcctagctcttgatccccttttgaccccttctcactctcatggtttcctattgtgtccaaggcaagaaggttcttgactattccagctagtattgtatcatcagagtccacttttagcattggatgaagaattcttgattattacaggagttttttgaagcgagacatggttcatgctttggtttatgcatcaagttggataagaacctcaaaaaatgacaatactgcaccttcttgtgtatgtaatatattgtaatgcttattttttgcttatctttgtcaagtctttgtataaattgcttattttggactggttttacatggagaagatggagattatgacattgaaatagtggagttcccccattgtgtggtggcaagaaactagtaagtataagtatagtttatattcaatgtaggcacttagcaacttagattaacaatgtacagctagtaagtttcttattttgacccaatatattatactctgcaatctgtattccactttcgatatgaaacatttcaaaaaagcaaaagagaaagaaatccaacatatcactttactaatttctctacatgcaggttaaaagcagtggcggattcaaaaattttcatgagcctgggcaagtctaacaacaaatgaggtatatacaagcctatataatttgatcatagataacttcaatatgaacatttgttttaaaagtttgtgttgagcgagtttgcgattgtactagttgcattgtactgccttgccggtgactaagaaaagtgattactaaggtaattaggcactggtgaattgatgcgtgcagctggtggagcccaggccattgtctgtgcaagctgggcttgcacaaggctccgcacacttacaagggaaggggtgcatggggggtgggagaaagtgaagctgcttctaaacttcactctattttagcttcagtcaagctacttgtatttatgtgtaattgtgctggatgaaaaatgatggacatgtgccctttctgccttgcaattttactagttattctaaatcactagtatagatccttctatttgtgacgggctctaatatgcttagaaatagcaggccgtcacaaggaagtcatctcaatcgggccgaaaagtgcccgattgagatatggtcgcacagacatattagatgggcataaaatttaagcccgtcacggatgacacctatcagtgacgggccgtagtttaggcccgattgagataacattccatatcttcatctgtgacgggcaccaactttaggcccgattgaaataacattccatatctcaaacgggcct

SEQ ID NO: 59056 - DNA, 5820 bp, Oryza sativa
ccgccatggtcgcgctcggcgaggagcgcctcgcgctcgtccgacgctggcgcgagcgcgaggacgcgtggcgcgcgcgcgccgaggagcgcgaggagcgccgccaccagctcgtcgccgcactcctcgccaagctcggcgccggcgacgcgtccgcctgagatcgatcgatccctccccccattgttccatccgcaccgcaccgccgccggtacgaaccaaatcccctaccacctcctcctcatcaacagcatctgcatcatgtactgcaactgcttgatgatgatcttgttgtgttcttccaaatggagatcgaatcgatcataattcttggattattcttcattgctcaggacgatgcactgccgcgaagcgcgcgcgccacgcccggcccgatacatttgctatttatgttagatcagtcgtttcgtttctagtgatcgatcaatcagtccatggtctttctctcatctcatcttttgttagggtttcccttttctctgtagaagacaatgagaggttggtcaagaaattataagggttttgcaactgagatgcatcaaacatcttcctagtaattctttagtttctctactagctatctatccagcccatgccatctgcaagctctggtcttatcaagcttcaggaggaagctgaagctagctgctagcttttccaacgcatggatggagatgcatttatgcatgcctttgcatgatcaatcgatgtgctatctatctatctatctatctatctatctatctaactatctttctttcctctcttctcaccatgagtccaccatgaccaccactagctcttcttttgaagatgatcggtagaatctctgcagggaaaaaaatggtggtggtgtgtgtagtgtgtacgtgctccccttaattatgtctgcttttcagaggagatcgatatctctctctgtgcgcaggcagaggtgtagcttttgggcgacatggtctcgctagatctttcctgcttttcagttgcatggtaaagagatttgcgtctgaaaagtttctctcttggtgagagaagaaaaaagatgtgtggatggagctaagctagccataggatatatatatatatatatatatatatatatatatatatatatatatatatatatatatatatatgatatatatgtctagacatataatgcatatatgcatgcatgatgggggtgcagtgtgcagtctttggggttgggttgggttgggtttgctttgctttgcttatcatggaggaagggaattgatgccctgcatgaaaatatgcctatgtatgcaggacctccatgtgtgtggtgagaggagagatagattgaggtgtagaagccataattaacagccactagaacaacaatataatgctgagtaatgcgccatgcatatgttggtgacgctaattgcctgcctgattagtttaagacaggctcgctaatgatgtcaaatgcgcgtcatagtatgcatcatggtcatgcatggcatgcccctagtaaagggtgcgtcatgcatggtatgaaaccatggaccagctgctgcacagtgtgtacgggtagaaaagtagagtatgaatgcaagtttatacatgtacacattcattttttgtcaagaaattgcaagccaatattatttgtgcagtttagccgcttgattaagtagttttaagtttttttagtcagcatatatattagctaactatctgtttggatatatttgtaccgcttaatttgtagtgcttgcatgagattctgtaattatcatttatcaaaaattaatatatattcttgcctaaaaagtagtactatctaagatagagaaatcatatatacataaaaatacacagtagttaagctcatactgctactatatatgtatgtgaaatcttcaagtgaaagccacatcaattacgtgttagactgctctgccacccctagctgttaattactttagtgcatgtgatagtagcttccagcatactcaatcgtgcgtggtcagtaacgacaacattttgttgtgggaaggacggtcgttttgtgatcatgcatgcagggtctgtaactaacatttggtaagatatatatatatatatatatatatatatatagacaacaacaaataattagtatttattttaaaactaacatgcatgcttagtccatctgcacttgattccttgattgtgctcgagggtaaaaacttgctttctagtccctttaaactctatcttgtcatgcatgccatcatcaatttaattaattaagtactcaatcctatgaattttgctccgtcagcgtatcatcagtctagccattatatctaagatatgcacaaattgcctagttggtacgtttcagctttcttgacatgtcctgctcactgttcacttttggtgcgtgtgaccttgagtgttcacaatggcaacaagcaatcagactagtgagatgatgactagcaagatgttttcatggattccaaatgtttgtttggctctagcctcaataatatgtatggtcaataagtgatgattcgatatttggttttttattaatatatagttaataatttgaagctatttgatgtatatatagtcactaattactcagctactagaggcattatttcggtgcgtatatatatctctctctcccatgcatatgcactactatacgaatatatttcgtgtgaatgttgtcaaactttatgcaagctatttaagatttgaaattttgcgccatgctgctatagatgcatgaattttatgaaaattttgtgagattatcaaaattttatgaattttattattatctctacacaatatttgaaaatatcgtaccactcggtatatatgcacctattaatgtgggtagaaaaatattgaaatgttgaaataaacggtgcatgtattttcccacagttgccaccagtatatattacatatataaatactgaaataaacagcttagcatccaggcatctttcatctttggctctttggtgatagactactgcttcattattcaatttcatttcatataatatatagtacttgcatgttgattagaagatcttcttcttgttgcttctgttgtttcttgtaaatatgcatgacttctttttttgtttgttttcatacttgggcatcaattatttttctattattatagtgctcacagattatgacgatttcatcacgtcaatctgatatcattcggttctcactagatcttcccagctggaagtagaaaatgcacactttgttatcttttactaagaaattactggttggcaatacatgtcaaagatttatcttgaccttgctactagggtaattcaatttgcaataatccgtagaataatttaactccctaatatataggtttgcattggatgggaagaaaatgactgccgaatctatgatggagtaagcaaaaattaacaagaatttatatgatcgatacaaggacaatcgatctcggctggcccacaaatttcaggtgtgaagtcatcagtcgcatgtttagccaaaatctggagagaccacttgacacacgcaattaatatattccccagtacagtctaaagaaccaatatatattatttgatacatatgttaatatatatactgatgtgactgacaaatagacaaacgagattaaattgtgggttttacaatacctgaatcatccttaagaagcaaaggattatacagcagtgactgatggtgattgattcaacggtgacttttggcgatatgttctgattaaggtcgtccatgcatcaatatcgtatcctgacaagtacgtgtatcacataattcttcactagcttgatttttttatgttgttacttagtaatatactacatctttttctaatatataataccgtttaccttttagcgttcgtttgatcattcatctttcttatcatgaatattcacaaacataaaaaatataagtcatatttaaagaaaccttaattgtaaatcaaatcacaacaaaataaatattaattacatatttttttatataagtaaggttaaaaaatcgattgtatttttaaaagttaacaatatcatatattaaaaattatagtcggagtaatataagctagccccatatatatatatatatatatatatatatatatatatatatatatatatagagagagagagagagagagagagagagagagagagagagacgcatgccataagccaccatcagtaattcaatgtaaaagttaggccctgtttagttctattttacgctgtcatatcgaatatttggacacatatatggagtattaaatgtagaaaaaaaatcaattacacagattgcgtgttgcgagacgaattttttaagcctaattgtgtcaacaatatagtgctacactaaacatttgctaataatagattaattaggcttaataaatttgtctcgcagttttcggtggaatctgtaatttgtttttttattagactacatttaatacttcaaatgtgtgtccgtatatccaatgtgacaaccaaatctaaacaatattccttcgtttgtcaatgccatagctagctagtactagctttttcatgaatagttatatattgtcttgcgtgtgtccttcaagatcgcaacaagcgaacaattgtcgtgctgacacgttactgccaactaattttgtcgctgcatcgcatggcctttgctgccaagttggttgcattattttgaaatcgcgcgttttcatgatttggatccaagttgcagctggcaactcggttaaacaagcatgcatgcgtgacgctacaaacttaattcgatgggctatttggatgggcacagcaaaatatattttgataaagtatatcgtgtcgttattggtaataaagtgttgaccacaattctaacaggtagtgtgactgaaatatgtatatatgtggcaactatattggccagctacgttaattgctaatctccattaattccataggaaatcaaagttcccatgttacaaattttggaccttccgaccaactttgaaatttctataccatgacctcctttttcggcgagctcgttagtctccgggaacggtgggcggcgactttcggctaagtatcgggattgagagagtacagggagggataggaggggaggggtggctctggcggcttagagggatggcaatgggcaagtaaacagcgaagcggcgagacaagacagaggcgttataccaaaaatacggggttagctgccagtggtggcccgatgttagcgttaggggtgatggtggaatttctggtggcaagaaaccgtcaaagatgggtaatatatatggctgcgcaagggaacctctccaactcaccttggagaggaaaggtgggaaaggggaaggaggaggtccgatgggcctgctaccattgttgacgccttccggcatcgaccagacctggtggtgcgacggtggcaacaggggaatcggcgacgcacgagcagtggcggacgcaggattaaaataaagatggggtgaggatgctcgtctcaataagaacaactaaacggaaaaaataccatatttatgttgtaatcatataaacatatagtataatcaataaattaaggcaaacaaaaaacaaaaatgatattaaaataaagtaataattttgcaccatacataattcatcatacataaaaagatactagtaaacatatcaatttgcaaatatgagtcaattcataaaacatggttgatagatatcttttaaaaaataactatatgagaagatatcgcatacc

SEQ ID NO: 59057 - DNA, 4923 bp, Oryza sativa
  unsure (1)..(4923): unsure at all n locations
atcaattaatcaatcacgtacggagaaaagcccaatttcgaagtgaatcataagattcgtacaaaccacaaaagtatttttttaagaacaaaaccacaaattaaaagtatgatcaaaattgttggcttctacagccaaggtagctgacgtgtctgaccgtctgcccatggatctttttcgcactatgaattgatgtgtgttacaaaaagagggatcaaaggcaagacccaatgaaggcgactcagcttcatcatgatgtgctctatctggttctcacttaagccttcataaaatgacatgaaaaatgaattgaaggggatttgcatgcgagattcacgttggcgacaggtactcactaacctttctgatgggcataggattggcatatttgtatatgtacacaaactatatatatgtatggtcaggcgatctgctagcccctgtttgctaaatgtacacactgtgccatgaaaaaaattgaagtgccatttaattagtaaggtaactggcatctaccagaaaaatacacatgcatgacatattatccaatgtgccagaaaaatacacccgacaccttgagacaagttgcctgaaaaaaaacactcatctatatatcatatgcatacagatttttctgacttgttaattattagcggggtgcaaaactgtcctcatggacccacatatcaatacacatacagtgcgatacccaaatgtgtaaggctacatgggaaaagtaatatcatccctaaggagatatcctcttatatttttttgctatacaaataattataaaaaattgaaaaagttgataagataaatcaatatgtaataatatatcactctacaaatatacaagtttaaattcaacatatacaagttgtaataagaaaacaaatgtgcatataaatagtacacatattcaaaatcatatgccgaatttgaacttgcatgtttgtgaaatgttaaagtaatatatcacatatatattggtttatcttatcaaacgttttcatatatatgttttcataaatatttaaataacatgtaaaattgagggatatgcctagcttaaagggtgaaaatccatccccagcctacaagagacaaaccatgtgcatccagcagcgattgagataataggaggcatccgtgcatgcacagtgtggtgaccactgatgactgatcgaccagcaggttcattggcctcatctctaattaacattttccctgcctgctagcctgcaattccactagcaagtcagtcattggtgtcctcacaaagcacacaaaagtaactttcaaatagtcttgtgtgttagttggtcctgggttagaaaacacattgacacaacatgcatctatcaaagaattcaaggcatgcaaccactctacatgccctgtccccatccactgttcccttttctcaacgattttttagcattaacatgcctatatgtgaatgatccatattgcctttagccctttatattgcatatattggtcatgcacatttggcactgccacaccacttgggctaatgcagcggttgttttcttctacctcatcatcattcttatatatctaagttaccatgtcgatctgttccaaaatataagggattttgacgatatatctgatatataattaatagattctctcgctatgtgtatatatatagctaggtagctgagcaagcagctggtcatcacggatcaagaagaagattagcttagctagctaaaaagtaagtagccgtgcgaagtcgccggcggtgatcagccggcgatgacgacgtacagggtgtgctgcttcctgcggcggttcagggcggcgtcgaacgagccgtcggaggagctcggcgacgtgttccaggcgtacgccgacggcggcggcggcgtgatgggggaggaggcgctgaggcggttcctccgggaggtgcaaggggaggccgccggcggcggcgacaacaagctggaggcgacggcgagggaggtgatggccttcgcggcggagcagaggctgctcaagaagggcggcgccgcttccgccggcggcgggctcaccgtcgagggcttccaccgctggcttgtgcagcgacgccaacgctgcactggatcctcagaaacgggtacgtacttaatttacgtgattagttagctaattaaactcgtaattaacacctaattaatcatgattatgcatggattcgacgatctcttcctccatcaantagcttatcttagctactcttgtgttcaatagatactactattaacaaatgagtgtgaaatcaatctgtaataataataataataataataataataataataataataataataataataataataataataattgataataatgctcctcctatgcttttccttttttttttacggaagaatgtagagtaggctttaccttatagtcatttcattaatagaaatgaggtttacagattacatattaggtgtgggaatcatcagagagaaaaaaagaacaaaaagcagaacaaaccaaaacagaaaaagagataatttacagatatatgtacatgcctatgttcttctatagaaactatatcccagttacttattatgcgtatatatataaggaattaattcacattcaggagcaactaggcaaggccttcatcgtcagatactgtacatggataatcatacagaggctaaccatggccatgcaacctagggaccatggatgagctctcacaagcgcctccaaaacaaaagaagataaggtccctagtcatatgagaatggagaacaggtcgatgatattggaataagtgaattcccgtctttcattatcagtctaaattttttattcaaaccaattgacgcatgcaactcaatatagtatcagtcccaagtttaaaccctagttggcatataattaaataaaaaatacaacatatttctatctgaggtttgaggggacctcgtgtgaagggaagtgttgaaatataagtgaattgtccgtttttcttcatcagcttaaacttttgggttaaactgttcgggatgtattacacaatagtgaaaagaatctgtgtatacaactcaatggtgtgaaggagaaattggtcgagtctatagaggggtcggtgcgtacaactcaatcgtgggaagtgaagaggaggtcggtgtgtacaactcaacagtgggaagtgaagagggaggttggtgtgtacaactctatttttttagataaagacaactcaattaatagtgggaagtagggggggggggaaggagggggggatcggtgtgtacaattcaatagtgtagaaggggaaattcagatgagcatgttgctgcccatgcgcagagctacgagaagactgcttttgcggtttcgcctaggacacatgccatgtgaaaatatcaagtcctttcggtgagcgaaggaccgaagtcctacataactttttcccttgtttggtactcgataaaccaaaaccaaaccgtaaaaactgaatatatattcatgtaaaaaaataatcctcgctatacaaataagttgaaagatatagctacaaaataagcagatgtctctctatgttatgggtgcaggtatatcaagacatgggattgcctctgtcacactacttcatctacacggggcacaactcatacctgacggggaaccagctgagcagcgggtgcagcgaggtgcccatcgtgaaggccctccacgacggcgtccgtgtcatcgagctcgacctctggcccaacgctgccaaggacgccgtcgaggtcctccacggcaggtgatccgctcgatcaaccaccatcctaccttcctacaatctccattgcatccttaatttcaattcacgacagatttttgctatacgacactagtccctttgtccacagattttgagcaattttacccatcctatatttatacctcgaggtaccacattttgcacataaaattttaataccttggatatcaacttttacactataaagtacctcgaggtacccaaaaattggtaccaaatattggacgctaaaattactctaattttttgttttaattttccatttcaatcgtcctctcatgtaatttcatcatctactactcatcctaactaggcgatgaaaatcgtggtatgaattttatcttaattttattatattctaaaacattaaaatactcatattttttggatgaaagtagctgttaactatgttaatttgtgaaatttatgttcaatataacagtgcctatgattaaaagtgcattaaaattaaaaaaaaggtttagtggccatcctagccgttgtgtatttgctgatgggttgtcctaaattaattaattagaaaaccaaattaactactgcagattcaacgaattaaattaaattaatgaaatggaaacaagaccaaactatggacctatatgggccaaaataaatctaccggcccgtcattaggagatagagtaggcccatgggcaatgaggtggcccatgggccgcgtccatcaccggcctgcttcacgacgccgccgcgcgcgccgcgacccgtcggcttcagctcaccgttgccagccgtcgccggagaagaagctgacgacgatttcgctcccgcaggacgctgacatcgccagtgggtctgatgaaatgccttgaggccatcagggagtacgcgttcgtcgcctccccttaccccgtcatcctcaccctcgaagatcacctcactcccgacctccaatccaaagtcgccaaggtgaacacgcatttgccatctcgatcacctcaccttcttcttcctccatatactgacaatggcggcatcgatcgatggattttcactcgcgcagatgatcaaggagacgttcggtgacatgctctacgtctctgaaactgagaacatgg

SEQ ID NO: 59058 - DNA, 6081 bp, Oryza sativa
ctttattcgttcaaaaagaatagttacaagaagttgccgaatgaaggcagggggatcacccagggttggaaattttggaccgaaatttcggtcatttcggcgaccccccgatacgatattaattcggccgaaatttttgaatttttgaattttttcattaatttgggtaatatttgtttaaattcaattaaattttgttcaaaatttcgggttagagtgaaccctgggatcaccacagaatatgtttatgtttagggttttacttctgtgaaataaatccgtcagtccatcataaggtggtacgatgggaataagcgaaacaatgaaaagataagcgaaaccgcacgaatccatctccttcctcgcgccgccggcctgccgcattctcatctcttcgctcttttttcctcccttcgcatatgtgcccccacggcggtggaaccaccggcgcacagtctccttcaccggtggcggcgcatgcatcatcgagtagccatcccgcacccacgcccccgccgctaccgatttctttttctccatccccgcaaccagtccacatctatctgcccaggagcgacagtgccatcgctaccgaggtgcctggtacaatctatccacagccaccaacgtggcaacgccgcccctcgccggagggaggcggataagtcgggtgctagggaacacgatagagctgagtgctcgacgagacggaggcggcagctccggatgagtgcgaaggtggaggtggtggcggcagcgacaccgatgccaggtgtgcggcaaggcagatgcgacggcgtagatggcacattggcgaggctgtcggcgagagcacggccatccgagataagaaaaggcagacacggtgagaggaggaagaagatagaaaatttacataattacctttttcagttagtacctcctttaatggttaatgaacacgtgggaagtactaccatgtaccatttttccccagccgttggatggaatgaaatggatggcctggattgcatgtaccggcaggtaccaggaaacatgatgaacggtaaaaaatctcttatgtttatgttcatgagtttatatgaatgaagtgtcgttgtgttccttgaatcgagtgaatgattgacactgtatatcaccttaacttttatcagtgggactagctctatatatcacgcggaagacttttaacacaatactcccttcgaattgataatacttgtcgttttagacaagggtacaatcttaaaaaaacaactttgaccactatttttttattataatacgtatacaagtgttaacaaatacataatcttattgaagtattttttaaaactaatctatatatatagttaccatatttcaaagacaaatattttagaaattattcataattaaagattttatagtttgacttcacccttatccaaaacgacaagtattatcagcccggagggagtatatcacaattttcactgtggcaattaaccttaaattaattaagccttttgatatctagatcagtgattgcaatttcacttggaaatttccgaaatttcggacccccccccccctgcaagtgattatctcggccaaaatttttaggtttttctcaaatttttgtgaatttggtaaaactttagtcgaattcagttaaattatgttaaaatttcaaaacatttcggtccaaaaagtgtcgaaaataccgaaatttcgagaattttggttgaaccaaaatgtgcaaagtcgaaattgaaaaccctgatctagatagattataatgttgagaacgttaagaacatatacctaattaattgtagcggatatatatatgatatgatcacttcacttgaaatcaaagttggtcatggccgtggtgtcgaagctttgctgcggtgtgagtatcctggggtgcggcagcagcgcggcggagacgtcgacgtcgccccaccactcagcgccgtgctcgacgtaccactccgccgtcttcttgatcccctcctcccatggcgtccgctccgaccaccccagcgccttgagcttctagtcgtcgacgaaatacttgtggtcgttgaacggccggtcgctcaccgtcgcgacggcctcgccggggtcgagcccgaacacgccgcagacatggcgggcgacgtcgatcaccctcggctacgccgacctcccccggtggagcacgacgtcgaacgcctcggctacgtcgtcgcagtagaggtagctccgggcgtggcgggagccgtacgtcgccgtggacggggagctcgcttgccgccgcgcatggcgaggaggatgagcttggggacgagcttctccgggaactggcgcgggccgtacacgttgttgccgcgcgtggtgatcgccgggaggccgtaggagctagcgcacgtacgccatgacgagcatctcggcggcggccttggacgcggagtacgggttggtggcagggttttaaatctcccgttatagctgccgctatctcccgctatagctatttgagaaaggttctagttattttctcttatgtataatttagcagctatagctttagcccgttatagcgggtatagctgattgagaagctaactgctaaatgcctttgcccgctctttaaaagattggttggtggggagcagccgcgcccgcgacgcctcgtggttgcccgccgtggcagcgtcgccgtagacctcgtcggtgctgacgtggacgaagcggcggatggcgccggcggcgccttccggcggcatggctcgaggaggacgtgggtgccgagcacgttgttcttggtgaactcgaaggagttgtcgtcgacgtgggtgtgggcggcgaagtgcatgacagtgttgatccgctcggcgaggaggaggtggaggacgaggtcggcggaggcgacgtcgccgcggacgaaggcgaagttgggcgacgccatcgccggagccaggttgttgagggtggcgcagtagtcgtcgagcttgtcgagcgccaccacccggtacgacgggtggtcgcgcaacagccggttcgccacgtgcgacgcgatgaaccccgccgcgccagtgatcaggatgttcctcggcgtcgtgtacgacgccgccgccgcatctgcggccgcggagacggaggcggcggcggcgggcgccatgattaatttctcgctagcttgtgattaataattagtatttgttaggttatactgatactgatactaatctcgagtttcccactagatccgtatttatagccagacgcctacatctcatcacttcatctgctttcattttttcttttctgaagaagaaaaatggtgatttttttgttagcacaagagaaaatgttgttgaaatttcatcacgtatgtatgtagtaccagatcaaattgcttccatcttaaaagttttggggtgtaaaaaacttgcggaagttttctaccaaatgcgctctccaataaaaaaaaagtgtaggttatcaactgtatatgagcccatgcatggttgtaaaaagccaagtccaaatgcagcccactgagaagagcccgagggcctcacacctgactggccgatgatccagctgattcataggcccacctcaccgacacacacccacattatgactactattataaaaattaaaaatatttttgctagtatcttgatatgtcatccacggtttttaagtttgttcatttttggaaatacagatccgtgtttgaattggattttaagtttttttcctttgggaagtataaaaggagtcgtataagaaatattttgaaaaaactcacatgctaacttgagacaatatgggctcctaattgcagctcatgattttctgaaaaaatatctaagcgaatttccacagtggattttaccctagctaaaccatataacaataataaaattaaaatagcatttacctgttgcaacgcacgggtatttttttttaagtatataaacattcttaaaaaaagttgtgatggtgaggtgggtcttgtctaataagcactattattttaaaatatttttatgtaaaaaaatatatgagctatatatcttttatttggtatccctccgttacataatgtagcaacttaggatgtaattagactcatcttaaattgctatattttaaaatgaagatagtagtttctttcataatttcatatatgttacgtggtccatttcttaattacagaattaatttccatcttctcttctaagaacctctatatatatatatatatatatatatatataaccagttatttatagagtttataggttgaacgactgtgaagtacaaaatcataacttgattaaaagtaataaaactacttaaaataccagcctaaagacaaagataacacctattgttaaattcctatatatctatggttggcaaaaatctgcaaagcggcttgaaagttgtacatagtccttgtctgtctcaaatcagcggctgatcgttgtgccaatcaaatttcacgtatggtaccaaagcggcagataacgtcggagggtaactgagctataaatcaatcgttcacgtagttctctagctagcaccatggccatcgaagccgatctattggggacatcttgcaccctgccgtcgtggaccgtggcgaggtatagcgtcttacgatgctcaacatatgtctatctaataagctatgctaaacttaatttaagtttaatcgtgacagtggaaattgtgatcttgtgcacacttcagtattccaaattattcttttcataatttagttttctattgtgcaatataaacgagaggcggatctatctattgggtagggtgcgtaggtcgactggcacaactacgacccatattgccaccccccctcgggcggagccatgtagggccaagggggttcatgggcacccgactgcaaaagaaaaattaacggtcaataccacttgttggccatatgggcacccccccaatcaaagcttggtgtacccccacccacattagaaaagagatggaagcacagacaacccacaaacccacatcatgagttgtgtccaagcctgacctagcaaatgtattgaaggccaagaggagcccaatacgttgtagcttgttgttgtcgcgaggacgcacacgcgcatgtctctttgccttcttccttttattttctttctagcagcttcctgctgctctttcctcctgaaagtagatctaacctcctttgtgggttttggtgattaatgactaaatggttaaagggactaatttgtttattgagtttatatacggataattagagcctgtttggttgctaccctgagcaaaccagcctggcctgagcccaagcctgtaatctgcctgagacgtgtttggttgctaccctgagaattttagcctgaggaatcttgcctgacgaaacttgcctgagtcaggcgtagcaaaaaggtcgcctgagcaagccacagcatttcccccaacatgcttgagtagaatcacctctcttctactacttctcctcctcactgtaccaccgtagggttaggaggagaaaaaaatccccatcgatccatccatggctgcagcagcagcgaccaaggggctgctccaccttgtagatccggtggccgtctacttcctcttccactaaaatctggtgccatcagttggagctcagctctatgcgtgagagctactagaaaaaagagagcactttttcagatctgaaagggaatcaacttttcaactctctccttccctgtgcatgtgagattgcaagtctccactagtttttccacgatcttctgcagcaaggtgagaacacactctcaagttctcttcttctttttctttcttcttctttttttttttgttgcttttcccttctattgttgctttgttattccaggatctgtcaagagcatgtctgttagaagaaaaatctatgtgaaccattgcaatatttgtgtttttctccacctatttattattatttgtcatgtgatgctcagatggatttagatcatactcatgaatacattatccaacaacaagctagaactttggccattttagctaccgtgttggcta

SEQ ID NO: 59059 - DNA, 29870 bp, Oryza sativa
  unsure (1)..(29870): unsure at all n locations
ctgagccggtttgtttcaaatccgggagatgatcattggcaagctctggaaagggtcatgcgctatctaaagggtacaatgagctatggaattcactatactggttacccaaaagtactggaagggtatagtgactcaaactggatatctgatgctgatgagataaagcacaagtggatatgtgttcacacttggaggtgcgctgtttcctggaagtcttgcaagcagaccatcttaacgaggtcaacaatggaagcagaactcacagcactagatactgccacagttgaggccgagtggcttcgtgaactcctgatggatttgccggtgattgaaaaaccagtgccagctatcctaatgaactgtgataatcaaacagtgattattaaggtgaacagttcgaaggacaacatgaagtcatctaggcatgtaaagagaagactgaaatctgtcagaaagcagaaaaactctggagtgatagcactggactatgtccagacagctaaaaatctggcagatcagtttaccaaggggctaccacgtaatgtgatagacagtgcatcgagggaaatgggcttgagacccacttagagttgcacaatagtggaaacctgtccgttgtgatcggagatcccgtgaatttggatggcgaaacaaactattgtgtaaccgagagaagagacccttaaatgggctcattttcatgatgtacttctcttctattctgtatggtaggatggcttatgcctcaatgtgttccgagtggctttcattaagcagagatgttgacctgcagaacatcttagaaggaacacacctatatgagttcgactgctagtcacaatctatgagatttgggtgatctctagatactcatgaaaggcctggagtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaatactggtatataaaagctgctatggaatagagagcattctcatgagccttgaaatttggtggggattgatagatttaattggataattgatccatttaaatcaattaaatcaaataaattccaaggctcattatgctaggaattcatgtgtattcatttttttatgggatatcaatgggatgaagagttttgagaattaatccatttgattagggaattggtaacttatatcaattagttctaattgatggatggttgatggttgtgtagtggaggatggttcatggctagttgatgacaattagttgctctattcctcttcctattccattggtaacttacatcaattactcttaattgattgttggttgatggttgtgtagtggaggatggtttatggctagttgatgataattagttgctctattcctcttcctattccatgactcttactcgtcatcttccattcctcttataaaatgagaatggatttgatctcccgcgagaatagtgagacacactttcatccattttccaacgttgttgctgctacggtaatcccatcccgacgagtgtgtgcacacgtgttgggagagtaggcctccgaaaccacgcgctgctgcgacgtttgcacggacgggcgggcgatcaggtttttggggagcgcaacacgcgactactcactgttcgtcaacatctacttcactttcaccaatatgtcgaacactggagacaacggcaacactggatacaaggagaaggaggctcccgtcaacaccaacggaggcaatactgcctcaaactccagcggaggaccatgcttggggtataaccttcttacattatttcaattagaagttttactgttaatgttcatcgcaatgtcaacattgtgttattatgtgattgttgatgcttattctacattaagcatgctcatgttgattacattcaccactgtcactggatcaaatcccattgtaaatatcatgtttattatcttgttattttggattaaaatataccaaattatgaccaaagttctaacatcgtcctattctaattcactgtattttagaacggatgtagtagtaattatgtaaagttttgaaaagtaagacaaatcgtcgaacgtgcgtgatatcaatcaacgatgttatctgttaaaaaacaaaacgtaggtagtacttttcttccgttggacgtacaaccagcacgaggcgccgtgcattgacattgcgttttctcgatcgccgcctcggcgtctcgtgatcgtgagctcatccaatccgccgcgtgatcggcgatcgcggcgaggcggcaatccatgtttctgttccgtccacggacacaaggaatttttcccaaggtcaccgcggccgtacgagagctagttgtcagcacagtgatcgtcatgtcgcatgtccttcccctgattataatacagcaacttaatgccggtttatctgttctaacagtcactgatgagtgatgaagcagctgtttgtgattagatctgtctgtcctttttcggttgaacgtttgtagccaattggtttctataaacagaaaagtggtcgtcctgcattgagaaaaaaagaacaaatgaacttaagacattatcaattacaaataattaatcttaactactactccacagtgttgtcttatcactatcaactttatattctgcataatcaacacttgctcgagaagtcggcactcggcagagatggttgtgctctacattcatcttctccatttctcttttgtttatttgtttttgaattggtgatataaatccgtgcaagattcaagagccaagacagtttttattttttgctactctgacatgaattggtaattttatataggctttatctcagagcaaaagttcattgagactttcagacgcagtagtaacagtaacagaacttgctagtcacaggaaacagaggggcaaatgggctcggctcgtgatattgcttgtcaatttcttctctcattcaaaatcagaatccaaaaggatacgtctattttgcctcccttattttcttgcgcaatcattacccacaacctcaaaactggatataatgtctcccccattttcattggatggtttgggggagcggtttctgataacatgcaggtgttttaatcagaagtaggacaggagggatgacaaatagacttattccaatccagaagtaggaagctataattattgggcttaaatcagcaagcaggccgagccgcacacactaacaagccacaaagccccaaaaaacccaatggaaatatcgcaaccttgggagccggaggtttatccccaccacgaacgcctcctcttcttcttccgatgcggggaggctgagctcgcaatccccaaagctcgcggagatggacgccaagctgctcctcctccccttcccctcgccgccggccactctccaccaccacccgccgccccccaaatccctcttcctcggcgcctccctcccgctcctccacccgccgccgccgctgcggctgctgcggcccggcgccccgcggcggctggcggtggtggcgcaggccgccgtgaagcggcgcaaggagatcccgttcgacaacgtcatccagcgcgacaagaagctcaagctggtgctcaagctccgcaacatcctcgtctccaacccggaccgcgtcatgagcctccgcgacctcggccgcttccgccgcgacctcggcctcacccgcaagcgccgcctcatcgcgctcctcaagcggttcccgggtgtcttcgaggtcgtcgaggagggcgtctactcgctcaggttccgccttaccccggccgccgagcgcctctacctcgacgagctccacctcaagaatgagtccgagggcctagccgtcaccaagctccgcaagctcctcatgatgtcgcaggacaagcgcatcctcattgagaagattgcgcacctcaagaacgatcttggactcccgccggagttccgcgacactatctgcctcaggtacccacagtacttccgcgtcgtccagatggaccgagggccagggctggagctcactcattgggaccctgaattggcggtgtcggcagcggaggttgccgaggaggagaatcgagcgagggaagaacaagagaggaatctgatcattgaccggccactcaagtttaatcgggtgaagctaccacaggggctgaaattatcaagaggggaggcgcgcagggttgcgcaattcaaggaaatgccatacatttcgccgtactctgacttctcgcatctgcgatccgggtcggctgagaaggagaagcatgcttgcggcgtagttcatgagattttgagcctgacacttgagaagcgcacgctggtggatcatctgacacacttccgggaggaattccggttctcgcaatctctgcgtggtatgctaattcgccacccagacatgttttacgtgtcgcttaagggggacagggactcggtcttcctccgtgaggcatacaagaactcccagttggtcgagaagagcaaactcgtgctgcttaaggagaagatgagggctcttgttgcagtcccacgcttccctagaaggggtgtgccggcaactagtgaggaggctgatagaaccaatggagctgcgcaaatgctgagtgaaggaagcgatgtagaagatgatgaagacgagggattgtcggatatggaagacttaattagtgagatttctggtggcaaatctgacacagactaccactggggagatggctgggttggcgagaatgatgactcgccaccagacttcgaagacgatgatggctcaagtcttaaagaagtcaaggtgactatgaagaaaactgctaattctgccaatggcaaggcacatgttcctgtttttcctgatggcagaccaagggaacgatggtaaaatgatctattttagattgtttggtagagtgtgtaatctttgttgttagttatttcatcatatctagaaagtcgcaaaaccctcagtcctttgaggtgctgcttgaattttgttaccgagcacatgaatagcatatcagaatttgaacagttcacatgaatcatcactaatatagtgaacgaatttgaagttgtgggggtttgtgatcaagcatacttggtgatataaataggtgcaaactgtaacaacttaagtataaatacaagcttaatttgagctatgttagcaatggacttctcttaagaaacagaatgaggtgatgttcctacaaagtaaaatatagtgttagtttgagtgatcacgcaacacgttataacttgttctctttcttttttttttttttttgcaaaacaattcataacttccaaatgtttctgaatcatccttctggtttggaaatttattacctcctagcaattgtagttagtgctaaaggggacatcatcattagctctccatgaatcggtgcttgtaaagagtatgtcccatcttttcaaatgaactcctatggagggaagaaattcaagccactggagtaatggaatgccctctcagaacaaggattgcttggtaaaaactagggaacacaaggcatatcgcttgctgtctgctagattggcattttaaaatggtcagtttgatgaccgaagctgaatttgaggaatgatgtccatttttacgactatgcaacatgttctctgttaccttatctgtctgaattgccaagtttcagaagtattcgacgcttaaacatctgcattcccagtccttgtatattcagaagtttgagttgtcagctatacttgatgtgctcctttggttttgtttttcacatcagtcacaggaaggttcaggatggaatactcggttcattgactactactttgttgttgatgatgatgatgatgagatattgagttctgttattctgtacgtttggtttatatttgcatctttgtgtaacattgagaagctggtgcagtggtgcataagcatcatactgcaccctgtcagtctcatttcacaaaattttgttattcagtcatgggctcatggcctacttccgctccttcgtcgacttcgcagggtcccacactgactcaacaaaattgaccgtagtcaaagcaccacgtcggatcaaacgggagctatactgccttgggacgtaagttgatatggttttgaaacttcggggacgcactatatctggactggcggttcaagggtaaacttgccgacaaattgagggatctgaagtgaccttattacttttggacgcgaggtgcacgtctctccatattgcgcgaccagagtgggcccaccaaggttcgcttctggaatggatcaagtcggcccatgcgaatttggcgctaccgcagcgatccaactcggcgatactgcaactaactacacgtgtcgtatcggctacacgaggcattatgttgggacgaaagctcatccatgcagaactgttcgatggagacgatgccggtcccggcgccgcgtaccgatgaatttcaccgttggttaccacgtatgcatcaatgatctgtgtgtgcgacagagaaggggggtggggggcggaggaggagaggaaaagagggaatatagacttatccagagaaaataaaggaaatagaaagtagggtaaaacctttttcatacccactctatttatttttatgacgccattaattttttaagtatatgtttgatcattcgtcttattcaacaactttatgcaaatgtataagttataaatcaagcttaaattactttgactgataaaacagctcacaacaaaataagttataattatgtaatttttattaataagacaaatggtatgtgataaaaaaatcaacgccgtcatctattaaatcagaggtagtagtttggagtgtaaaacgagctaaaaaaattatttagaaggtttaaggaataaaatgaaacttttttgtttagaaattcccaaggactcctcgtgccgcacggccaccagattcagagacgcacggccgccggatacagacggcgagccctttcgtcgtggacgtgtcgcgcgggacgggataacatacgatcgtgggaaccagcgggaatgcagcgttgcaggccgctgcaggcggcggacaagtcaaccggtcaagcactcgcgggatcgcgtcgccgtcatgcgacgcaccagaggcgaacagcgtacggacttatattttctcgcgtgaattttctgattttaaatcgagtttttttatcctagtttattttttagcttttatttctagattgtttagaacacctatataaaagttctattccattgagcagccaaaggatggggctgttagcctttgcggtcaaagcgtcaaacaagcacaggtgaataaaataacttccctagctagctatttgagcgatactccagtttccactccacttaaaggaaggaaatatcaacggcaacctttgtttctgcccctttttttcagtccaaaaaagcgatagatcgagcatgcaccagcaccagctcggctaatggctatgcctacaatatctatgccgctatgatgtaaaaagcgaggaagcttgactgaagcttctgtctggagagagagaaacttcggtgaaaagatgcatcaaacattggctcattttcagaccagagggtgggattttcggcctcacgtgaaacggtattgtttattagctgataagtaaggccccgtttagttccaaagtttttttccaaactttcaactttccatcacatcaaatctttcattcacacacaacttttctatcacatcatatcaatttcaaccaaacttccaaacttcagtgtgaactaagcacaacctaaataagtattaactactactccctccgtctctaaatatttaacgttattgacttttttaatgtcttatttaaaaaaattaagtaattattaattcttttcctatcatttgatttagtgttaaatatacttgtatgtatacatatagttttacatattccacaaaaggttttaaataagacgaacggtcaaacatgtttaaaaaagtcaaaagcatcaagtatgggacggagaagggagtataattttgaaaacatgatttatttgattcttttaagaaacctctacgtataatttttttcacaaaatatatcgtttaacagttcacgtcatgatttagagttgtagtttaaaactcagccaggtatgtgcgtgtggctctgcaactataggatccagtagggtagagtgatcgcttcaaagtaggaaatgtgatcccaaaaaggcatgtgttttttatgaactgaactgttgggttgccgaggagaaaaaaaatggaaaattccactactcaattgggagaatctagggcaaaaagaaaacacatcacctttcctgggtacctgtcgcttttgcattggctgcttggagattattaaagccatgctcttttagcttatttatcgaatcatttaaaacggattatttgctacacgttttgaaaaatattttccacaaacaatattcttttgatgcactacttatactgcttgtttaaaactatttgtcacatttatctcataatttatatctgcaattaagttaatagcgttttacagtaattcatttaataatctaaattgaatggggcctaccattcaattagtagtaagggcatgaacggtgtttattagtggtctctctattgccatgcaagtaaatttaatgacatggaagaaagagaaatgagtatggttagctcagagtcgacttttaggatttattagagcaaattttattgcatgatggtgaaagaaagaaaaaaagtaagaaaaaagtattttgatacattaatgattaaagaccatattatctctaattgttgtagcatatagtctctagataacgtagagctcatatcttaccctacctttgtagttgccctaggaccacaagctgccgatgacgcaagtgaatccatctctgctgaccagtctactgacgtggcgcacagactgagaccgacactggtcgttttcactcgacatgcttgaccgtccgcacgagcgctttgcttccaatacaccttttctactagtagtactaataattagtgttagtataaatcaccaaaattagtactactaagtactaatactaacagtagctttaggatgagtggcaataattaattaacctgatctcgtggtttagtcagcctggtactgcacaaggagtggactagaccactgaatcgcacaaatgctattcgtccggtgattcgattcggtcagtcgcttgatcgcactgcacgtacatgcttgcattgccgagtcaaatttaacatgatctacttctaaccaggccactgcataattgaacgtgacaatacaatgtactccagtgttttacaaatctagtacaaatcctgctgaattagcgctgtagacggtggtgcctactacaaacgaagacgaaaacgtcaggacaattcttacacactattgaagaaaattttcttgtctgaaaggttcatgtgcagcagtagctcccagccaaaatatcaagaatttgatcacacatgcacttttccgcccatatgtcttgttaagtttttttttccctcatttggaatgcagaaatcaaatttcgtaggaattgcagcagtagttcacttgctgtctgaaagataactttcatggtgtctcggataaacacacgagtgcgttgctgcgctataatactgtactaacaataattgtccacaaactatacgcaagaccagaccaacactacaaacatggtccagtgacagaaaaggtgattaaaaccttattaaggaccacttagctaaactataggaggagaagtgaactgaggaagaagccgagcaaccgcaagccgccttccaacctcctccctcccgacacatagccacctgcacatctccacactacgtgcaccccattttcccatgagaatttcaacgaatcaacacagtactatcccaaagtcctattttagcgaatgcggtatcccaaagtcctaaagaaatacaacaatcaggctggcaagaaagaacactgtgccaagctaattcactgtccaagctgataatacttatcattttgaaaaaaacacagtctttaaaaaataattttgaccatttttttattataatataaaaatatcaataaatatcctattccagtgaagcatttttaacacttgttcaaaacaacaactagtattatcaacccgcatgaagtagcaagaatcctatgatcaatactaaataatattccttcgttctaaaatataacaaccttagtggtcctattcgaatctaccgtaagaatgaagattaagtgtgcgcgcaaaacgagataagtcattagcatatgattaattaaattttaattattaaaatcttaaaaatggatttattagaatttttatagtaacttttatatagaaagttttcaaacacaccgtttagtttgaaaaacgtgctaacggaaaccgagaaaaaaatgtatcttaattaatttagaacggggccattattagattagatataatactaagacgaatttggacaagggatcagtacagcgtccaacacacatagttgtcagttgagcaatgcgcagctgcacaagtgtgtccgtctgtggtaggttgagagttgagaccattctattctaacaaatggtcagtcagacacaagttttttttttccgaacggtcagtcagacagacagaagtagtgattagattagagctggattagtctctgcacatctccatgatggccaagaaaccaaaagaccggtccaagtgtttgaatgacactcgggtagtgatattctctgcttagtcataatcttttccctcggtccggtcaaagtttggatctgaacatgacgcaacgaatcacattttgctccctataaatactcctctccctgtcactaccacactcgccatcctacctcacacgctctcaccaacacaagaaaccacacgcttacgagacgccacggcggcggcggcggcgatggtggagctctgcggcggcgagggggaggggcagatcatgctggcgacggagctggcccagctgcgggccatggcgagggagctggaggcgaagatggacccggacagggtggccgcgcgggagctctgcagggcgctggcgtcgtccgtcgaccggtccatccgcctcgccgcgtcctgcttcccgccgccggagcacccgccccccgccgccggcaatgccggcagggacgccgcgttcaagaagaggcaagtcatggttcccggtcatggtggtttaatttcagggttgagagatcgccggagcaacgctctgacatgtgtttcgatgcaggaaggggatggccaaggtgaggaggcaggtgagggtgacgtcggtgcaggacacggcgtcgctggacgacggcctgagctggaggaagtacggccagaaggacattcttggcgccaaatacccgaggtcagcatcgacgtcagcaaatcatccattgatgacgtcactctcaccttccgctaattaaaaaccaatcaatggccgccgccgccgccgccgccgttgttgtgacacgagcttgatctctgctgcagggcctacttcaggtgcactcaccggcacacgcagggatgcaacgcgaccaagcaggtgcagcgcgccgacggcgacccgctgctcttcgacgtcgtctaccttggcgaccacacctgcggccaggccgccgtcgccgccgccgcccagagcgcgccgcccgagcatgccggccaggagcagcagaggcagagctcgctgctcgctgcgggaacggaaggaattcatcagcaggtagtggcagagcctatggcggcgccgttcttgttcacctcgacggcggccggcggcgtcgacgacggctacttctccttcatctcgccggcgaactccgactgccagttcagcagcgacttctcggcgggcagcgtcggggttgacatggaccacgaggctcgtttcgaagatcttttctcgagcactcttgagtttttccaatcggagattcagaatctgtaggtggccgaatgcacgcagtaaccgtactttgttaaaggttcgcatcagtattagctactggcctactccatactactctgtacagcctctatgctttttccttatgaatgaatctactattagttgctaattgttcttttccatctccggaaagaccctttttttttctgacaacctgaacctgcatcatccttaattccttgttcatgtccaacatactctgaacttgtgtgattttctgaagatgttgacttcaaagcctgaatatatacaactacagtagccaatcaaggtaagccagggcatccgaataaaaattatgggaaacgttttcgaataaaatgctcatgttactgcaagtaatgacagtttcagtaaattgaacactgggctgtgtttagttcctgaaatttgggagaagtttggagaaaattggtagtttgaaaaaaaattttaggagtttatgtgtataggaaagtttagaatgtgatgtgatggaaagttgggagttgggagaaagtttgacgtgaactaaacacaccccaggtaaatagagagcagatcgattaattaggaaatgctcacggggagtgcgacgttctgacctgtggtatatgatatgacattagattagtattaaaacattaggcaatgatctcgttcattaggtgaggttttctcccatctttgaatatttatatatactttctttatcatacctactggtaagactggtacatgaacaacaacaatgtacacaactccaccaatcaaaatgtacaatcatgttattctttttcttctcaatgaaattnnnnnnnnnnnnnnnnnnnnnnnnaaaaaaaaagaaaactcacacaaaatcgatatcatcatcagagtcaccttcttcctcgtcggtgccttcatcgctattgcgataaatgaattcctcttctaacccggacaaaatattcactttgaggctattaacgataccatcgttggtgtaaaacggttcctcatcaatttctggatcaaattcgtctccgcaggtatcttctccacataccatcttctcaaaatccacctcacgcccatggaaattttctatcgacggatgcataatcccaaccccttcatgttcgcagtaaaggcaacgcacttgttctagtagagaaaagaaaaaaaaacacaaatagaatttcttcagttctgcagaaggggaaaagctaaagagaaaattcagatttgtacatacctgagcatggtggcgatatggttactgggcagcaaatgccgtcgtggttgaggcgatagttaccgcattctgcaaagaagagttgaagagctccctcgccggcaatggcagatggatcggagtctctccggcgagccaagaaattgacatgacaacgaaagtatatcagaggagtataactgacgatgtcatcgtcagtgcaatacacgggtcctgatacgcaattgttcatgccacagatgacatggagctcgtaaccaccgggttcctgaaatcccagcaaaaacaatagagatgtttaattacaaagatttgttacagtcaaacaaaaagtacttttaagatactgataacttacgataccaaataattttcaattgttggatctaacaatgaacatcatgtccagttaaatcaaacgatacgaggatctaacaatgaacatcatgtccagttaaatcaaacgatacgaaacgatttgatactgtaaggtactagtacctcgagttactttttgctggaccggagcaaatctcttaatcatattatagcaataataattgttcatcaagaaagaaagaatcaggttaagatgttgaattacgttgttctgcaacgcgtatctgtccaatgcagccttcaccttcctgcagatcttgttctgatcacggatgatctgcgccttcagtttgagctgtcttcgccgccgtggtttcgttggtttgcgctgcattggcgagacggcggcggagggagttggaggcagtaaggcggcggcgaggcggcgaacgtcttccgaggagagctggccgccgttctgcaggagcagcggcgtcgtcatggctctgctagagctgaggaactccacttgttcgtccggtttggggtgccgggccgccgcggcggcggcggcgtaggactcctggatagtgcaggagggacggtgctgccgccgatctgcttctcttgcggcggcgttgaggtcgccgtcgaagtcgagcaaacaccggatggcgtcatggaggccgaggttggggtagcgggtgcagaggaaggagacgaggccgaggaaggaacgcgtggcgatgctggacatgctcttgggcgggatcatggccagctcgagctcttccaccggcgggtgcgcggcgtcgtaccagacgacgttgaggatgatgttggagacggggtccatggggccgtagcaatggccggccttcaccaggctccggtggtagtgagaccgcagctcgccggagggcagccgggcgagcgcccggaggtagaacccctggatcgcgtagaggagcgtcctctggagaggcatggcgtgccggtaaggcggcgcggcgatgccgttgtcccggccgagaaatcgggacgctgccagctcccacgccctctccatgttggccgccgccggcgcctccgcctcgtcgacgaccagcgcgacgaggccgcgcacgtcgtggttggcgagcgcggacacggcctcgtcgaggcggcgagacagggacagccacgcgtggacgagccggtcgggatgcggatgcttcacggccagcgcggcgcatctgagggccaaccttacggcggcgccggcggtgtccgaggcgaacccgaatctcctcagtccacggtcccgcacgacgaggcgcgccgcgacgaggacgtcagcgtcggcgtcgagcaggtagcgcacggcctcccagtccgggaggtgagggaagaacgtggtgaggaaggtgaccgcgccgtcgagagatcgccccgtcctgtcgttcccatcttccgcttcggcgaagacggcggcgttgacgatggcgttggagacgggatccagcaagccgaagcagaggccggcgtcgaggtccgccgccggccgcagccgttccagcgcctccgcgtgggaggcacgaaccttgtcaaggagcaacgatctgttcttgtcttgcgtcctggaagacggcgtgcgactccggcaatcccttgacatgatgacgcggcggtggcgggcgtcgtcgtctatgtccatggcggctgcacggcgcacgcaaagatgcgatgagcgtgcgtgttggctcgtttaggttttgtttgttatacaccccgatccttcctgacttttatccgaatcggctcctcgcacaagtggcattgtcaaatctttgaagtttttgggatttgctcttgctgcgtttgatttttgcactggcttacaggttttgacacgaaaaggattgattctcttacagttcatactccctgtcacataaaaaaaaacaagatagaactgatgcgagacacatcctaatactacgaatctaaacagactgtactataatatgtcatatctaattctagattcgtatctaattctagattcgtggtttatgggaccgagggagtctgttctatttcttaatatgttcagactagagatagcaacgggaattcctggctggagatttacaccaccagacccgcctccacggaggagatggcaacggggaattcctagtcggaggttacaccaccagacctgcctccacggagaagaattttctccatcaccatcaccgtgaaatgcaaacggggcaagatctttcaccatcaccacctccgtgcaggtaatttatctccgtggagcctccatccccgcgagtggtgaagacgaagccatggccgcatctagcgattggtcgtcgttttcccctttgacctggtggggcggcaccgggacgtggcggcacggcgagccaacggccctgcgcgtgcgcaacgggacctgacggtgcgggcgcgccgggacgtgacagcgcgggcgcggcgagccggcggccctgcgcgggcgagggcgtggcgagtcggcaaccctgcacgggtgccgacgcggcagacgcacggtggccttgcgagatcgggagtcggcgccggcgtggggactagggatggaacacagaagggagaaaggattggaatggctagggttttgcagatgctttatatgctctaggtgttgggcctggtttctatgggccagatgggccaaatatacatgataatactacacatacactattatgtcgggcctccacggagagcggggacgagggacgctgaaacaaacctgcccctgccagacccgatggaaggtgtttttactctatttaatcctctgtggagacatattttataccacccccaccttctaatgggaggattcaccgcagggaatcggaggacggggaaccattgccatctcttgcttagacccttcttgaactggaatatcctacgtcaaatagtcaatcaagaaaataaaacaaaattccaaaaaataggtaggagtagttcgcctacggttcggaaaactttggcccagtggaactaaactctccctaaacatgccggtataagggctgaacatgaacattgaacatgtacacagctccatcaatcaaaatatacagtcatgtaaacctcacacaaaatcgatatcatcatcagagtttccttcttcctcgtcggtgccttcatcgctatctcgataaatgaagtcctcttcgaaccatccatagcacctgcatactcgaggttgttgacgataccatcgttggtgtaaaacggttcttcatcaactaaaagatcaaaatcgtcttcacagggatcttttccacataccatcttctcaaattccacctcacgcccatggaaattctccaccgatggatgcacaatcctaatcccttgatgctcgcagtaaaggcaacgcacttgttctagcagaggaaaaagtaaacacaaataaaatttgctcaatttttttgaaatataaatttcttcatatatgcaaagtgaaaaaagactaacacaagtactctatctggatttataatattcatcgttttggacaaggctaagatcgaacttcaaaatatttaactatgaataatttctaaaatatttattttgcaaatatagagaccataaatatagattagtcttaaaagttactttaataaaatcatatactcgtttgatatttctactacaaaatagtggttaaagttgtttttttgaaaaccgtgcccttattcaacatgattagtattagagcaggtacaatagcagactattagccagctacaaacatattttaataagataaaagatgagagagaatagcagtgggctacatatctgtagccagttacagcacggactccaagacgcaatgtgtgtatgacaggtgggaccatatactaatagtacagtaatcaattattatatgaattggctatagatgaattagagctagtaaaacttgctcttatcaaccggagtccggagggagtattatatacctgagcatggtagcgatatggttacagggcagcaaatgccgtcatggttgaggcgatagttaccgcattctgcaaagaagagttgaagagctccatcgccggcaatggcagatggatcagagtgtctccggcgagccaagaagttgacatgacaacgaaagtatatgagaggtgtataactgacgatgtcatcgtcagtgcaatacacgggtcctgatacgagattgttcatgccacagatgacatggagctcgtatccaccgggttcctgaaatcccagcaaacagcagagattaattgattaattatgcaaattgtgttcatcattagcaatggaatagtagtcgagcaagaaagaatcaggttaagatgtttacgttgttttgcagcgagtatctgtgcaatgcagccttccccttcttgcagattttgttctgatcacggatgaactgcgactgcagtttcagcttcccgcgctgccgtggtttcgttggtttgcgctgcgttggtgagacggcggcggagggattcggggacagtaagccggcggcgaggcggcgaacgtcttccgaggagagctggccgccgttctgcaggagcagcgacgtcgtcgtcgtcgtcgtgatggccctgctcgagctgaggagctccacttgttcgtccggtttggggtgccgggccgcggcagcggcggcggcgtaggcctcctggacagtgcaggagggacggtgctgccgccgctcggcttctcttgcggcggcgccaaggtcgccgtccgcggcaagcaaacaccaaatggcgtcatggagcgggaggtcggggtagcgggtgcagaggaaggagacgaggccgaggaacgaacgcgtggcgacgcggaacatgctcatgggcgggatcatggccagctcgagctcctccgccggcgggtgcgcggcgtcgtaccagacgacgttgaggatgatgttggagacggggtccatggggccgtagcaatggccggccagcaccaagctccggtggtagcgagaccgcagctcgccggagggcagccgggcgagcgcccggaggtagaacccctggatcgcgtggaggagcgccatctggagaggcatggcgtgccagtaatgccgcgcggcgatgccccggccgcgcaagcgagactctgccagctcccacgctctctccatgtcggccgccggcgcgggcgcctcgtcgccgaccagcgcgacgaggccgcgcacgtcgcggttggcgagcgcggacacggcctcgtcgaggcggcgagacagggacatccacgcgtggacgagccggtcgggatgcggatgcttcacggccagcgcggcgcatctgagggccaacctgacggcggcggcggtggtgcccgaggtgaacccgaatcttctcaggccacgggcctgcacgacgaggcgcgccgcgacgagcacgtcggcgtcggcgaggagcaggtagtacacggcctcccattcggggaggtaagggaagaagctggtcaggaaggtcaccgatccgtcgagagatcgccggcgtctcgatctcctgcgtctgcgcgtcctccgccgcgcccttctcatcttccggtttctcggggcggcggtgaggacggcgttgacgatgacattggagacgggatccagcaagccgaagcagaggccggcgtcgaggtccgccgccacggccgccggccgcagccgctccagcgcctcctcgtgggaggcacggaccttgtcaaggagcagcgaccggtgcttgtcctgcgtcgtcgaagcaagcgtgcggctccgacagtctcttggctcgatgacgcggcggcggcggtggccaccgccgtcgtccatggcggcagcaatgacggcgctggactgcggctgcatgcaaaacgcgcgtatcggcctaggtctaggttgttacacaatacaccctaccgatgccgataagaattgcaattgttgctgccccggattcagaacggaatcccgataattataagtcttttgacttctttatcagtcaaagtcaaagtgcaataggtttgatcaagtttatggaaaaaaattagcaatacctacaacaccatattagtctcattaaatttaacatcgaatatatcttaatacaaaatttatcatgtattgaaaatgttactatattttgttagaaacttggtcaaactttaaaatatttaactaaacaaaagtgaaatgacttataatatgaaacggaggcagtatttaggttaaaggcactggaacaacatactgcatatagatttgtcttataaagtagaatactaaaaactaaaaaaaatatttattgaatatgttatggtagaaaaatgtagttaaaatatattttggagaaccaaagagaatatttggaaattggaagtcttcgagggtttagcatatgcacagagcaaatcttcgagggttcttaatttcttacagtacagcgcacccttacacaagatttttagcagaagaaatatacattctacatcactacatgggacttcagctgtgctgataaaaatataaaacaaagtaactagatagaacctttttctttaatgtcctgggattcttcagaagcgctctcttttgtgtcctccaatttcctcaaggctccccttaaccccaacacgatgaataaattggtaagagtaagtagtgattctgcactcccgtgcagccagtcgacgttagacagcgaggttccataatgaacttttgctgcaaaaggttatatcaacaagacagttagtactactgactaaatatggggcagagtatgtgagaacaacaaaaattcacaactcgattaccatatatcccagcaggtactgctccagggataaaaggccagtgcatgaaacaacaggaaaggaattaatcatagggataaaatttcccggcacctagctaaaagaacagaaatcaaacatttttgaaagaaaatagggattataggggtgtgtgctaaaggatgatcaccaagtacaaacatttcagtatcaataagtctgcaaagcaggatcaacatagaatgccatccacttgattcgcttttgtgtattctgcctaatccattgtccttattgtgccactttatgctagataaccaaatcagcagtgaacttgatttgaattaaaccacatgaaaaagtcatttcgtgattattcttctcatcgtagtaatttgttgacagattgttcggatagaggctaactgtcatccagaatgactaagctgacagaagatcaattgccatagttcgttggatatccatatagtttaatcaacatgaaaatagaattaaaagtcactaactatgtaatatattatatatgcatccacatagcattgcatttatgcccctaaatctatgtcaggccttacaatgttgctgtgatcaatctaaagagcacctatttttttagaacaaagagcattgtgtttccacacctaaacctatatcttgtcttacaatgttttaacatttacagaccatctatagcctaactgtcaaggttaccatcacttctatcaaaaaggtagcagtcacaacatcacatgcatattcatacccatatgccacttccttgtatttttttcccaaccatactcaacacatttccgccaattacatgagcaatttgagactagagagtctatctatgaagtattattagcttacatatgcatcatctctgcagacaaggaagtattgacattccaaaacattccacaaaatttttaatacgtactactaagaatcagtgatccagggaaaaaatccccaacatatcatgttcagaaaaagctacatctacgtgaacggattaaacacaaacttttgcatcaccgttactttcacgggtcctatcaaggtgttattaccaaactcaagtttgacatgtatttgtcccgaaaatttcaacggcatacgtcggcacaataaaggatacagagtgacactcgaagcgagagagaagaagacgcgtactggtggcgccgacgaaggcgaggaggaagtagaatccgaagagcgtgagtcccggcgccgtcttggacctggtcatgaagtagaggaagccgaggtaggggaagagcgagacggcgaacagctgcgacgccacgctctgggagtccatggtgggcgcccacgggtccacggggagcagcccgcaccgcaccaccatcccgcgcgccgccgccgctctcctcttcaccccgcgagcgcggccgaggccatagcctcccctggctctaccggcggcgagcggccgcggccacgggcacggcggcgcgcggcaggtggtcggcagcatttgggcgtggcgaatttctccactcggtttgggtggttcgcgttcacctcgtggggatgaggctcttaactgggccgggccgtcaatgcaagagccatcggcccataagaaaatcaagttattttgggccgcatgggctcatccttaccattcatctgggccacagctggaaaggtttcttcagagaatcaagtgaacaagcataatatgaattttatattggttaaagtaaaaaaaaatgttactagttattggccaatcttccaagaaatgggaaaaaataaatttacatgaaattgtgttcggtatttttttttgcgaggaaatagtattgaatttagatcgagcgcttaaaactttttatctgtcgtttaatctcgaggagctagcttgacagagcaacatgaatcttgagttcttgaccactagctagtcctgagtcacccaacgtcctataaaaaagaatcatatgcatcgcaagtaaaacggtactaattaattaatcatttaattatatgctagaaggagtagataataggttgagtaggaagtgattccccgcgcattgctatgaaaattactaagtaatttttaatatattttttcgacaatcaaactagactaaaaaagaaagaaaataatgaaacgcgagaattaatcagtacttatcataaaacaaacaaatatacaccagtacaaagtttctatagattagtataaagtgtatatacattagtacacagtttttatagattagaagaaagctttttctatacaggtgtaaaattttgcatgtacatacttttgtgtatatacatgtatacatacatataaatatagacccatgaaagtatatatatgtatagggagagacgtggccgaaattttcacatctaagcacatgcaatcttctaattccaaatatgagaaggtaatggatgaaattctaattttaatcaagaagcccacatgtgtgtgcagtggtcttccatcggacttaacgtcaaacgaaatataacaaactaatggctgcttatcattggagaaatcactagctgtagcaacttgtttaggtctaattgattgtttgttgtcggaaaagaaaatcttattaccatttgcaattggttggatcaaccattacgagatagggcaccgtgccgtcgtgccgttagtctcgagctttctttgtctttttttttcttaatccatatttgatcacttggatgttttcgttttgaaaattggaactgtagcggtcggttgaaatataatcatctgcttggatcatgaaaatcattgacaaatcttaatttgtttcacatagaagctgcatcaacaaagggtaattataatactagcgaaacatgttaatggatcatttgctttgtggctgctagctagtttgattagaaacagaattcagggcaatacatgctcacatttggaattaggaggtcgcatgtgattaagattaaaaaaaatcgggagacgtggggctgggggaatcggtcgcgcggggactcctctgtcaccagtcgtgccccctcctggtcactgacaaggaaaaaaaaaaagagtaaaattagctatgttgggaatcacttggtgtaacactctagtccaaatagaatttggcatatgtgcgcatgtttagtaccaccttactagttagggtggaaccaacttataagttttccttcctccaactatataactttcgagttaacctttttacatgaaacgatgacgaaagtataagcgaaaccgtgtgggtaagtgggcccgcccatctaatgacgcgagcttgtctacttgtctagtttgtggtgaccacgaaatttccccttgatttccattcctttacctccccttagttttcttcattcaatcgataaatctgaattgaaatctccaaattttcaaattgtattcaatttcccttctcagaaaactatcaaggaataagttcaccggaggaccctcaacttaacagcgagatttttggatgtcctttaaccgcaaaatcagaaatcttcacccctaaactatacaaaaccgtccaatttaggtcccatgacagtatatatgcctagtttcgctgacgtggcatccgagtcagcaaaaaaaaaataaaaaaatatgtgggtcccatatgtaagtgaaatgagatagaaaatgtgggggccacttctcttcttctctcttctctctttttttcttctcttcagctcctctcccagggaggctgccgctggtggcagatgggggcgaggcgagccggcgagcctggccgagctccgccgccgccgccgctgcactcacggacacgcgctcacccgctattgtttcctttgccccctgcgttgtcgcttcccctgccccctgcgcccccgctcccgacggcgaagaggcagttccgggcaatggcggatctagaaatttttttcagcctgagcaagtctaatgagatataggcatacatataaaattcatacatgtacatatgtactccctccatccatagaagttagatatattttacatttgagtttttccaaataagttgttcctatttatagtctttatgcatttaagacttaaatgaagagataaattaaatgtttgatgataacccaaggagtcatctaaatactcattttctgcatgcttacattcactccttgattttacaatatataaaatgatttagtttctccttggtcttggtgacaaaagtaatatgtgtaacttttatggacggagagagtactatatatatgatttaatctataatttagtagaataaactcaacgtaaaaggttatatcgattaacgtagcatgcatgggagactagtatattcttgcattagccttaattactttgctaattgacttgttaattaagcaggtacgtgctagtgcagctggtggagccggggcacttgcccgaggtggccaggccgcccctggtcccggggacgttgctcgaggacaagtagcaccgccacctcgaccagatctgggagcgtcccactgccacgacagcggaagtggctggaggaggagtggagcgcggcgggtggagtagaccggcagagcggcggcggcggcggcggcttgactagccagaagttgaggatgcggcggctagtgaggtcgaggcgggacaaggggagggggaagtggagagggggttggagaagagaaggggaggcgctcgccctaaatctcgacagtgccatcggcggtgagcacggagtccacgtaggaagtgtagtttgcctcggcctcgatgaaccacaccccttcgctggtgctgtcgatctcaggctccctgatgatcggcttcatgatgcggctgacgacagggtagtggtggacgaccgatgcggcctggtcctcgacggcttcggcggagacggaggggaatacctggatgaagtcaacgaagatgcagacggcgacgatcttgtcgttgttgtcgatggaggatagcgggagggagctgcctagggtaggctccgcagtgggcatcagcgccgcgtcccccccaacagccggtgccgagtcactgtctcctcctcgccgtccctagtcaacgtcttgtcattgccgccccaaactcgtcgttgcagcgggtcacgaccccactccacctcctcaccaccatggatgcaacagccgctaccaccacatagcctgtgccacctcctctccccctttctcgccggtgcgtccagatggctctctcgcctgtcctcctctaccaccggcgtgttgtcaaccccccctcctgccgctgcatgggaagaagatagagatgttgatggggctgatacatgggccccatatatctttttttatttttattttggtgactaagatgccacattagtgaaatcaggcatctatactatcataggatataaattggacggtttttcatgtttagagggtgaagatttctggtgttgtggttaagggacgccaacaaatctcgctgttaagttaagggacccccggtgaacttattccaattatcaaactccgctgctcaaccaggccgcctccctctcttttcggcccaacctcccggggcccgttaggcctcctctcgcgtctgctgagtagattagtccagcctcctcaaaagaaaaaagaaaaagaaaaagaaaagaaaaaaagagagaaaagactagtccaggctggacgcggtgggcttctttttgagatccaacggtggatcgtcgatagatccaacggcagaaactgtgcttggcacggaaggaacgcgcggatcgatgacgtggcgctgatcctgcctagtacaaaaaggagggtggggatccccacacctgctctcccattccccatcgccaaccagtccgcggccaccacgtagagagagagagagagagagagagagcgcggcggcggcggaggaggaggaggaggagaagtcatggcgcttgtggcgcaggacatctacaccctcgaggagctcaagtccatcatcggctccggcgtggcgtaccgcgttcgtctgcatggggtcgagtccctcgaggaggccatcaccatgtaccgtacgctggacgacgccgtgcagttccgcggttgggcgtgcccccaactgaacaagctggccctcgtcgccggcatcgccgcggaggtggaccgcgtcatcgacgagttggttcccagcctcctggaggacgacgagaacagggtcctgatgcttctcctgaagaatgcggcctggtctatccggaacaacggcaagttggtcgacgcggacgccggaggcatcttccgcgtcaggatgcaccccatcgccaaccgcatcctcaaggccgtacgcctcttcctcaccgcgcgctccaccccaaccggtcgccgtgatcgcctccacgccatcgtctatgatctcaagatcttccgcgagtcctactacctaccaatcccatagatccactcaccggtacatgcgccccccccccccacccacacgacttggttctcagcgctgcgagttttggtggtcatattgatgctgtccatagcctgtagtttgcttcaaatcgtggtgttcctctccaaagctgtacgtacctgatggaggttttgaacgccatgggttgatgggttacgaaagtgagatttgagattctgttagtgtttcctcttgctgctttgagatttgaggatgagatagttcttgctgctttgtgaattgggatacgattgtttctgattagtattgtgcagttacaatacaatgtcatatggtggatatattagctgaaatcaattgcaaactcattttggcactttctgagctctgatgtttcctgacctctgagattttgatgatctccaatgctgaaatgattgggctggattcctgttatgattcttgttgtgtgctgcttgttgaaaaacagaattcggtgcaaaatgtatgtactgtaggtgcttcgatctctgcggttagcagttcactactgcattttggcactttctgatgagttccacctgtttcccctgtgtttagttaataggaaattggaggtagttttgtttctggatactatccttttggcgttgccgattgattgaattagttcatttcaggttagtgattgaattagttcagacgtgtgttctgtttggtatctgaaggaaaactcgttggaatttgggtgttcagcctgtattcgtgtttgagattgtttctgattgggaggctgtctgcatttcgtttctgttgtaggctaaagcaatacaatatgtccttgcgagggatcatttgttcattatctacacacgatctgttttcattgccgatattgtaccatatattttgctaaatagatgtttcgtgtgtctgcagcattggctatgtcaattgcttaccagtgagtctttctttttctgaaggaatgaaaaaatagtactgtctccatccatcattttctttcccttttcccacttctactccattttccgtgcacacgcccataaagtttagagcaattacaagggtgcttgagtttgatgtacagtaccatatatattcatactctctatattcatcacaaaataagtttattttctgtacattccacacatatcaatataaaatctaaaagtactaaatacttttacttttgtcaaatttcaatacaactattcttcatttgtcttctctcaatataattattttatatttttacaaattttgatgtaataattacttaaaaataatattattttggaataaatgagtggagcttttttttttaaaaaaaaaacttattactactactactactattcctttttggctgttcaatgcagcgctgcattttgctacaattaccagcctgctggacctgttaaatcacctcccacccccactcacacagtcacacatgtcaggttagcaagaatgatttggagaaaatggtcatcctgatcacttcccatgttgtcattgttgttgctgctctcaggtcgtcacattctgacttttggaaattgtagcacatgagtacatcaatgggtgtgtttagttcacaccaaaattgaaagtttgattgaaattggaacgatgtgatagaaaagttggaagtttatgtatgtaggaaagttttgatttgatggaaaagttagaagtttgaaaaggaagttgggaactaaaccagacctatatcacatttggtctaaataatctatgcacctcaatgaatacagtttataccgcttggtatttatttgaccgtgtttgtctccatgcattattcaaaaatatattaattctttctactttgtgggcctttcattgtttcagtaattcctcattattaacatattatcaacaatcaatcctacaaacacagcaaataaagaatcataagtctcaagagaaataacagaatgaaacattaccacatccatgtcattacaaacctcaacagtaaacagggctgatagcctgatagtttcggggcaaatgtacgtttaataaaacaacacttgtaactgacagttgcaatactggttattaagaacaaccacacgcacatatttgacatctaaaggtcaagagcatggcaccggctgcaaggctccaagacgtttaactcaactttggagggaactttgagctcgatgtatgtttgaacagccttgagtgctctgtgggcttccatgagtgtctctctgcgcatcaagaagcatttaccaagtctgttcacagaacatctaggcgaacctgacgttgtgtccaacgtaagacattcgagtgctgtcgctgattcaacaatgtgacatgttaactcaaccaaagtcttcacagaagagaaattgattatcttcacacacttgagtttgtcatgacggtgctctggcatcatcctcagacctgaaggatccccaaaaattgtggcacgttccgtgcgttctcggagtgcctgtaaaggtgaaaaaaccaaactatgagtagtgattccaccatatttacataaatatatttacaggatggaacttacattcaagataaaagtctccaagaaaggagaagcatcaaaaaaggaaaccagagaaaggtaatcataggtctgtccaccaagggcaatactcaagtacttgaggtgatagaatttgctaggcaccattggtgtattgaccatctgcaggttcaaacaggtttcattgtaagact

SEQ ID NO: 59060 - DNA, 1416 bp, Oryza sativa
cctctgttgcaaaggactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtctgtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagccgagcaatgtactcaagttagtgttttaattcttaaaacctgcttaacaactaaaatgtggaatggttggcctgggttggcataggacgagctgggacccagggtcgggttgccagttcggtctgtatcatcatcggccttgggttaaggcaggttcgtgtgggtacacggccttgattaatacaattgtatagctctagaatcgtgtttacaaaatagctttgagcaactaaatgtctttaaatgctgattactgcaaaccctaatcccttatattataactcccttgtactcctttgcatttattctgcactcgtgggtgtgtcttgttgagtacggtggttgtactcagtcttgctcaatttttcccaaacccagaagaggtgttcctggatgatgaaggctttggtgtctagctcgtgcctgccatcaagcgcatgtggtcgtcgccctagtcttccgctgtttttcgtttgtcttcatgtgtgctgggccttcgccgcccatgtaataaattaactatttacgcttccgcttgttaaactctgaaatgtatcaacttttggtgtaccttgcctcctgggacaaggaataatacacgcacgtaaggaacgcccgttgggttaattccggtcgtgacacccggtcagaccggctgcacaccctcggtcagaccggcctcggaggaatttttctgaaaattctaaaattgattttgcacgtggatatatgcctattggatcttctggtcgtgtgtttcagtactggattactaaatttttattattatctaacccagtactgaagcttcgacttcttctggtcgtgtgtctcagtactggattactaaatttttattattatctaaccccagtactgaagcttcgacttctgtttgtgtgtaggctttggtggcaaggaaggagaacgtgtggatcgtggattcctgttgttcgcggcacatgaccggtgataaa

SEQ ID NO: 59061 - DNA, 1602 bp, Oryza sativa
tttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcaacaagacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccacgcaccccgagcccagcctaaaaccattttggggattttgaatagaaggagcggtgtgaagccaattccacaataaccaaaccattccaaagtgtccaggtgatatgaatattcccaaagtctagagttgaaaaaccacctagtgttacctaattaaaatagcgaagcatctacctaaaatcatgctagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggtgtcgcgtcccaaaacgactctaaaatacatcctcaaaattgtgcatagaataagtaaaatccatgtgaaagcctccaacaataaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaaaccctaaaaagtctttttcccccttccccctcttgggccggctcggcccagctccctccctctctctcctctcccccgcggcccattcggcctttccccgcgcgcgcgccgctgacgggcgggcccgcccgccaccctcgctgacgggtggggcccacccgtcatcccctacctcgcgccgcaaccgccgcctcgcccgtgccctagcgccgccgccgccgggatcaccgcatcccgccgcccccgcgcgcaataaagagggggaaatcactccccgtgattccctctccctttccccccacttttccctctctctctcccgttcaaacaggcggatttgcccccgcaaatctcgccggcgccattgatggagcccgagagcgccgcgccggtttccttctcctccggccgccctttctcactcccaaccctatataaacactccccgtgcctccct

SEQ ID NO: 59062 - DNA, 3605 bp, Oryza sativa
ccttcggaaaatcataactaaataaccgtagatccgttttaggtggttcaagtttataaatttttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacacccctttgagcatgttgatcccgtttaaagctattattttatttcaactatgcattgttttcgaatgtcatcgggtggtgaacctttcccagttattaatggccgaagatgactttattttcctatgggttataatttgattagcatgaaccttatatattggattggttcagctaaatgctatatataggtttgcttagccatgcttagaaacattagctaactaaaaggggttaaatataaattatattacataattattattgttaataatggttatatttaatggtagctcacgatgaggcacatggtaacatgatgtggggttgtgtcttgtgggtacagtggtacatctctgatcagagtttaatctattcgaatagccgtacccgcggttatgggtgagttgagcaatgtttttcgtgattagtctcacactactcattgatggtaataatgtgataattaatttaattcctggtttggaatggcaaattcctgttttggagggttaatttgttcaaccggggttggttgttcaaatgtggttcggcctatgcaacacgggtgtgttgtatggtgtttatttaatattgattaattattcaactgttttattattctcttaaatatttattaaatgctgttttctgcaaatgagttatattatgccatcctctgttatcctgtgcacttgcatatttgctgtgtggcttgttgagtatgtcatatgctcattcttgcaatattcattcatcagaagaggagtttctcagtgaaggtgatgatctggaggactaggcttgttctcggttgagtagcctgtggagtggagtcgccatagctgttccgtagtttgttatagttttattttccgctgcgtagaatgttttattctttgagaggaactatctacctctgtaataatttttatttgcgaatatttgatagttatttgtactctattatcaatattgtcattgtgtgcctcgcttgattcctggacgagggtttaacacacatgtaagcgtttggaattttggatagaaattccgggcgtgacaggttaatacccccaaacagtgtcctcctggtacttctagagtttcttacgacaacctgtcatggccgtccaaccggggctaaatacggaggagtaccctccccagaaattgtcttaggaatatatactatcgtggaggaatactcgtactgagctgtcaccatcagcggcccacctctactgtcccgcggcatatatgcccaattaatgatatttaataatctaagcaccatgcttacattactacatactattctatacccatgcacccgacatagagcaattgataaatcaaacattaaatccgcaccattacacctctctggtaggctacccacacaatgaatataatgcataaataaagtaagaccggtacttagactaagcaaagtaccaaatatatataaagaagagtatttcattaatttggaaagtattacagaagagattataagagctgctagagccataccgaaaactcttccgaagattccgaggatttccgaacactattctatactacttgtcacgaccggaaataacccaacgggcgttcctgacgtgcgtgcatccatccttgtcccaggaggcaaggtacaccgaaagttgatacaattcagagtttaacaagcggaagcgtaaatagaattattacacgggcagcgaaggcccagcacacaaagacaaacgagaaacagcggaagactagggcgacgaccacaagcgcttgacggcaggcacgagctagacaccaaagccttcatcttcaaggagctcctcttctgggcttgggaaaaattgagcaagactgagtacaaccaccgtactcaacaagacacacccacaagtgcataataaatgcaagggagtacaagggacttataatataaagggttagggttgcagtaatcagcatttaaagaaatttagttgctcaaacctcttttgtaaacgcgatcctataactatacaaattgtattaatcaaggccgtgtacccacacgaacctgccttaacccaaggccgatgatgatacagaccgaactggcaacccgaccctgggtcccggctcgtcctatgccaacccaggccaaccattccacattttagttgttaagcaggttttaagaattaaaacactaacttgagtacattgctcggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtacagactatagttgaaaaaccacctaatgttacctaattaaattgcgaagcatctacctaaaattaaaccactagttgaggttttgtttgttctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcactttcccaaacgtcggcttcaacttccacgaagagcgtatcctccgaagctgcagcgtctacacgaccaacggaaaagaaaaggcttttactctaaataactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagggagcgcacggaccgggtccacgggagtggggcccacgcggcagcctcacggtccacggtggaccgggcgcacgcggctcgcgccggccggcgccgtgggtcccacgcgtcatccgctcccgcgggcgcgggcggctgacggccgagcccacctggcagccgcggggcgcgcccgaaggcggcctcgccggcacggccgacggaaggcggcgcacccgagagagaggagggaagggggaagcgaacggagcggtccacggctcaccccgggacgacgagggcggcggaaacgacgaccggagcggaggaagacggcggcgcggctcgggtcgacgaggacggcggcgttccggcggtcggcgggcgaaacggaggag

SEQ ID NO: 59063 - DNA, 8121 bp, Oryza sativa
aactggcctcaagtgcatcccacatgtccttccctgaaagcatgtgcatgtacatgtccactatattgtcagcgagtacactgatcaatgctccacggaacaggcaatccgaagcctcgaacttagcctcctcctcaggagagagaggcggttcacttcgtttgccccgtgaaacatagaagcattgcatccctgtcaaccacagtagtgcacgtgctttccatctcttataattagaaccatcaaaagcatgtggtttcagtgttgcagcaaagccaactaccgaaaatgacctagcaggtttttggattgttggaactttggtcataattcggcatattttaatccaaaataacaagataataaacatgatatttacaatgggatttgatccaatgatagtggtgaatgcaatcaacatgagcatgcttaatgtagaataagcatcaacaatcacataataacacaatgttgacattgcgatgaacattaacagtaaaacttctaattgaaataatgtaagaatgttataccccaagaatggtcatccgctggagtttgaagcagtattgcctccgttggtgttgacgggagcctccttctccttgtatccagtgttgccgttgtctccagtgttcgacatattggtgaaggtgaagtagatgttgacgaacagtgagtagtcacgcgttgcgctccccaaaaacccgatcgcccgcccatccgtgcaaatgtcgcagcagcgcgtggtttcggagacctactctcccaacgcgtgtgcacacactcgtcgggatgggattaccgtagcagcaacagcgttggaaaatggatgaaagtgtgtctcactattctcgcgggagatcaaatccattctcattttataagaggaatggaagatgaagagtaagagtcatagaataggaagaggaatagatcaactaattgtcatcaactagccatgaaccatcctccactacacaaccatcaaccaacaatcaattaagagtaattgatgtaagttaccaatggaataggaagagaaatagagcaactaattgtcatcaactagccatgaaccatactccactacacaaccatcaaccattcatcaattaggactaattaatataagttaccaattccctaatcaaatggattaattctcaaaactcttcatcccattgatatcccataaaaaaatgaatacacatgaattcctagcataatgagccttggaatttatttgatttaattgatttaaatggatcaattacccaattaaatctatcagacgagacccatatctaaagtcctgggatgggacgaatagtcctccgtcccgtattacttcgtcgctttaagattttgtttgcaatgtttgattattcgtcttattaaaaaaattggaattcttatttattttgtttgtaacttgttttattatcaaaattactttaagtatgacttatttttttatatatttacactaatttttcaaataaaatgaatggtcaaacgttgttgtaagatatttattatgggacggaggtagtataatttacttgtgttatgagttgttttatcacttatagtattttaagtataatttatatcttacacaattatataaaatttttaaataagacaatggttaaacatacgctcaaaattaacggtgtgatccgttaaaaaacttgcttctgtggaaggccggctcactggaaacgagatcgaggcgatgacgacatctgcattttgataatccacggatattaaggctccaacagtagaatgttcacatgatctcacgtcgtcacatgtttatcttctaggagtgagagtgcgtgcgtgctcgctcgctcgctcgatcgatcgaaatgaaaattcaagctgagcgtgtgcgtgtgttcacccatgccccattattgctagctagcagcttgtttacaacaacgcggagtggctccctcactgtgacgtgccccgcatcaaagcatgggtagaaaaaatggcagcgtcgtccatccctttcttcgcaacgccgggtcggtttccccgtggcggacgtacgccgctgcgaaacggccgaggaagcggaaagggaaacgggcgatcgtcgtcgtcgtggtggaccagtagctgtagctgtagcggcacaagctgagggggagaagtagaaatgagaatcggggggggcggcggctaatggccacaggaatacgcacgcgagtaggagatcaagatcgcggcgggtggcgggtcggggcgtatagtttaaaggcgtgggtcgtggcgaggagcgccccacgtcgcgccgcgccggagccccggagcgccagcgccgcaagggattttttttttgccctctcttcacattctcatttgtgtgcgggttcgccgagcccgcgtcgcggctgcagctaggggagggtggctacgacggctgttcatggagattaactgcagcttgattttactggtatggttaatttggcgtgaggcgttgagcagcctttatcatttcctcgcttgaaagatatcagctgcggagtattgtgaaaatcatttccttgcttaaaaaaattggtacagtacattgttgtgcagtaactttagcaaagctgtatcttgaattatggcacattgggcgttgaaaagggacacgtttgaggcccgtttgaactgattgttttatgaattatttccatattcaattatgattatgtactcaacaataagaataaattaatcattgtaagaagataattttaatgagtacagcttagaacaaagagtagatgtcagtatgtcacacaaccctatgtattttggtttaagttgcagaaagctttatgatatgtcatatataaccacagatattatgacctatagtctcataaacccacactgctaaccctttttatctactataaatatgatttctaaacttataaccaaaattaaatttataagttcgtttaatccgtcgtctaaatgttatcatcctcattatcactctgtgcattctaaaatataaacatttctgcacatatcctaaaatgcttatattttaaaatggagagaataaattaaaatagtcagtagtgcaattttatgaaacctgaagaccataatacctaggttatgcaccgcatatcaaaaccaccatggttttatgcaactcgaaaataaaataaccagggttctaaaatatactccttatggtagaagaagtttcttttgtcgagcaaatatatttttagagttgtggaatgaataatttgcgaaataattgcaaagtagctgaacgggctcgaatttaaacttttgtccttgctaaaaatttaactttgcctagtttgttttttgtttaagaaaaaacatttatcaacaaacacacggtaagtaacattctgcattctgccactgcgttaattcatcttgggtgaacatcatatttacccaacccacccgggttaggtttcttgtggtggaaccagtccacccgggttcaaattctagacttgacacgggtgctcgcatttatggctaattattctttcaatggtaggcgacgtacccgtcgacagcgaaacgcctgtggtgacttcgtcaatctcaagatatgccggcccagtcttccggaggtgctcataggggtagggtgtgcgtgtgtgcgttcataggggtgagtgtgcgcacgttgtgagcgtctgtttctaaaaaaaatattaggtaaacatcatattcaattaatattgttttcgatgtttagcagaagtactaccaattagaaaaagtagcatagtgggccatttgctgaagcgattggggtagcggggctcatctcatatttgcagcgactacaccattttttttgcttgtggactgtgctgtcaagacaagaagctggctggttggtcattggtgtcctggaaggcaacctatcttcatttcccaccacagttttatatgctccactttctctatccctttctttctcactctcccctcttttctctattgcccaaacacacctctaattataaatttataatatcctttagttcccataggccaagtttaaaaaatatatttgcatggtcaggaggattcatgctccatgtttttttcccttttggccggagaccacgcgttttgcaactgggcgattaatgaaaaccaatgtgattgttcggcacggtcacacgatattaaacacaccaactattttaatttcgtttctaaaagaaaaaaaactattttaactttagatgcgtacaaataaaatgtcaaagaaatataaaacaaccaaccatataaaattccttatgaactttccacctctccctcccaggcaatgcctatagcttaaattgcgaaaaccgttagttgtaaggtccaataataaaatgagcaaaaaaaatgcattttaaacatccagttttggcaggtgtttgaggggaaaaagaaaaggagaaagagcaacacaattctttccaattcttacagtagacgacatcgactattcagttcgggtaaattttaccaaacggccatgggctcaccagtatccccagttccccaccaccacgaaaccgcacaaaagccggtgaattttcccgtaatttgaccgaaaactagaggccaccgcgaaagcgtgattaggccggacgtaaaccgaaaccgggaaaaaggagataaaaaaaaagaagggaaaaaaaaaggtgaggaggaaagaataaagcaaaacgatcagaaaattcgatttgtttaatcctctcccccttcttcctcgtccctctgctgctgccgctgctgcttctcccccttccttctgtgccacacactcgcgaggagaggagagaagaggaggaggcgaagaaaaaaaaaacctaagcgcttttccctttcgggaaattccgcgcgctcgcctcccccgccgcggcgccaccgccgccgcccccgccgcggattcgccgccttcctcaggcggcgcagcgtgccgcgcaggcgtcgtcgtctcggtaacgtgtggctctaattcgtttttttttttgggtaggaatgtcgctgttaggggtcgacgagttctaatccgtggtctaaccctacaggtaatcgcgcgaggggtcgtggtcgctctgggatggggttgtggcgctgagatggtggtgggcggcgcgaggttgtgttcgccgtgaggtatggttcccaaccgctgaaatttgggggggcgcggaggatggtccggcgaggggtgatctcattgcgagcaggatggcggggacgcatggttttcgtagggtaggcgtggtcgagatggaagcggcgacggcggctgaggtggccggtgccggcagcggcacggatggcgatttgcagattaaaggcagcaaggagaatggtcagactgcggagcagccggcggccagcgaggcgcttgagatgccctccactccgctcccgctcccgagggacatagattggtcggagcatttctccttcttcaattcggtgggcgggtttgggggcagcatggatggcgcgaggggcttgactagtgttggcctatctaattctgagtcgaggccggatagtgtaacccagatccagagctgtttgaacaatgcagacgagagggttgaggagctcacattgaaaaattgcatcagctccgatgcgcaacatgaggtttcagctggtggaagcacgagcagcggggagaagcctacagttatgaggggtctgtggggtaattttacaaggatgtcatggagagctagcgacgtggctaacagggaaaaattagcagcgaatcgtggtgacgttgcaaacttgagggtcggtgacatgcccatcagggaaaatttggcggtgagcttcggcaacaatatgatctcacgaaatgatgcatccaacaaggaaatgggaatgagccatggggatcatgcgaataacgagttcaatttgccgtttggtaatcagcagccttttctgtctccacggcctaatcagaatgagcagcgagttgaaagggagaatgctctcatagtgagtagcttttcagctagaattctggatcagatgaggagtaagaatgtaacaccttcgtctggggttcagagcttcccatttaagagtgtgttgaagggtaaaggtgttgtatatcaaggtgcacgagaggagatccaagttcaaggtaatgcaaggaccagagcccctatggataagattcgcaagatccctaacataccacaggattccatggctagaatggatggtacaatctttggcagtggtggaaatgttttagaaccacagtgcgagggaaccagcctaagggaactaattaagcctgcacgccaaacaatgagcaagtttgagaaaatgcacttctttaagcagattcttgatctcgtagacaaatctcatgcccagggttttagtttacagcatttgcgcccatcatactttactatctcagcctcaaaccaagtaaaatatattggttcttatggtacccaagatttatcagccccaagcaaactggatattgcgacggatgatattttcaatacaaaaagataccttgatcccaaagttgagtcccaagattctaatggcgataatgcttcaatcacaaagtatcaaaaagttggtgaacaaggatccattgctgtaaggcgaccagtgcataccttttgggctaatcacagagggggcaaccaaagtgaaggtgttgatcctggtgctttgtggcagggcaattcgagctgcactgtccgagaacgttttaaggctgcagaacctttctatggtggcagtatgccctatgctcaacgaccatcaagttctggcaaccaacagtcagtatttgaattgaggatgctggaggaaagctggtacagaagtccagaagagatcagtcagttgaaaggcatacttccatcaaacatctacagccttggggttcttttgtttgaggtatgccaattgctttcatcacatatcctgaagtagtcctccaaacactttgtagtgttagaaaagtaaagtgacattgtgcaaatgctatttattttcttaccccatgaggttgtttgtggatgatttttactcttaagccatttgatgaggagttcatgctgtttttatggttccacttatgagtagctgaaaaattgggacatgtatagtgcagagtttcctacttatcctactcaataataagtatatgagtatgctgtctcccttatttgtttagcagcagttggattgctgaaatgatcggttactattatcataattgtatttctacgaatttgagatatacctgattgagatgtgcaattctgactgacacaatgcaacagtcttcttgtttgatgaaataatattgtttgcttatctaagctgcatgggcatattattattcttttttttaacatattcagtaaaatctaatctagccttaactagtacagaaggtctacaggatattccattaatagacttcgcatgtgcacgcacagacaatagattatgatggctactggaaatcacattgaattttatcatttctagtttccgtggaattctttggtgctatcttaagcctggcttgtagttgacaacattctctttcctaccagctcttttgctgctgtgaaacatgggaggtacattgtgctgcaatgtcagatctccgtcatcgcattttgccccaaattttctttcagaaagtcctaaagaagctggtttctgtctttggttactccatccagatccctgttctcggcctaaggcaaggtgagcatgcttgtctctctcagcggtcatcagaaagcaagatacttggtgattaattggataggatcaaatattcatagggttacattttggcaatttcgtaagttacacttcatactctaggcagttcatttggctggtggagtaaaggatgagatctcaagcataattaattaattattagtttgttgtacctggttacttaatgctcctggctcctgtattaacttagcttgcttctattttttttaatatagatacactgctagggctggtattttgttgaatgttgaactgttgagcttt

SEQ ID NO: 59064 - DNA, 9749 bp, Oryza sativa
tgtctcttgaaaactcttgaaagcaaaaggtttgaacaaactggctcaatcagagtagttgtagtacaactgaacaaagaaacaactgtagaaagttatcgtcttttcgagcgtgcatacgaatacaaccattctaacaccaacacacaggttaaaacaagaacctttttctctgtcatctttctcgagttccccacccccgattgcatggagaagagaactagtagtaatagtgtatacactctctgaatgtttgcaagtcattgacatcttctccttgttacctgcatttcttactcttggatttttctcatccatctaagataacacggcaatctgcagttgggaattaaaaaaaaaaaggaaattagagtagctgcttggaattcgagggtggaccctttgtcagattgattcgtggggccgcgatactgtcactgccacactaaacgcagtgactactccctccgaaaaaaaaaatatataaaccctgttttccgtatccaacgtttaaccgttcgttttatttaaaaaaaatatgaaaaaaattaaaaagataaatcacgcataaagtattaatcatgttttaccatctaacaacaataaaaatattaattataaaaaatttcatataaacggacagtctaatcattggcacggaaatccagttttttttttaaaggacggatggagtaccagtgaattaaaagacgtgggcaataaatgagctgagctgagacttgcacgtccataattaaaaaaagaagaagcaaagtgtgggtacacgtgggccacacacacgccactagcacaccagttagccgaggcccagctagccgttggagcgaataggcttgaccaaattgaccccacgttgctgaccgttgcttcgcgccaagttcccttgaaccatagggattttgaaaaaaaacatactacttcctccgtcctaaaatgaagccatttttaatattgacacgggtattaagaaagtaagtgaaaattattagaggaagtgtgtgattggttgaaaagagaaagtaggtgaagaagaatggttgtgattggttgagaggaggaagtaggtgaaaaaatagcttcattttaaaataaaactttgtccttaaaaataccttcctttttggaccggagggaattttgtgtttgccttctttttgttgatgctgcatttgctgcgtggttaaagttcgggagttgcttgcaaatttctgacggtttctatgcgtggctggtgttcgtgcaaatcaaatccgatgtggagaggcagggcgatttcatccggttcctgatcaaggaggtggaaggcgccgcgttcgtcgacatcgaggacgtcgtcaccttcgtcaagtggctcgacgttgagctctcacggctggtgaacttagccagctacatccattcactctcacatgaaacatctgcttaacttgaagctggacatggactgatcgggatgttcaccgtgttgctgcgcaggtggacgagagagcggtgctgaagcacttcgagtggccggagcagaaggcggacgcgctgcgcgaggcggcgttcggctaccgtgatctgaaaagatcgaggaggaggcgtcgtcgttctgtgatgatccacggcagccttgctcttctgccctcaagaagatgcaggcgctgttcgagaagtaagctgtcctgcattggcccggcttacttaatgctgatttgagcaatcagctatgtgctagttctggtctgctatttgtgctcatcatctttgatcattggcaggttggagcatggagtgtacagccttgcgcgagtgcgagatggcgcgatgaacaggtaccgcggctatcacatcccatgggaatggatgcaggacacaggaatagttagccaggtaattcagtgtttttcttttcaattgttacgacatggtatctggttttaagtagaacagcaatgtagcacgaacatgtacaaataatgtcatttgtgcatgcttgttttggttttttcatgcaccagaacacgcacaaggatgcgaaaaacattaacacatataagacatacactcgagataacaacaaaaagaatttgggggtaaaatggccaggtctcgggggaccaatgaaaaggctctcaaccatttgctgggatttgcttatttgcagtgtaatgttcatgtgtgccagggggctctcgtgagtctgtttttttgttttgcatgtactggtagcagagaatgttgatcgtatttttaattcgacatttgtttttgctgctaacatggacccattcttgttgttttccactaggaaatggtccaaatgattgtttgaaatttcctgcatatactagtaggtggttcttttacgtagcacatatgatttttatcttgttcaagacattgttcgtcaaagctccttggtagaatggtatatcaacgtaccacctagtgccttgacagacttccagctaaatggcatatatctcattgctggattcggatcagcttaagcagtagtagtgcatgctattggatgcaaatcggatgatccagattgcatgctgtactgtacatagtactgtagcaaaatactgtagcacgaaatactgtagccattactactgtagcgttcgatctgaatcgttgaatgtaaaaatggatggccaaaattatgtgcagtttccccattgctagatgttacaacctcttttctagaacttgctgcaggattgcttctgctgtaactacactacttccatcattgaacaattagtagcatttcaatgacaaattgaccctgatgtgcagatcaaactccagtcagtgaagttagcaatgaaatacctgaggagggtttcctctgagcttgaggccataaaagatggccctgacgaagaggagctgatgcttcaaggtgtccgattcgccttcagagttcaccaggtactcaatcagaacgaattcactaataagtgctcatgcagcactagtgcataggagtactacttatctagtttccattttcttttcacgaacacttatcaactttccgtagctcagtatggtattcaatccttttgttccatgcagtttgcaggtggattcgacggtgacacgatgcgagcatttcaggagctcaaggagaaggcctccacgttccaatcgcaacgggaatgccaaaatcagcatttgcaacagcacaagctcgctggcagaagctgaacgcctgaaacgatgtattatataccactcctttactgtaggagtataggatatatacccaatgtatcaatcaccatggaacaattttctctcaaaagtatttatttctctctcctcttgatctgtactgtggctgggagtccgggagtgaagtattaacaacagttactttcatgaattgtgttcatgtacaagaaagactacaggtgactcccactcttgtgctctaatttctgaagacagaactacagagatcacacagatcagacaaactgcatttgagcaagagcacagctgaaaagagaaaactgaacatttgctcacggagtcatgagtcatggatggagagtctcgcagggcaagctcttggagctagagcttccaaccagcagcttcacactggtcaggtccacggacgccgtggctctgcgcaatatggacttcatgttcctgtcgaggctctgcttcactatcctgtccacggcgttccggcgatccttggccccctcgccgccgtcgtcgcacgacgccgacgacgcgccctccatgcgagggccggagtgcgccctgatcctgtcctgcccttcctccttgaaccactgcaggatcttggccgccctcctctgcgccagggggctcccgaggagggacacctcgaggagcgcctgcacgacgccgaaccggcgcatccgccgccgctgcagccggctgccgtgcgcgagcaccatggcgaggtacgcggcgtgctcctggcaccgcggagcgtcgtgccacgtcatggcctccacgagcgccctcggcgccgcctcgtcctcctccatctcctccctccccgccgcggtcgccgccaggtcgccgaggacggacagcgccgcctccgacgtcttccggtccagggagagcgccaggagcgcgcgcaccgcgccgctcgacgccacgtcgcggacgtgctcgagcttggccgagaggttgtggagcgcgcccaggcacggcagcttcgtgtcggccggcgcgtcgtcggcgctgaggacggcgacgaggaacgggaggagctcggaggaggcgagggggaagtcggtgttggccagggaggagatggagaggaggaggagcgcgagctcctggcttcttgacatgtccttgtcgtccatgagcaatggcagcttcttcagaagaccggcctgcacaatgtgcaccttgtttctgaaaaccaaaaagcattgctacccattagcagagaacttagatgtcacaactactgaagaatattcagtgcaccgtgaactattgaatacattagaaacagaagtaaaagtcaattacaatataaaagcaaacatgaacatgattaaggtgaaaacaaatgagaaatgctttctcatgtagcaagcactacttctcctgcagttcatgcatcatggtctactagattacacctttgtttcatatgcttccacgggtgtaattgatgttagaaaattcaccattgtggaatatctgatcctacatgatgttgtataggcatatgaggaaaacagaggggaattcagtgtcagtctacatcaccacatgtaaaactgggattccatattcctgagtggaatcacacatacgagaacatgaggtctactttttctacagcactactccctccgtaaaaaaaaaaaaagacaaaccctgggtttacgtgtccaacgtttgaccgtcttatataaattttttttataattagtatttttattgttgttaaaatgataaaatatgacttatactttatgcgtgacttatctttttttttcataatttttttaaataagacgaacgatcaaaagttggacacggaaacccaggtttattattttttttttttggacggagggagtactatacactatcaacgcagtcacatcagtgatgtcacacggctgaatttgcacaccatgaacatgggcggctctatagccatatccacatagaaaatgcccttttatcatgcatgtccacacatgggtctatttagtgttcttttcgtagaagtgattcaaacaacgaaatgaaacacatggttaggcacacttcggtacgattctctcaagaaaacaaggaagataatatgtaagaactatgaagtttggtattgctccaagtcaatcttcagcaaccggcctatgcataatgcatgcacctgccgaatattatatccctgtgctgcctaatactaccaacgaacaatgctgaattttgagtcgtgtaaagttctgacattttgttcctggtcaatgattctgtcatgaagcaatggctttaagggactcaaagaaacaaaagtaggctcaaccacacctaatgcctacagaaactagaatgcaagaaatgatgtggcgtgtgtggctgttgtgcatgttcagatgttgttatggaactattggacaggctagagcagctaatatcactctcaattcagagattgaaagcaattgttgtcagaaatgcttgtaggttgagacatagtaaagctagctagtttcaagcctgaattctctgccagagacttgcagtatgaaagttgtatctggtctttgcatggtccagttgctcttagacattcagatcatggtgaatatgtcagtatcgtggctatagtgcagtctagatacgtggagatgtaacaaccaaaacgtattaaattctacttcttcaagaagagcgtacgggcagttgagtctcaagatcaactttgaacagcaggatcaaggctatgtgcagtaaactagtaaagttccatgctaattttctgctttagaaaaaggtttacatgttaattaacttgaacttgttggaacagcgtagatcatgacaagtttaaaaactaaccgaattctcagcatatacgtttccagagaaggaaagcaggataactcagccaaatgtgccaagttgatcaagaagatcagagcgcggcgtttccttttacagttctactcattgcaagaaccagtaactattcttcgctcatgtttggtccatgctttacttatgacaaaattacgcaaagcgtaattcccactcggatttaatttcagaacaagatcggtttcaacttcatttctctactgtatctctaccctgagaagttgcacttcatttctcagatcgattcacagaacgaaggtgatgctcaaaaaacaggttggcatccgaagcatgaactgaaagtctgaaactgaataacggatggctcaagcaaatcgcaaattcgcaacacacgggaagatatactactgacctgtgtgctcccctggcgagctcaagcagcgcccccgccgcggccatcctcgcgccggcaccacctcccctggcgtcggcgagcatcgagacgagcggcggcacgacgccgagctcggggagcagccgcttcctcccctcgtccgagcgcgccagcctcccgacctcccccgcggcctccgccctctcctccgccgtcccgaagctgagccgcttcaccgccgccctcatcctcaccgccgccgcggcatcatcgcccgctgcctccatgccgatcgatcgtacgcggccagcctccggtgcatgtgcagctgcgcgctacgagacgagacgagacgacgcagccgtgagacgcgaggtgggttaacgtttttttcgcggcaaaggcgcggggttgggttgggttgggggggcctcggcgtacggtggtttttgggggaaaagtgtgtgggatttgcgtggttccgggcgacgtggagagcacttgggggttggggtcgcggggggttttggggctttgcggggaaaaagcttggtgcgtgcggctttatcacgggccggtgagccgcgctgtctactagtgttggtgtcgatggcccgccgcctctatcaaccggcctaccaccgtaccaaggccgttgtgatctcatcacactacaattttacaccatgttttagtatggtttttttgtgtgtgtgttctttgatcataaactgtttatctgcaaactgcaatggcatcatagagtcgtgtccttagttctaaaattctgtctgcgtaatcattttgttctggcttaaacccgcctgcacacttgatgactatgatgatgctagtgacatcgtcgggaatccggtcgttggatatatcatcaaatctgcttaaacccattcgctcttaacttttgcacactcctacgtgcttactgctttggcatttatgatgtggccgaagctggccgccgaactcaagatcgctactagtaccagtgccgctacatcaggcgtatttccgtttgctcgatcggaccttgacagcgttgtaaatgctccaactaattaaaagaaagttcaactcaaatgcaacctttctaaaccaactaaaggaaagttcgactcacaggcaacctttctgaacatttcgatcgatagccccacactgagtaacatcaatcacgtacaaatattggagcagatcttttggtgcaccttggtaggctggctagcttgagcatgcgctgatttgataaaaaataaagaggcaaatgctaatatgggggtggtggtggtggtctggtgtgggtcggctggatattggatagaaaagaaaggcaagactatagtggagcattaagctatgattactccacttgatgataagtggagtgcttggacaaggactaagcccccgtaatcttatcctgtactactgctaattgtgtaccacgtgggcgtacgtgctcatgtgcaacgagttggcactgtaccgaactaactgatgaacaaacaagtgtacgtgcatgagcatgcatgatacttctatcatgtacactcctgagtaattgacctgtttctgacaaagtttggcaacgttactaacagtactgaagtacagtacgcatgggggtattatgttaaaaaatccgaatgggcctcaaatctggcctggttaagatcctctgcctttttttattaggccgagattgaggcccatataaacaaggccttcacgggctatgtcgctctgctgctttttatcgggccatctccaatactgggctaaatagaagtccacactctccgctctgtcgttgtcggagcggatccatgtgacccacagatatatccccgcgacgcagccaccgattgtgactactgtatacacacaccggtgcttcgcatcgcagccagggtttcacttatcgcacgataatcgcgacgtagccaccgattgcgactactgtatacacacaccagtgcttcgcatcgcagccagggtttcacttatcgcacgataatcgcgcgattatcgcgcttattgcggggatacggtagaggaaaccggcgatatggtttggatgaattttgaccaaattcaaaattccgaaaaaaaatcaaaaaaaactgaaaaaattcatggatgtagttcttgatttgtaattgccaatggtgaagaatttttttaaatagagtaagataaattcaaatttgaggacaaaaccaaaaatggtttacagattgaaaaatgaagaggatattggccttaagtatcctgcatatttttgattattctcagtttctagttttctacacatattcaaccgtatttttgattttttttaccctatttattttacatttacattatttcagctacacagcccgcgataaccgtgcgaatatcgcggtaaaccgtgcgattatcgcggtgaaaccgcgaaaccgttgagttttgaattcaaatttttggatgtgatttttgtgcgattttagacgattatcgtgcgattatcacggttatcgcgctaccgcggggtggcgataaccccgacccaaacgataaggtaaaccctgattgcagctcacccctttcgccaacccaaacggccaccgatgaagttgacacaaaccctagcccaaaatcgcacatcgcttcacgtaatctaccgtaaatgtactttctctattaaaaaaaacaaactctaactatatatctgaacatacataaaaaaaataaacatagctagaggcaaatgctatgatatatgtctagatatataacgagtcttttttttaaggacggatgaaatacgttgcaccgttgcacgagcacgtattattttttttcaaaaaaaaaatagcttgacttgctcggctcgcgctcgcgcatctccatgcgttgcacgctgaaaccgacaagttttttttttacgcgctgctcgccgccgcagccgtgcacgtgatcccatccccccaaggacgtgggtgccacgtccgcgacgcgacccgctggcgctgtggccccacacgcctcgacgcatcgcagccgcaggattcactgattcactcacgctgtgggtggttgggaagtttttcacacaaaaacgagattgctcattactagaacataattaatcaattattagttttataaacttaaaatttgaattaatacgattttttaaaatatttttttataaaattcttagagaaacgtaaaaaataagggagtagaa

SEQ ID NO: 59065 - DNA, 6613 bp, Oryza sativa
ctggttaacaactaaaatgtggaatggttggcctgggttggcatagaccgagttggacccaagggtcgggttgcaagttcggtctgtatcatcatcggcccttgggttaagccaggttcgtgtgggtacacggccttgattaatacaatttgtatagttataggatcgcgtttacaaaagagctttgagcaactaaatttctttaaatgctgattactgcaaccctaaccctttatattataactctcttgtactcccttgcatttattatgcacttgtgggtgtgtcttgttgagtacggtggttatactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgctgggccttcgctgcccgtgtaataattctatttacgcttccgcttgttaaactctgaattgtatcaactttcggtgtaccttgcctcctaggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgtcttgctgcttcatttatcgccaaaatctaacctttaaaatgttgtttttctttttgtttttgtttgtagatggccggcagcgtcacccgtcgtggtttggacatgactggcttcgtcttggagctgcggggcatgtgcgtggtcttggggtatccacatggagtggattaccaggccaggccgctcccggagcaggagggtgaggacgcggagccccacgctggttgggaggtcactgcagtgatcctttctggctctcccgagcggacctcgctggcagtcaccgcgggtggagattccttccccgccgcttgccagaacgccgctctcctcgccatcggcactcttcaccagcgctacccggacgagttgcagcactcgccctaccgctaccaccctcatcgcggaggagcccgcgactacgccaccttccgggatgctagctcggaggatgacgctaccatcgtgcacctggcacgcatggtggaggcgtacgacgcggctcgtatcgacttccatcagatggtgcgccgcgggatggtcgagaacaacttgaagatcctggagctgcgtcaggagaacctgcagcttaagaaggacctagacgcggtggaggcgcagctgcatcagctcaagatcgcccagggagaggactgccgccccaagcgtcgccgcgtctgccgcagccagaagatcaccgcccgcaagagcacctccaggcccgagcttgttcgtcagtccctggcatggacctgcttcgtcgagacccctcatgccgagcctgcgcccgtggttccccaggagggggaagcctccggcgtaggtagcacggaggatgcgctgttgctcaccttccgtcctggcccgtcgcagcggtagacgagcagttagtaggcttgcgcgtgtgttctttctcgtttgtctttttgagtcgtgtggggcatggttatgccggtgtgtggtataactatgtcggagcctgtcttattttatttgcttaagcaacttgaactataatgaaccaatttaatagcagtaataaattcaagaattatggtagtcgtggtcagcgttaattgttagctctctctgtttgctggttctgtgtggggttttcagatggtgacgaccaagagaaatgttaacaccggtgatggcaatcaacctgaaggcagcaaccacaaccaccagtgcaacccaccttcaccttccccttctgctacaccaccaccaccacacaccaacgccattctcacccaaatcctcgcccagcaggccaacatgatgactgctttcctccccacatccaaaatccgccacaacataatgctccaccaccacccccacaacactctaaactcgccgagttcctccgcatccgcccacctaccttctctagctccaacaaccccatggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcgtggcccttaagaaaagagaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgttcgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatctctatccagggggatcctcctcacagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggccagcagcgtctgtgcttcaactgcttcgagcctgggcactttgtggataaatgcccaaagccgaggcgtcagcaaggccaagcgcctccccgctccaacaacggtgggaaggacgtcatacgaggtcgtgtgaaccacgtgacggccgaggacgtgctgacaactccagacgtcatcgttggtacgttcctcatccattccatccctgctaccattttgttcgactctggagcttcccactcgtttatatctgtgccattcgtggggagaaatcagttgggggtagaaaggcttagaaaccctctgctaatcaccacccctggaggggttatgacagcaaagtactatagtcctgccgtccctatagaaatccaggggattccttttccctcggacctgattctgctagacaccaagaacttggatgtgatccttggaatgaattggttggctcaattccaaggagtagtggattgcgcgggacgcacggtcactctgtaccgagggccggaacaaccggttgttttctttgcacccccaacctctgtcagaagttcagaagtgcatcagatagggctgtcagaaatccccatagtcagagagttcggagacgtgtttccggaagaactacctggtatgccgcccaagcgagagattgagttccggatagatcttgctccaggaaccactcctctgtacaagcgaccctaccgaatggcagcaaatgaactggccgaagtaaagaaacagttggaagagttgaaggaaaaggggtatatacgtctgagtactttcccatggggtgctcctgtgatttttgtggagaagaaagacaagacgaagaggatgtgcgttgactacagagctctcaatgaagtcaccatcaagaacaagtaccctcttccccggatcgatgatctgttcgatcagcttaaaggtgccactgtattctccaagatcgatcttcgttccggatatcaccaattacgtatttgtgaagaagatattccgaagaccgcattcaccacgcgatacgggctgtatgaattcacggtgatgtcgttcggtctaaccaatgcacctgccttcttcatgaacttaatgaacaaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgcccgaagtcaaattcttggggcatgtgatatctgctaagggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccaaactctcaaagaaaagctggtttcctcgccggtgttaatcttgccggatactcgcaaggacttcatggtgtactgtgatgcttcgcgccaaggattggggtgcgtgctcatgcaggacggtcatgtggtggcctatgcctcacgccagctacggcctcatgaaggcaactaccctacccatgatctggagttagccgcggtggtgcatgctctaaaaatctggcggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggttgccgacgctctaagtcggaaaagccattgcaacactcttgacgtccgtggcattccacccgaacttaatcaacagatggaagccctgaacctaagcatagttggtcgtggattcttggctgcgctggaagccaagcccaccttgctcgatcaaatccgcgaggctcagaagaatgacccggacatgcatggactcctcaagaatatgaaacagggtaaagccgctggtttcacagaggatgaacacggaaccctatggaacggaaagcgggtatgcgttcccgataacagagaacttaaacagctgatacttcaggaagctcacgagagcccttattccattcacccgggcagtacaaagatgtacctagacttgaaggagaaatactggtgggttagcatgaagcgggaaattgcagagtttgtggccctatgtgatgtgtgccagcgtgtcaaggcagagcactagcgaccggccggacttctccaacctctccaagtaccagaatggaaatgggatgaaattgggatggatttcatcaccggacttccaaaaacccaaggtggatatgattctatatgggtattatggatcgattaaccaaggtagctcaatttattcctgtgaagaccacctatggagggaacaaactagccgagctctacttcgctaggatcgtgagtctacatggcgttcccaagaaaatcgtatctgataggggaagccaattcacctctcacttttggaagaagctccaagaagagctgggtacccgattaaatttcagcaccgcgtatcacccgcaaacagatggacagaccgagcgtctaaatcagatcctagaagatatgcttcgcgcatgtgtactagatttcgggaagacctgggataagagtctcccctatgccgagttctcctacaataacagctatcaagccagcatacaaatggcaccttatgaagcgttgtacgggcgcaaatgccggacaccgctcttgtgggaccaagttggagaaagccaagtgttcgggactgatatcctgagagaagctgaagctaaagtcagaatctttcgggataatctaaaggtggcacagtcccggcagaaaagttatgcagataaccgtcgccgtgacctggaattcgcagtgggtgattttgtataccttcgggtcacgccattgcggggtgtgcacaggtttcagacaaaggggaagctcgcacctcggtatgtgggtcctttccgtatcattgctcggcgcggagaagtcgcttaccagttggagctgcccgcctccttgggcaacgtgcacgatgtgttccatgtgtcgcaactcaagaaatgtcttcgagtgccatccgagcaggccgactcagagcaaattgaagttcgcgaagacttgacctacgtggagaggccagtgaaaatcctggacacaatggaacgcaggaccaggaaccgggtaatccatttttgcaaggtccagtggagcaaccacgccgaggaagaagctacttgggagcgtgaagacgagctgaaggcagcccatcccgatctcttcgctagttcttccgaatctcggggtcgagattccgtttaaggggggtaggtttgtcgcgtcccaaaacgactctaaaatacatcctcgaaattatgcctagaataattaaaatccgtgtgaaagcctccaacaattaaaatgtgcaaagttaaaagtcgaataaggcttggaggatttttgtatatttcctaaaagcctaaaatgcgtaaataaattttagtggaattttcagagcacaaataataattattaagaaataaacaaagttaaaaaggttttacaaaaagaaaaaccctaaaa

SEQ ID NO: 59066 - DNA, 7118 bp, Oryza sativa
ccccattttatattggaatttaacaaattaaaattagatcttcttttctaggcttttaaaatcatttctaataattccttttagacaacaatttataatttaaggatttttaaacaagaaaagaacttaacaattattattagatcattaatgattaattactgaactgttctttgtatcatttaggaattgagctccgaaaaatccgggaaaatttcagagagtataattaatcatggagaatttaataaaaattaaatccatccatgctttaaatttaggaaattttatttcccacatttaacttcacttgtaaatttatgaacatttaatataaattcttttaatattaaattgtttataaaccctaaaacgaaaatctagctgtgacaacaacccaaaagcttgataatgttattatgcatcatttgcgattggatgatcacttcatttgtgaaatcatcctttcgagcttcatttacttcgattgacgtcttcactgcaaccgtagtattgtcttcaagagtctctttgtacaccttaccaaagcttccttgaccaagaacttctgaattattctttgtgattttctttagctcatctttggtgaaaatcttgatattgtccactttctgtagcactgaaccaccattctttttgaaatattcattcatttttcgcttttggtgcatcactagcgtgaaaagaacaacaacaattaggaaggaaaatcccaaagtgatgcctacgaaagttaaaaaaacttattagcatccccgcaaaaaaaatacttattagcaaacataacaaatccatatatgagttccagtattattttttaatagaaatactccctctatcccaaaatataagactcaccactcgtaacacaaagaccaagaaataatttaatcaccttcttgattggatcacatccatacatgcaagcaatttgattggaggatttaatggtagatgatttaaaataaacaaatttaaagaaccaagaggtgatggctaatgtatgcaagccttatattgtgagacatggaaaaaaagtggttgtgccttatattttgggtagagggagtatgaatgaaggctcattttatttgataaatattattgtgaacaactaatgttatattaatattggcgtgcacaatatattgctgtaactaatctttagtgcagtttccttacacaatatacaattttctgtttatgtttcaaaatttcttgcatgtattttttttgaaaagtcattctatgtggcattagagagaaatcacttacaaacaaaataacaaaaatattttgtgtagcacatgaaagatgatttgtataaaaatatacaaacgatgcagaaaagtagtctatgtaaataacagacatattatattttacaaaaaataataaaatgcaaaaagcatgaaacttatacacacttatattcttatatcatgtgctaggaggctaattttttaaaattgttgatttttttttttagttttttcaattaactgtcaacccttatatttttaggcattataagaaattctttgtttggttgaatggtatattgtagaaacaattaaaaacatagtcaatgggaaatcattgaattggtgtaaactcaatgtgacatatatatagtatattattttatatttttttaaaaaaatgctgaggtgcatatgtaccaagggcaagccttgctgcaagagggaattttgcgctgcactcttgtttcttggggccttcaccactccactggtatcctacacggcagtggcactcataatcccctgggatgttgttgcagacgccgtagcagggatatttcttcttgttggacacatcacactcgttgatgtctgtgcatataaaaaggatcatatatattagtcgttagatcaactgtcactagtaaaaaaaaatcgtaggcttaggcttctttttcttttctcttgacaggcaactcaaaatgaaaatcacctgtgtgaagatggcttaggctgtccaggattataaaccacgtatgaaatcctattttttaactggcaaattcttaggaaaccgcctataaaatttgtcgctcttcacgaaatctacattgaaagttttttttcatcattttagataatacgtttagatcgatgtctaaatatatatatgcgttacaaactctcagatctatttttgaaaatgaacttttgagtatttcaaacgatcttggataaagacattctatattaaaattgtagaacttaactagatctacaactttgtagtaaatatctttataagctctagtatctatttttctataagcagttctttaaaaaatcaaaatttaagaaatttatagataattcattttaagtcctattgaggtaaactaaagttctccgagatcgttctagtacttcttatagtaaaacttagttaatatttttcttagaacatttattttagaatggttattcactaatgtcacgttagataacataccaactcatttagaggtaaatgataagtaaacaattatactaactgaaatataaatacaaaaatattgtaagggtcatatataactttggttcacctcatttgaacttaaaatgaactttctataaatctttaaagtttagacattttcaaagaataacaagttttttcagatgggcttcctacagaaatgtcatttttggcgattctcatatggaaaggcacgcaaaaattaatttttgaggcggttctcttgaaaataccacccttaaaaataatagcactactacaataggaaaggagtagtatcttgatatatatgaagtcgtatgatgaaaatctttttataaaattggaagagctctacaactatatagtgaaatgttttttcattcgaaacttttacgggtcatgatattcgttacaaaatctcaaatctattgttgaataaacaaacttttatgtttttaaatgaactcagatggagctgtgctctatatcgaaattgtagagctcgatgtgatctacaagtttgtggttgataaattttccttttgatatcatttatagtgcaatttatatattacaagttttagaggggcgaagtcaaaagaataagcttctctcccacatgcacaaagttctttataggcgagatggtaaggacgctacttgaagaacatgttcccgttcaaatcctatatatcacacacacacacaaaattatgcaacttgtgaaacttgcaacacacggccgtgtatatatagacgcttactaaaatacacaatacgtttttccctttttttgcgcctaaatcaaatagcgaaaagatcaaatcaaacctggtaaaaaaaatttagttaatgaatttaaacaccaacagggttggtgcacacacagcgaaaggtcagagtaaattgcacccatggtataaaaacttggtaggtgagtgcgatttagtgtaaggacttgaataatgagtagactggtacataaacttgacaatcatgtgcattttaggccaaaacactaatacgtacctttttttaagcagttttaatacatacctttgattaatcctggtattataagctttgctagaccgctggctcatggatttattttcgtgtttcaccatgttcataacccgcgataatgaatatgttgattagtcatgcatttacttttgataatcatatatctttcggttttaaattgacagattattttattattataacttaccaattgaaagcaacatataatacttgtagatccttttcgagatggtttgagtggcggctttttttatatggcgtaaaaagtatggtgtagaatatagaccttttaaccaaaagtccaaaatgcacgcactagccaagttattgcacttatatgctcatttctcaagtttttgcgctagatcgcacccacctacctttatgtaccgtagacgtaatttactcgaaaggaaaaaataaaatggtggcactatttagcagaactgttaactaggagtaataaaataaaacattaatcttacccttgcaaccttggtccttgtcgtaggggttaccctcgtaaccttgcttgcacttgcagtagtatccgggaccgttggtggagttgacgcactcgctgctgtcgctcacacatgcgtacccagccggtttcttctcctgcacatccagtggagggcaggtaatggagtcgcggatggccctctttcggagaccaaaaatcccagcaacttacccgcacgaacgccaaaaacacacttatctggattcgtcttcatgcctaccgagcacaggttgtcgaatgtatcttgaaggccagacgcatggtcgaatgccttgcggctttttacgatgatgtcgtcgacatatgcttcaacattccgccccaactgtgaacaaaggactttgcagatgagcctagagaaagtagccccagcatttctcagtccaaaaggcatcctaatgtggcagaaggtgctgaatagtgtgatgaaagttgtcttcagtatgtctctgggttcgtaaagatttgatgatacccggagtaggcatccaaaaaactcataagtacacagcccacggtcgaatcaaccaattgatcaatccttgggagtgggaagtcatctttcgaacaagccttgttcagatccgtgaaatcaacacacatccgccacttgccattggacttcttgactaacactgggttcgccaaccactccgggtggttgatctcccgaatcacaccagccttgagcagcttttagacttctgtcttcactgcctgttggcggtctatcgacattttgcgtagcttctacttctttggcttgcatatagctttactactagatggtgtatgatgaggtcgggccaaacgcccacaacctcgtttgatccccagacgaagatgttgatgtttttcttgagcacggccaagatgttattcgtttcttcttcacttatatcgccgcctagggaaaccacctttgttggttcagcctcgtcaacttggaccttgatcaccttgccatgtggggacggcttcggcacgattcttgctcgctcaccatcttcagcttgtacattgtctacttctctacttatcactgttgtttcgctccctagcacggccaaagactgcagccccttgactacgattaccccggccggaccaggcatcttcagcttgaggtagttgtggtgcgcgatagcttcaaacttgttcaacgtggcggtgccgaagatggcgttgtagttgtacgaaatatcaatgacaccgaagagaatcatctgctcgtgtctgttgggacccgcgccgaacgccggagctaagtgaacttggcctaggacttgcaccgcttcgcccccaaagccgtgaagcaaagtgagcgcctgagagagagccaaggtcaggaaccccatcctagtgtatgcttcggcgaagatgacatatgccgaactgccgccatccacaaggattcgacgtactttaaatctagctatctctgccgaaatgatcagcgggtcttggtgtaggaacaagaccccctcggcgtttctctgttgtgcaccgcccgaagctgcgtttttctttgcagcttcacagctgtgagggtggatctgctcttgttatcacttggataacactttgcgggatgtcttgctgttgttcggcctgagggattatgtcctgaacaggttcacagggcacctcttcggccttcacttgctgtggtcttggctcctgttggttgccttgctgccgaatgtttcggcattgctcggtggagtgcaaagagcgcccgtggaacatgcagtagagatccttcttggccttcttgcgaaagggttgctggtgattggtgtcctggtgtgtgtcaagcaccttgtggagggtctacacctcttcgactgccactcacaacctttccacgttcggctctggtctttttacacgtcatgggagcttggctgggtcttgggggcagcaccttcttcgtcggctgcacttggcgattcgccagcggcatggcttcagctgcttgcatcaccgcttgcgcagctgcagcggaagcggcggccttgtcatagtcggcttgtatctccagccttcgctttgtgtcctcttcgccacgtgcatggccgtcgatgatgcgaaacaagcgctcgatggtctggggctctttccttgctattcttcttgtgaggtcgcttggaaggagccctgccgaagcagcattgatgacggacgcctctgtgatgtcttgcacttggcagcgtgcttgcgagaagtgtcgaatgtactccttgttgtttctccgtcttctagcaaatgccgaagaggtcttgctgcgttttcggctcctcataggtgcctcagaagttaagaacaaagacttcacagagttgctcccatgagtatataatattagatagcaaattgaaataccaagagcgggcgatcccgtcaagcgcaacatgtattaccttcgccttggtattgtcattgccgtgagccacttcgattgcggactcgtagattgacaagaactcacttgggtctgattcacgcgagtatattgcaacgggtgggtacttgaattggggtgggatgggatgattcttgagcacccaactaacggtggcctcttttcgcccccgcctctcatcgttgcaccttggaaagatgagttcaagctcggttatgggatggcgaatggcgaagtcatcgcctgcacccgtggttgggccatcgctttcggctagggtccggttctgaacagtgctccttgcatgttggctgaaactacctgtgtcaccatgcctaggtcgaactgtggtgcttggatccaggccacgccctgattcgactggttcgcttgctgtgtggagccgaaaccggtgattatcccataaacatcagttgttgatgcttgggtcatggtgttctgttcgaagctcagtgcttgctaccaggctattgtcccttgacttggttgattgattgccgcgccgaattgacttatcggttgccaggtcggagccccctggcttgactgattcgcttggtgcattgcaccgaattg

SEQ ID NO: 59067 - DNA, 6432 bp, Oryza sativa
cgcacgccacgtcgccggcctcgagtcgacgacgccgtagcccaccgacatgagcggcgccaccgccaagttctcttcctcctaccacctcgccgccgcgctccgccgcgagcccgacccggcggccgcgctccgcctcttcctcagccccaccccgaccgccgccgccgggccatcctcctcccccgcgccgccgttccgctactccctccgctgctacgacatcatcgtctgcaagctcgccgccgcgcgcctcttcccggccatggagtccgtcctcgcccggctcccctcctcgctccgcccgcgcgagcccctcctgtgccgcgtcatctccgcgtacggccgcgcccgcctccccgccgccgcccgccgcgccttcgcgcacccggcgttcccggcgccgcgcaccgcccgcgccctcaacacgctcctccacgccctcctcgcctgccgcgcgcccctcccggagctcctctccgagtgccgcggctccggcatccaccccgacgcgtgcacctacaacatcctaatgcgcgccgcggtggccgactctggctccgtcgacaacgcctgcctcctgttcgacgaaatgctgcagcgggggatcgccccgactgtcgtcacgtttggcaccctcgtcactgctttctgcgaggcaggacgtctagaggaggcattcaaggttaaggaggtgatgtctttgcagtacaacattaggccgaacgctcatgtgtatgcgagcctgatgaaggcgctctgcgagaaggggaaggtggatgatgcgcacagactcaaggaggagatggtgagcaattcagaacctttggtggattcaggagcttatgcgacgctggcaagggcattgttccggttagggaagaaaggagaggttgttagtttgctggaagagatgaaggaaaagggaatcaaggttggtagagaagttcataattcgatgattgcagggttttgtgaggatgaaggggatctggatgctgcatttgcagcgctcgatgacatgcagaagggtgggtgcaagccggactcggtgagctataatacactggttggtggtctatgcaagatggggcggtggcgggatgcaagtgagttggttgaggatatgccacgaaggggatgccgtcctgatgtagtcacctacaggaggctgtttgatgggatttgtgatgctggggggttcagcgaggcgaggagggttttcaatgagatggtattcaagggctttgcaccaagcaaggatggtgtgaggaaatttgttgcatggattgagagggaaggagatgcggcgtcactggagtcagtgttgtgccaattggctagcgttaacgccttggaatcaagtgagtgggagaaggcaatgagtggtgtgctccatgatcctgcagagcagaagattgtgaagttgctggataatttgagcttggcttgattatatatccctatggattgttgtcactgtactggttgtttttctgatctgccacagtagtttactgatttaaatttgatgactcttgagtaattatcatgggaaggaaagagatacaacatcatcaatacgaggagtttgtcattaaaaatacatgccaatctaacatcaatggtgcattcttgaagcaaatgaagcaaggagtcatagggatgattgcaagtgatgatacagaccaagtcttatttttcataacgctgccgtcttcagcaatgattgcaaacagagtttgagcatgcaaatatgctctgtccttggcaaagatttggatcaaccgcctaatcatcgttgagtaaggcactgcaaatccagttgagcttctatttctctacgatgtggcatggagtccatccaaattttttacaccgaagaaagatgtctgaaaacttgcagcggagatatcaaaattaagaaaaaaaaaactcggtagagtaggacatgaaattgcctggaatgcaaaattatcaggacttaatgctgttatgttgtattttcagtccaagttcagggttgtatatagcaatatgagctccgggattgtaccccctatacccgtgatatctaatactcctaaagatctctcttttcccataatgaggtaactagccgagatcagcgaaaagaagaacaacacgagtgcaacagatctggtgacatttttgtcagtcgctaacatcgggaaaagaaaaagagatcccgaggcacattgaagttggatgaaatcatcacagttgccttgttgtcgagggtacatcgattatcactgaaagaataaataactacgaggaccaatattaaatctaattggttgcaccataggaaaccaacctagccagcccataggaaacatagccagttgagctcactttgcaaattaaggttttttttatatgtgaatgaaatgagcagtaactctaaatatagttaactaaagttcaaaaaaatatatagttaagtaagtttggtccaagcaggggaaggcctatcagtgactaatcctagcccaacaaactatctgggccaggcaagtcctatcacggcccaaataacaagtcccaaaacagagagcctaaacaacaactccatccgagccgtccattccgcgatcagagcgctctctccgccacccccctcgctatataagcacccgagggtgcatttctagggtttccgccgccgaagccaccacacctaaacccttcttccctctcctcctccgccgccgccgccctcccctctcgccatggtgagtgaacccctcctcccccctcgacgccgccggtgaaatgctcggcttctccgtccatcatagtgtgacggggtttcgtggagattggttggttgctcacgccgcgtgttttttgttttttttttggggggttttgcaggcgtcggagaagaagcagtcgaacccgatgcgggagatcaaggtgcagaagctcgtgctcaacatctccgtcggcgagagcggcgacaggctcacccgcgcctccaaggtatatcctccattggttcgattgatttgggtggtagatctgctcgtccgcgatatgctctaagcaaaagtttgtctcaagaaatgcatgcgtcgcagttcgaatcgaattcttgcttccgcttccacgatcttctgtatgcaactcttgatttctttttaatcaaaaaaaattctctgtttcgttctccttcctaggtgttggagcagctgagtgggcagagcccagttttctccaagggtaagcgaattttgttccaagctttgtaatctctttcatcgcgttgttaccaatggtgccaccgtgtggtttggtttcttacggtgagagcgatgcgatgtttgcagcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtaggaccatctatctgtcttgcactcatgttaattcatacggtttcagtgtgctttccttctgtttatatggctatgacgaattggttgtggttgtccggtctctggacgtttatttacctgatgccattgcaatctgctttggtggataataggcttggtagatgttcctatgtgaaatataaacacatgtgcattcttgaatgctcagttgctcgttctttacatttgccgttataaatcattattctatcatataccgaatgattttatttgcacatatagcctactagttttgttccttaagtcattgtatgtcatttcataaatgccacaatttgatccttagtcattgtatgtcatttcataaatgccacaatttgacattgcatggaatttctgatgtgtgcgccattgtttatttctacatgaagtggaaatttgtgatgcatgaacgaaatttttgcccctctttggtactgtcctagtttaaatagttttacatagaagttattttatatgaacccaggtgtaactataggggcttatgacctcaagttagataatgttattccaggttaaatatcttaatttaaccatgattaaccaagatcagaacactgttctcatctttatcaaatagtttacttttgattgtttttgtgaccttatattacgatgtttcttgtctacaattaacattctgcaacattccttatgtttcctagtttatattttggtgttactttgcaactcatttgcttgagccacttgtatatctgaaacaccttttctgtgctttgtattgtagataattcgtattgtagacaatcttataccaagcgtaactaggagtactcgtgctaagagaattaacttgtctaatcaatgtttcaggtacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaattggcaagggtttaaccagttatcctgtagaattaagtgagggttcatttgaatcatggaactgtctttcttgaaagccaaatgcactgtcaattttgcctctgttggagttgacctgcgtctatatttccattaaatgcttaatgatatccttgttttaaatcttaatattaaggcagacttggaatcaatccacccgctttgttacctgtatttctgccttatcctgtgtcaggcaaaagctaagtagcaacagtcaaattgttcattttagtgatgttttatttggggtgccaatttcttcttttggactgcgacttgtgacatcttcatggcggtatacatcttactctcttggtaatgtcaatgcattgctatgctttgggcgcatgtttttatcgatatggtgtgtatttgttcttggggacatatccggtaaaaatgagctaagtgttgaaaactcgtgaaaattatacctaaaagttttgtaaattcatgaaaaaaaatactagagataggtgtagatatgaaatacattctcaccaaatctcacgttcaaactcaacttcgtttaggagtaacaaaaaagacaaatttcaggtgaatagtaacatgacactattcacctgaaatttgtcttttttgtttctcataaacgaacttgatttggagttgagatttggtgagaatgtatttcatatctacacctatctctagtatttttttcatgaatttacgaaacttttaggtatgattttcacgagttttcaacacttagctcattttcaccggatatgtcctccttgttcttagtatgaaaaatggtaaattgggtaaaaaaaacactaaaagttttgtcatctaagggtgtgtttggttgggggcacgaggctggatgggagatggccacctgattttttttcttagtgtttggttggagggcagggtggatgggttccctcaatatgctggatgagtgcatccggccgatttggctggccggatgaagccatccagttttggtctgggtgatgtgtcctttggtttggtatgattggtttgattttctgttaagcaagccccaaatttttttctcctaaaccgtttatctaatttgtgatttgattacaccattatatttgttataattaaatctttaaaataagaatgattatattttgataatatatatatatatatacaacaaatgggtcctactaacttatgtctttttccatccatgctatattcattcaaccaaacaagaaattggatcgctatatctatataaaccaaataaaaaattggatcgtcgtatccaacaaaatatggtcccatccatgcatgactgtgaaccaaacacaccctaaaatagccatctcatctgaatagctgaaaatgatttatccaaaatggcaatttagaggatctcaaagcacatgattatggagcaaccatggcaagacgattacaatgatcaagcacgcaatcaagagattgcataatgagtggctcttgcagaagccgctgcatgccttggaggagccttcgacgtcgacgcccgccgtcgcgtgccaccgcttcatgaactccttgcctccgccgccccagccggtgatgttctccgccgtctcgccgcagatctcgcagcgcctgccatttttgtgaattccatgcaaaatattgtaaatatttgcgtaccgcttatatatgttgacaaatatatgtatttttctgtaaaaacgttatactttagaaacaaatcgtgcttagaggtatatata

SEQ ID NO: 59068 - DNA, 6170 bp, Oryza sativa
ttgagaaaataaaaaggtttagtaagatcccacaagaggccccaaaataagacccccttcctcagctgccctcaaacttgagggctttaaaccatagaccccatccatagttgtggtgataggaggacatttccaccggccgttactctctccatgtagtcatcgttccaccgttggccctactctgattgtatccatgatgatcaccacccttccccgtatctctacaatgccacctaagctcaactagtaccgtttcaccgcctcgactccacactaggagctcaggtggagccttggctcccaagctcgggcactcttattcctttcaagcttcttggcctctcgagctctagcagtgaccatgccaccgtccttcctacctctaccgccctccctagcgtcctatgatagtcacccagctacttcccccacctctgaatgtgcctcctccgtccattgccccttcctgcctccaccatcaggactctgaggtccctcgacgacggatttggttcctgtgcagtctttagtatgactacaacttaggcagtcatacaatagccgtaggatgcaaatccaaaggcccaaatttgataagacactgttcattcggaaaatccagcacaagattattatggcaagcctactgtagcatttaatctggactttccattgaaaaattgaatggacaagatcttgtgcagtccctaaagtgcagttacagttaggactgcatctgatcccaatccctcgacgaccatacctccggccgagagcaaggtattttttatgactattggtattttcaacatttaataatagtatttatcatttccatttatataaatatgaatttgaattgtggtgtttgaaattgtgaatttgtatatagctgaattctatgaattaaaatatttgtgtttgaattaccatggtattgaactacgtataaagcatatgatgaaataaaaaaataaatgtgaattgttactcgagttgaagatattttttatccttatgaaatgaggcaacacttattcggacctaagagggttgaaacgaaggcattgtattgtggatccggatcaccttagtttagagcctaaaaatataggcgtgcagtaccatgagtcaatcgctatggtagtaaacaattatttttgtagttatttacagtagcaacagtataaaacatgaattgtactatatcgcattattgtttattatatattgtagtatactgtagtgatcgatctcgttcgttcgttacaaatcggatggctgggaaaaccctagtcatggtactgttcacctctcactttaacccctaaagtcaggggggtctcaatccattgttttgattgtagaagcagaacagtgctagaggaaaaagattggattgatgctacaagcaaggcaaattcaaagttgctactagtacaaagaaatgaatcaccatcaaagataagttcttgaacagtgtgagtgatacttaggtccacatggtgctgagtgtttgcaataattcacatgtgtagttttctatcagtattttaaaagggtagttttcttttatgctactccctctatccacaaaagttacacatattacttttgacaataagaccaaggagaaattaaatcatcttggatgttacaaaatcaaggagtgaatgcaagcatacaaccaaagagtatttatagatgatttcttgggttctaataaaatatttaatttatctcttcatttaagttttgaatgcataaagattacaaatatgaacaacttatttgaaaaaactcaaatgtgaaataggtgtaacttttctggatggaaggagtagctattaataatagctaatttttggattaatagcaccctaacttgtaaattaaataaaattgcttgttggaccaatcaagatgcacccaactgatgccaggtcaatgctcccaggctcccagttggtataggtaatatgctaggattgcaagggattattccaccatgattgcacggctttattctttctttttcactacagcgaagattccgtcccattattgtcataatttatggccatataaataaataaataacttagatattacgtacttcaaactggtttcgacagaaacatgaacctcaccagcacatgctaattaaatcgctttgaaataatgagtcctttttcatgaaaaagaaaagacgaactctacaccccatttacatatttcaccaaaatgttataacatacaatatatctacggcccaaaatataacgatttttatcttttcgaataaatgtagtaattatctttagaactaatctcaattggaatttaattgaattcatggagaacgaagattgcatttaaattattgtagggaaacaaagaaagctcatcaacaattttttttcttgaaattatcattaaggaattcatcatccattaactttcttctatgtacaaagaaatggatcgaggttgatcggaattggatgggagtgagtacctgttgcccctgacggagaaccacgcctcggcgcaacgccggtgcgccgccgccagctcgccgcggcagccgcacccgagcctcaccagccgcccgctcccgctctccgccgccatctcgccgtcgccgccgccgccgaggtggcaaatcctgcagcccgtgctcgggcgccggctgcgatcatcatcatccgccgccgccgcacaactctcgtcgacgtcgaccaccacatgcgcgatgacgcccgcgtccccctcccctccggcggcggcgatcaccgccatggcaatgtcatgatggcgatcggcacgcggccatgtgggctgggcgcatcgatcgatcaaccaccagggaagggaatctaggtgttggggaatatagtaataataataatgacaagaaatcaagaaatgggagaaaatgatgggggacggggaatatcgcctcggtgctgcgaactgaaggaaaaggcgcggggagggggagggacgaagctataaacaagttgacctacgacatgggatggtaggattggagacgaatcaggccatgtcatgtcgaggaaggtgggtccaactagtggtggagctaaaaccttcacgcataggactgaatcaatgtgagttcaaatattttcacaaattatatactcccccagtccctgttttagtattataagttgttttgcctttttttctatagtcaaactaagtttatagaaaaaaaatgataacattttcaatacaaaacaaatatattattaaaatgagtaaatttcacaaaactatatgtattttgatctaaccattagaaagctatggatttaaggcgttgtatcataaaactatagatttaaagttaagtatcacaaaactgcatatttaatattgaagttatcacaatttagagtttaaatccctagcaccattattatgctagagcaataaacattattgttttgtaactaaattggttctaaacctatagttctgtaataatgtagtaactaaacatgtagttttgtaacatttcatcttaaatgtgtagttttatgatacatcgagttaaatatatagttttgtgatagtttggtcatagtatgtgtagttttgtgaaatttactctaaattttaatcttacaaacctaacaagctatggggcccaagccctaactgtcccatgccttttttttcatctctataggtggtatgtaattcatcttttaaatgctcgctctattcaaaaatagttctcgttttagagtttaaagtttgccccaattcaatccacactacagtactacttgttacattaagaaataatcatctttcatttaaaaagttttcccattctacacccaacaattaaatagcaatatagttttctttctttttaaatcttattttatgctaaacaatctagaaaaatgaaagataagtattgtgcatatgggagtaaggggttttaaaacgacactaattgcttatggttgaccatcgaaagttgtgccatttttttaaaaaaaaatccagcaatgcttgatgtagtctttcgagagagagaaaaaaaattcaaatatgtccttccgtgtagcacggtacatgtacagtgtacactgtccacggctttaaggtaaacagtcaaggatggaaggaacaaggttacaaggagagttattcatcagaggcatggtggcatttacatcatggaatgtgaacaaaacagtggcagtttacaggttacaactacgcctacattagggaactatattcttctgttacaattgggcaaaaaaaatgaaagaaaactcagtcatggatctaaacatttcggtttcctccgtcataccagctgatcccggtttcactaccaaactcgcgatgcaaaaacttctcgatttacaatgttgttcttcttcgatgattgaattgaacttccaacgaagcatttgcatatcatcatctgaggaatcatattttctattcttcttgttttgcggggattcgaagaatcatctgactcagccttcatgtgaacttcaccggttccgcgaaaacgatccaacaaaaggtctggtggtgtgcatttagcatttttagctcccagtattgaagaagttgtgggtagcttgccgtcgaacatgttctggtatgagcctgctgatgagctcttgagaagaatttgctagctgtagagaccaaaaggcagcaccaatgagcaccaaggagagtacacattttctcatggataccaagatctgaagttgtgtagcagattatgtttcatctgattcacttacttcgtgtttgaagttgaatagtggtggaaatggacgtccgtttggcaagcgtgcattcggctctcgcagctcatcaaagaaaggatgtgcacatgcatcaagctgcataaagatattcaaatgaataagcacatcggaaaaaaaatcaatattaagttgtcatctggctattgcaattacactgaataacgactaaacatgagacaactatcattcatccaccccaacattgatttggtaatggaccactaaagatcataaccataatggccatgccccactaaaaccaaagttagtgaagactagcattcttcaatctactttaggaaaaaagaaaaaagagaaagaaacaaggagtgtttctccactccaccccatttcaggagttgcacaaatcaaagagcacttggagggcaaagtgattaagaaaattccttggttacgctcaaatttgtgcaactcttaaagggtgaaaagtaacagctcatatgaccagctacagtaggcaaacttgcataacagcaataagaaaaggggcgttttacagtacccctgctgtgagcagtagtgaaaaatcacttttctactgttctgctacttaaattgcagcaagaatatactcacagcagtgcagcggagactcggtgaatattgaagaaggcgtgaagcgaggtctattgcttcaggaggcatcctctttggaaaacctacgcagaagttagaaaaatcagtacctgtatgcacctccttatttatacattgcattgtaaagctatctggtgtccagaatctattattggaaatgagcccagctacattttcatagttgtccaggaaactataaaagatgacgtgatatatgactcaacatggataagattgtatgcttaccttgtgccaagggtgagcttttatctgtggaaacctaaactctgtatagttcgggttcatgcaacgtatttcctcacgggttggtgtaccaagaacctgcaagaatatcatacaaggttagagaagatgcccatactcaatagtaggagcaaaattagaactgcatggcatgtcttgcagtaccttaattatctctacaagctgatcgactgcactctcccctggaaacaatggctagcaaaaacaaatacaagataatcaaaatcacagcaacagtgatgacatcatgcttaaataactaaaccaaaagtttgcagatctgtcaaccatagaaaaaagaaaccaacctgaccaaggagtagctctgcaagaacacacccagctgaccatatatctattgatgtagtatattcagttgcaccaaatatgagctccggtgctcggtagtagggggtgcag

SEQ ID NO: 59069 - DNA, 8609 bp, Oryza sativa
ttcagtacttggttttgatgaggccttcgctgtctagtcccactttttgttttgcggcgggcaatcttcgctccttgcttgtgtttgctaggtgaagtcggagctgcttcgtagggtgacgaagctgggcaacgatgacacgttgcattctctttctaggggttttgtttgttggccgtgaataggatgtggcgtttagacggctttggctgaagttcttcgtgggaagttgaagccacttgaccattgacagcgagttaggtatggatgatgcaaccgatttgaagtcggagctgctgtgtcgctaggcggcaagctcggcaacaatgacacggttgcaaggtcggaacccctttgccgtcttggtcaagcttggtaacgacgttctatgttgggctccgtcagtggtttctgttgttagtgagttgtggcgtgtgcggtgcagctattcagccagccggtagttgttttttcttttcttgtaacccgtctagggtttttactcctgcttattgaaaatataattggcagttctcctgccggtttagtttcaaaaaaaaaagttgaatcagatgcacaattgccatcacacaagggaaagattgattcattcggttcgatatgagaactcaacttcattgcattgatagaatttatgttaaaaaaacaccttattgttatatttttagatagtgaaaaatcttttacacttttggtctcaatacaaaaattgtagtattgcactttacactccataaattcttgagattaattacaaccaataacataataatgtacgactaattattgcacccatgcataataaagctttataattatccgttcgaacaggttctaacgaacgggagatttcgaagcgtgaggcaccgggtgatggtgagtagcccgcggccacgggtgtcagtcatcttcttcgccgggccgccgccacgggagcgactagcgccgctgccatggctggtggcggaggatggcgggcgccgccggtacagggagttcacctggcgggagtacaaggcttcagcctacaggaccaagctggctgagaacaggctatgtcactttgaaactgaagctgactgattttatttttttttagtgtgtatagaatgtttgtatgtctcttttcttttgtggttttatgttttcctttttcattttggccagcgtgtttgtaatagttgatatacatgttgatgggcaaggttttcgtgttgatacaagcagcacactacagagtagttcatacatttctttttgttcggttttgtgaatttaaagttggctaaatttttcttgattgtcgtgcacctgactagttgaattactcgtgtgatctttttgttttcttctaattacgcacagaaacacactctatacacacacatgcgtactcacacatgcgcttgaagagatgaaaaccaggagcacatccctaatctcataaagttttagttgaaagcctacttgcaagtgtgtattaatcatggacatcagaattttaaccctgaattgtgcacctatgactttaccaccatgtcaccggtgcttccccaattactctagtgattctagatgccgtaattcatatgttttgaagtgatgagcctatggttagaattttgtaaagtgatactagaattttaggattatatttatactagtattaaattgaagtaagtgtactatatatattattattaatctgcagactgtagtaggactaatagtgctcaggcaaggtgaaaaatctgtatgaaaacaatcttctcttgtgataatcacacagagttgtgtaactgatgtttttttttaaaaaaaaaaagaaatctcgatgtcccatattgtcacacacgcggaaccaccatatttaccttggataaatggatactcattcagtcagataacctttcacaccattctagtctttaagcagaattcgtgagaaaactgttgttggtaggagcgggattcagtttgatcggcgtcttttaggttcgtctccaaaccacggttatgcaactatttgccaattatggttggagatttacaaatagacttcaataattgtgatctccttacgttaggctggtttcaataataatgatcttcggtgtgttctatttatttagatttacactatgttcatgaaaactactatgtaataattggctgtagctcttttgagtaaaggccgggatattatattccattatcttaaaaaaaaaaaggttcgtctccaaaaatttcggtttctaagaaatagcaacgaaaaacaatggggtttgggaggttggtccagatggacatggacttttatgctaattctgttttttttggggggggtgatttgcacttaatttgttatgtcattccgctgctggatcatactagctccctaccctcttaggttgagttttttttggatggagggagtacgtgtgatcaatagttacagcttagtcttggcacaatccaatcggcgagcgctatcaacctgtttatgtgtgggttaaaatcaacaatgagcgaagaacaatgttacttgtgataaataggtcatatctattcttctaaagccggcggtggatgccggcatctgattggttcagttgatggtcctctgtttgattgacacgtggcacaaagaaacaggtgaacataccgctggagagatccggaaagaaaacgaaccgtgcgtgcgtgcagtaaaaagaaaaagaaaaagatgcggctaggccgctcgctccagggctgtgcgtgattcgtatgtcagcctggtaggaaaaaaaatcatcgacagcatgcgacctaagacagttgtgcaatataaataaataaaagaatgagatagaagggggaaaatgtcaggattcatagatttccatgtttagcaaatttattcaaaaagttaaatcaaaatcaacgtagtaatttcatcctgttaacatttatactccatccatcccaaaatataagtatttttggattctggcacggcctccgagatgctactttgatcaataatatctattatagtaaaatgttttaaataaaaagtgttgcatattatgatagtttgtttaatgataaatctaataacatcaattttacatcatagatcttttttattgttttgctattaatggtcaaagttaaaaatgtttgacttgtcaatgctaaaaatgctcatattttgggacggagggagtaataaatagtaaaattaaatgtacggatagttaaaaatcttcgaataagtatgatctactataggtttaataaaaaattcaagacaaatccctatggttctatagaatgaaaacaatatgtagcaaaactagatggtatttatgcgtgaatgttccaaaatatctaccattttaagtgcaacggtgagtttccgtgtccaaatttgatcgtccgtcttatttgaaaacttttataattagtatttttgttgttgtgagatgataaaacatgaatagtactttatgcatgactcatatttttatttttttaaaaaaaattaaataagatggatgattaaaattaagcacggaaaagcatggctacacttaaaatgagacggagagagtcgataacaacaaaaatatatttaccatgtcggtgtgtcctatatttatagaaaaatgaaataatatgtagatagaaatcggtaatctaagacacattaattttaggatacatattttcagctaattatacaaattagatgactcacatgtaaacacattttattgtacgaaaaagaacaatttttagaaaacaaaattttactttttttttctctaatatcaccatctgccatgattagttcctggacatttttatataaacacaaaattgaaaacccattaaagaatcaccttgaatgtatatttcctaaaaagaacattataacaattatgctaattttgataaaattctttcgacgtatgttgctaaataatacacatgggttataatttagtgggcgcgccaactggggcgctttattattttctagttactattgaagtattgatgctggcaactgcatacatgtgcgaaagaaatttcacttcaccaatcaactggaagtagtatacttattggtggtgattgttgaaatgggtagctcaacaaagaaattaataggattaattgactggagcacatgatctgacgctttacaaaagaagggaagtggaacggcagagtggtgggattaattggcttactctgtcaattaggccttgacatgtaactgtgcagtactcgggaggagatctgaccactgcgttttcatccaacggctgctattaattcgaatgacgtggatgaaccaaagtgcacgaaattgataataagcacaataagtgaggatcagttgtatatgcttataggatttcagtttactgttgggcccacataaagatgcgtccgtacaatgcaaaacagtatgaattgaattgattttgcagtgtgatctagtttaacttgatggtaccctacacgttgcgaccggacattttgggcccatcgtttggcttttattttaactaggaaggtagcccgcgcgttcgcgcgggcatgagtcgtacgccaagtttgaggtatttataaaagcgacatattaacaggagaacatctgccacgatttctccataaattatttttgtcagcattaatttattctttaataatattttaacctattagatttatattatatcaaatataagtagtatctataagtaattatttataatattcttcatcattttaaaaaaaaggtagatttattttctttagaaaacatgtcaacgaaagtaaaagtaagtgtaaaataaaaattaaggtgtttttattttttttaattgtataatatattatcataatatgttaaaggatgaattgggtgggacattaagctacacgaaaaatgcacggttttatatagtctaatatgattgatatattttgagaggcgatctacctatgaacatttcatgtagagtgaatgagaggctccacgcaacctagcaggaatacaataacgtcgaaatatcattgcaccgtaatatttttggaatttcatgtaccataaataaacacttgttaaaaggtataggagcgcacacatgcatgttacgcagtgagccagacagagattctgatagactttgttttttttcccaaaagatagatatgatattataaaaattgggtccatcggtttaagtggaaaccgatggtcgattatatgagtgttttttaattaatagaatgccacatagcgacttagaagtgtttataggagtgctaggagcaatcatatgtatgatttagatgctatgatcattttaagatcgtttatttatcttttaaatttaaaatatcatttatttacaaaagcatcaagatcaattcgtatatgtaaatagcccccacgtgtatgttgtgagaaattaataaagtttttttatgaagaaattaattaagttggtagaaagtcattagatgtctaacaatgtacttttaatgggttagtttcattaaaaaataagctagcatattttgattttcaatgacaaattttaatattttcttttatttagtggagcactcaagatggatgtaggtctagaatgcaataaatccaatatagatgttaaaattatatatttatttgaaaaataaaaatagatatataatttatggtacaaataattgtaaagactcgtaaaattaatccggcctttattaaaaagtctgaaatagcacgtttaagtataaattagttaatatatttctttgttagtttaatgcgtacagaatgtaacggtataaactttataaactttatttaaatagtgtatgatttgaaaataatgctccacataaagggttcacgtatacctttatttaatgggtaaaaatatagtggtgtaaactttattttggaaagaaatatatcataatataatcatataagttatgattatataaaatttaactatattaactgttatctcgattatatatatatgaaaagaaaaaggagggaaggagatggaaccgtacgtacgtacgtacctacggatggtgtggaattgtacgttttaagatcaatatagttaatctgacggtatctactagtggacccactattttaagtaaaaatcaatggatagatgcttttcttttttctcagaatttttttgatttctctaatttattagagcgccaagtggcggcttaggagcgtttgtaggaagattaatggacttttagtatataatagataagccaaaacggcttattagagaataaaaataaatttacatgtaaagcttttatatatgtgttctcggtgatttaaaagccaatgctaaaaaagaaactacgttgaaaatatctcaaaatcaatatcaaaattaagtttgaaaattcaaaatttggctttttctttggctgaataggccatccgatgagagcctttgtaatgtacatttgtacatcactgcaaataataccttggggaacattatacagtaattgaattattcaaaatgaaacctcagcaagtttttactgaaaagataattcaagcactctatggtggtttttaatgtcctgaagatgaagatgaagattaaatatttcacgcaaaacgaggttataataacatgtgattagttaagttttaattattctaaacttgaaaaatagattaatatgatattttagagcaactttcatatagaaagttttcacacgaaacccaccgtttagtagtttgaaaagcgtgccacgagtatccaaaatttaatccaaccttagttggagaaaagaatgcaattgtgaaatacaacctgcaaattgccatagcttgtaaatctacttatttagtagtagcaaatagtagcgtcagttatgctaagtaaaagtgacaagtctttctactgggactactgaagctaattagttatcagttatcaccaactatacatccttaattattgaggatataaaaaattgcacattgatcgattaacttaatataggtactgtcccaaccgaggaagagtgattcacagacaattgattgaatcggcaagttttgtcaacgagaacaataattaatttgaaattgagctaaacaatactgaaacttaatccgaaggaatttctatgaaattttgaggtctaactcaaactaaaaaagttggcgggcgaggagcatacatatacctgaacaaacatacatatactgaaaagagtgagcttgtttggttacacccagtcggtgcatatatatactcgaacaaacatacagtgtaaactgaaaagaaatgagcgggtgttgttaacattgtttgctgcaaagagtaaataaaaaggaaaagacaattttattttgatcaaagaacaaagagaaacatgtataccagggttgctgtggggatctgctctgcatcctgtgctatgcagagcgagaggaaaagcgaagccgtcctatgagcgaggagcacgcttgtcgttgatgtgcttgggaggctccagcaatatagtatggtggtgagaggaagattaatcgaaaggaagtaaaattaagaggtaatagcaatgctcgttggatcagattgatgccttgtttaataggctaagttcctatcaatgcagtgacatgagtagcacctaaggtcttgagttcaaatctccatagtagcgaatttcaaatttggttatttgagagctaagttccttatttaataggctaagtttctaatttaaaaagccgtatatatccgattgtatatagaggccaggtaaaaaaaatacccttctcttaaaacaaaagatcgatgcctcttgtagttatcaaagtcgagtggtcgtctggtagtttcgataggggaggcaggaggacaggttgacggccgggcttcgctgccaattacaattctcatccagtgcagaagctctatcaccacaaccatgcctaatggaattgtggagactggtattcgcgctcgcttgcgtattgcggctgtggtggctcgcactcgactgctcatgaattggttgtttattgccggactgtatcatgggagagaattctatccaactgctgacatcaaagatatagattcatctaacgatgaagataaaagtgatgatgtggctgcacgagaggacatgaaattagcaataataactacagtaggtgggatcaactatataaatatataggatagtttttatcagtacttgagatggtcttaccatgcacctgaatcctagacgatgattatacacctagacgacgtcaatttgatcacatttatattgcaaaataatcatgcctatttgagaaaatagtactccacaagatgcacatgcaattgggccaaacaggtgctaccatggctgtattttaccaattatgttagtagcacaatgagaaatatatgccaagattgtattgaaccaattatattagtaacatcaaaatctcccacacatgtgttggagaattcttcttttccaatcaagaactgtacaactatgtgacacaa

SEQ ID NO: 59070 - DNA, 13708 bp, Oryza sativa
  unsure (1)..(13708): unsure at all n locations
aaaaattgccgaacgccttacttgttcggctccaagacagacaaacgataanatagaccctctatttaatatggtcagaaccatcagataaattaaaccctatcaacaccttcagatactagttccctgcaaatatatctgctagcaaataggacttgtgaaaaaccacttagttgaatgccaaaatgtttgattggctaaatatatattgcttgtacaaggttgctctctcatttatactggaaaaataatccacaatatccatgccaataaattcattctgcttttgttgggggatcatgcattagtgatgtagttcccacattagcttcatgcatgacttctcaaccaaagggggaaaatattgccggaaaaaaaaaaggaaaaaaatcaagtttgatgagtcttatacaacttagttgacatacggatttggccatacatgtttggtgcatcgaacagaaactacccttgagacgcaacgacaagagaacatgacatggtgcatgggagcagaaactggatgagcctatgcatcaaaagcagaaactggctgatcctatatgcataacatatgcgtgcagtgacacaaaggcaaaactcaaatgactaaaaatcttcaatgcacaccactaatttctctttgaatatatggatataggtaagcagctaggtaataaaatgttttgatgctgacttatattatgggcttgttcagattgatgtcattttaaaccatgccattatttggtaaagatgacaattatgtagctatatatatttattttgttaccaaattttggtaatgactatggaattttgacaacattatattgagcacatcctactacaatttggcaatgttgccaatttacccaaattttagaaaggttcattttggcatcaatctgaacagaccctaaatcacgcttgccttgatcgttactccatttgttttatattaagtcattttgtctttgttctaagttaaacctcattaaatttaatcatgtttataggaaaatatagcaagatctataacaccaaagttttcattaaatccattcaatatatttttatagtatatttaatttgttttggaaatgtttctatatatttctacaaacttacttaaatttgaagaggattaacttagggcaaacccaaagtcttataatataaaacggatggagcttgtatgttctaacaagatattgccatattgatgtacacctaatattgagttttttcaaaagactacctaatagtgaggttgttatccatgggccaaaagcccaagtttctcaacataaagtactgctgtgtgagctcttccatggttacacttggtcattgtctgtcacatgcacatctattaacttattaaagcaatagaaaaaagagccttcacgttcgctctcatggcctagaaattctcatattaatcaacgaaaaagaaaaaaaagagtccatatagaaatacaaattagaaatagctgaaattcagaattaaaaattagaaatattggaagatgagactagagtctatgttgtatacaatttagaattaatagaaattcagaattaaaaaaataagaaaattaaaattaggttagagtccataaaaaataaaatttagaaataactaaattcgaaattaaaaaagaatatcgaaagaagcgtatagagtccatatagaaatacaatttataaataactgaaattcggaattaaaaaaataaaaaaatattagaagaagagcatagagttcatatagaaatacaattaagaaataatagaaattcggaattaaaaaataaggaatactaaaagaagagtataaagttcatataggagtttagaattaactaaaattcggaataaaaataataaagttaaaagtagagtttagaatccatatacaaatacaatttacaaacaacaaaaattttaaattaaaaaaatgggaagaagaatctagagtccaaataggaatacaatttagaagtaactgtaattcgaaattaaaaataaagaatatcgaaagatctgtttaaagtccacgtataaatacaattagaaattttcaaaattcggaattaaatataaataatattggaagaagagtatagagtttatatagaaatacaatttacaaataacgaaaattcagaattaaaataatggaagacaagtctagtgtccatataggaatacaatttagaaataactaaaatttgatattaaaaataattataactatcatgtatgtacaatagtatgaatattacatattggtagtttggtaaagttagtacaaaatttaaaattatgttttcattttaatatattttaataataaattgagaaatatatatgctattataatgatgctagccgcgcaatctgcgtgggctgccatgctagttactaatagtgtagaagtatcgaattggagttctagctataatataatatagtttaaaagagcacttattttttaagaaacacagtacaaaagagcacttagactgagcgtcagatctaaacaactctcaggatataaaagcatagcattcaagcgccttagcccacccagtgaaaggtgttatttttcatgtttttagagtgtcacaaaactaataagacattaaacatgtatttggtttaagaatgaggtggctatttttttgatgggatggtcaaattatctgtttggtatgagatggagtggtcttattattttgagggataggaaaggcccgtatctcagtgaaagaaagtgggtgggattggtccagtaaaactgactctggtcttagggaatattctccttcagagttcaatccatctcatatatcctcaaaccgaacaccctaaataatgggtttgaaccaacccgaccaattccatacattgaaccaaacagatgtttaattgatgattgaaatagcacatgaaatttattgttttatttttaatattgcatacgcaatacatgcaagagaccaagctatattgaaaacatcgggcatatggtttcatcaagattaaacccatttcatctcttacttcattattaatttcttaccacatcatgaaaaatgttgacatgatacaatatttaatacggaataagaatgaaactcccattattgggagtggctttagcgttattgacttcagtcatgctgtctcacaagcttttggttcatacaaaatcgtgaagcacatctgctccctctatcctaaataaaacaaagtctcgctttgcataggaactttagtgataaaaaggactataggtacataagggcattgaataggtacaatgaagcttctcgattcgtggtaagatgatagtaaggatatatgaattgatttgttttccaacggatggagcattctatagctatagatcagatccagaacaaaagcctacatatccatagtgatgtgagctagctctggagtcggactgcaaaaagattgcaaattaatcatagtctggtgtcttaaaaattattggatcgtgcaaaatagtgccagtttatacagtataggttaaatccaaaagagaaacctataagttcccttatcttatgactcctttggaacaaaggaaaagtgaagcatttttcagaggatttgaattctatggatagaattcctatggagcgatttggaacaaaagattgaacccttaaaattccttgagaaatcctatggaatagaccatttcataggaattttagataaaaattaacataaggtctcacctcatggacttctctttttgtgccttcaattcctatgtatttcttgagtgccatccaaacgactattatttaagaatcttgtgtttttgtttcatgtaggaatttacaaggcatgacattctaatcttgtatatttcctactccatgttttcaaaatcgtgcgttctaaagcagcccatgccatctctagtgtacgtaataaatcgagtcgttgtatatttgatagtaataaagtccgaattaccccctaaactattgacgcagtaagatttaccccctaaccacaataccaaacatttaccaaaactcttcaaactggttgaattaaatacccccagtactgtttaaagagattttggcctaggattgcacacatggcgacaacctagcactccaatcagcaacaaaaaaaattccaagtaggcccatatgtcatctctcaccccaccctacccctcctctctcgaaaaggacaagaacccaagagattggcgggcagtggcgcttcaatcccccacaatctttcccgagaaaggccaaggcaccggcactgggtgtgttgtttcctgctgaggtcttcctcacgcctcgtagtgagtgctagcgcccgtgcctgccgaggtctccactgtgcaacagaggaagaagggcgttgatgccacacacagtcacgaccttgtgggaaagaggggaatgcgataagggcaaaaatctaacagatcggcccaatgacttttttttataaaaaaatactaactggattgtcacgtaggactaaaactgtttcagattgagttagtgtgttatttgccggtttgaacagttgcatctggtattaaaatttcatggggtaattcaaatgatggtaatattttaggaggtaattcttcaaaaaccaaaatgtgtagacttctgaaccgtcacaataaaaaaaaggataattgcttatttgaccatattttgaaagctaactactgaccctatttttttaagtttgcttatttgaccccgctttttaaattcagagtaaccgtctgcccctattttcattacaccattaagtttcccttcttcttgtacaaaataaccaaaatgccacgagtacacatcaaaatgaccaaacaactttcacttcatccaagccgaccccgacctcgaccatggatgactgacatgtgggcccaaaaagttgactgcatcgtatttttgtcactgatacgtgggcctgaaaagacgattgtactgtacctttgccactgacgtagtcgaccgcagaggatcctgactggtctcatcccggtggcgaggcggctagctcatcgaggccgaggcaaaggctcgcggaggcatgcgtgaagatagctgaggcgcatggagagagcggcggcgcgacctgcaatggacggaggccaggatggtggctcgcggtggccggtgcggggtgtggaggagcgggaagaaggggaatggatctgcggccggcgcatggctcggaaagagaagcgggggttcgcagcaaggaggcatgtgaactcaccggcatggtgctcggcgaacgcccggcacgaagctcggctaatgaccgggacggagggagacagtggtcggttgctcgcatagcagtggaaccccaaatcttgtggtcaccggcttcagcagctgtaggtgcaggctctaagaatattttttcctccggtctctatctttgttgttcatgatttttttatttttgtgtgaacagagcagtccaagtggatttcttcgtagggatattctgagattttctggttgaacttagcaatcgaagcaatttgaagacaatagtttagttctgattcttgctctattggaaagctctgaacttttgttccactgtacctgtcggttgtccatctgaatgaaggcatgagcgtcattttttctataagttaacactgttatactgttttcacggaacagggtcagacctaatttttatttttttaaaaaaaagtcaaatgatcaaacttcgaaaaatatggtcaaattggtatttagtctttaaaatatggtcaaagtgcaattacccatataaaaatatgataaaaagcatgggaaccgagacgacatggttatcaaatgaacagcgaggatacataaatatagattatttcagtttattattggacccacataaagatgcacatacaatgcaaaacatatgaattgaattgattttgcagtgggtcctgacttaatagtttttacaacaagagatggcccttaccatgcaactaatagctgatgattgcatgtttgcatcatatttatactccaaaattatcataccaatttaaaagaatttaaatgaatagtatacaatgtgcccatccaattaggccaaacaggcactggcattatcatacgaattatatgttcaattatgttaatacgacaataagaaacacatcaaaatctccctgaggagtcatcctttctttctcaagacaaaaactctcattcgaacagttagttctcatttacttatacaacatgtcaaattgagtaaatggcatcatcttgttccgatatctccaacataaaaacattcatacttgcaaccagatcacacatagacataacttttatttggtttactccaatatcccctttctccaatggtaaataaatccttgatctctttctttctttgtctttcccttctttctaattataacattaagaaaagggccaaagcgaaatggtttgacagactcagcttgtaacttataaaggtagctgctctcctaggtctgttctctctctatctcagagcataaatgactttggagtaaaaccctagcaaagtcattactcggctccagggcaaaccgatcaatgaaaaagacctttttttagtttaatatggtcagacccatcagagaaatcctagcgctatcaacaccttcaggtccgtgtagttgaatgccgaaatgtttgattagctaaatatttattttacataggtcactctcccatttatactgaagaagtaatccacatgatccatgccaatcagctcattcattttttgttgtgtcatcatccattagtgatgtagttcccacattaggttcatgacttctgaagcaaaggggcgaaatattctcgtcaaaacatgaattttttttaaagtacccttgggtgaatgtgagccattcattagattagatccaaagaaggaggtttatttctactacattagtatagttagtgtaataggtgtagtagaagggtacatctgaaaaaaaaattgtggcattggtataaatctctgtaatcagtaatatgacagggttacaaatgtacaataagcctgaccctttggttcaccacagctaggtttgtgttgcgagtttctgccaaggcgccgtgcagtcacatagacctggagccagaggtcgaatgttgctgccgtgctcttcgacgagaaaagcattgttttccatgccatcgcccccacgctcacttgctctaatactacaaggatgttgcaacaaggatgttcctaccaattatgtcaatatatttctttcttgataatattagtaatttcattcacgaattgaactatgataaccaatggtgatcccaggacaaaaattatcggggatccaatacatattaattatctaattattagctaacatattaattaatatggtacaaattagctagaattgaataatttacccaggtgtggtgagcccgggaaacactacataggaacacctccgatgataaccctagtagcagattgggcaacaatatcttactcaagacaatctcttactggggagcgaaagatattggcataaaaattcccttgcatatgtacattgagacattgcttcatgaatcggatcaaaacaaacggaagaatgattacagtggctccagactgaatgcagtggtggcagcggctcttgtgacgtaccgcatacaaatgaggggtgccgcctccacagagaggattattcgcgcaaggagtggcagtggtccctcactcctgaaggcgagcaagaaaggtggaggggcggcgagctcggagcttcaagcacgcgggtgggaggcggagccagaggacgccaattcgttcaacaagggtcgccacctagccgcatgttgtgcgtatagcggagtggaggggcacggacgggatgaccattgggcaccttgggcggaggggcggcaccatgcatcaccgttgtggcagagtcaggcttgcgctgtcgcgagagaagagccgagggcggtagcaatcacagactgggagcaaggcaacataccaaaatacctttctaccttaattaaggaaaaaaaatctaaaatacccatgaaaatcaactactatttgccgggggcggggggagggggcgccgtaaaatgacccaaaaaataaggaaaaacagttcaagtttgattagtcttactaaccgtcaacttgtatgtttcatggcctattgtgaatataaaatattaaaatttcactggataatgataaattatgttgttaaattcataagtaaattttgttttaaaggaagttgatacaaaacatttctatataattatagatgccaaaaacagaattagtaatttcttatataatccattctaatatttcttctattactttatttttttgaaatttcataatttaaaaattcaatactagaagtatagatttgtactgatcttttggtgtctcttgtaagcatttgctataaaataatttagcaagtttgaattaataggtacataaataatcttggtttggagttaagctttttgatgatttaataattcttatattcataattattaaatatcaagttgtattacatgtagagtagactcaattataacatatacataatttaattttaaaattcctaagtaaaaaataacatactgggtttgaagtcttaactaatgttttatcatgattcaaaattgttccaaattttggaatcaacaatgtggcataaatgacatgtcataatttcaatgacgtctcacttccatcattacagacatcattatccaccatattcttatttaagcttagttcactaatgatgcaacggaatttaaaacatcattgatgcttgattaactccacaaatagatttcttaagtctacaccctatatgtgacttgtctttccacaacaaaaaaccaactcaggctatgctatgtatattaatttttgcaagtcactgttaagagatgaaaaaatgttttgcaaaacttttacaactcatgcaaaattttagcatccacataatggagatatgaatcataaatgaggtagaataatctctcttgttggagattttgatgagctcccactgattttattatttatgcaatggaatcataatatatgattttccatcaacttgaatcacatgatttaaatttaattttacttagtaaattatcatctaagtaatgatcgatgtaaaaaatttctaggaatgaagtgtctctatcttaatgagacatctattatccactagaaatgtggctgaataacaaggccataatttcgagaacgtctcataatgattcaacctaaaaataatgccattaattttcttttgtaatactttgtcaaaccaggacattaagcatgtccctatttcttgcaaaaaaaacatacataagaaaaaaaatcaagatatgtatacgtaagatatagaggcaattttatttccccttataaggaatatatgagctttattatcattaaatttggagttgctactctctctctctctctctctctctccttagtaaagtttatctttgccatcaaatacatgatcttacttagcttgcttcttagtattttgtatttcttattgatatacaaagtgataaaacaagtcaattatgctccactttgtctcactgaatattacaattctgaaaaatgatcgtagtttagtaggagaaaggtcatatgaactgggcaagtggcgtatttaaaatgtgcgatgtctttctctaacctttttaatgacttatcattggtattgatgaactcctaaagtttgcaaaaacatttgctagatacagtttcgcattgtcaagcacaaaattatcctctaatattggcaaagatgataatcttaatatatattaatatatattagtgatatgcgaaacataactctatattggccttctcccaggataatttcatcaaaatgcctctggaatttaggaaaagcattgacattagccacgaaagcaacaagggatcctttgttaatgttaagtcatactaagaaggccttaggctcagctaaatcaatgagagaaataactcaatagacttaaattgataaataatattagctaaatttgtatcgtcttatatcctatttttaggcagttcacaaatggtgaaatttaacatggaaatgacctcaccttgtgttacggagaagaccacaattaattaccactgctaagctccatcctccatgctctcatcctcctcccatggcggatttgcaaaaacaccaaaccattgccattgcttccttcaaaaatggctcctccacacctccatttcctcctcgtctctcacccattaacgacatgggctctccacgttcagccatggccgccgtgaacatacactaatccggccgtcgcctccaccagctgccggtggcggcgccgccgggcgccggtgtcaagatgccggagaagggcaccgtggtgatgagccggtacgagctcggccgctcgctggggcacggcacgttctccaaggtgtaccaggccaggagcctcgtgtccggcgagaccgtcgccgtgaaggtgatcgacaaggagaaggcgctgcgcgccggcgccggcatggtcgaccagatcgagcgcgaggtcgccgtcatgcggctcgtcggccgccaccccaacgtggtccgcctccacgaggtgatggccagcaggagcaagatctacttcgtcatggagctcgtccgcggcggcgagctcctcgccaggctggtcgccggcggcggccgcctcggggaggacgcggcgaggaggtacttccaccagctcgtcgccgccgtcgacttctgccacagccgcggcgtctaccaccgcgacctcaagccggagaacctcctcgtcgacgacgacggcagcggcggcggcggcaacctcaaggtcaccgacttcgggctcagcgcgctcagcgcgtcgcggcggcacgacggcctcctccacacgacgtgcggcacgccgtcgtacgtcgcgccggagatcatcggcgacaagggctacgacggggccaccgccgacgtctggtcctgcggcgtcatcctcttcctcctcctcgccggctacctcccgttcttcgattccaacctcatggagatgtacaagaagatcaccaatggcgagttcaaggtccccgactggttcacccccgacgcacgcagcctcatctccagactcctcgacccaaaccctacaactcgcatcaccatcgacgagctcgtcaagcatccatggttcaagaagggacacaccaagcggccggcaagctcgaacaccatgaaactcaacgaggaggagaaaccagcgaacgccgccatgaacatgaagccggcgagcttgaacgcgttcgacatcatctcgctctcgcagggattcgacctgtcagggatgttctgctgccatggccacagcagcaggacgcaggatcagctgttcgtcaccgggaagccggcgacggcgatcgtgtcgaggctggaggagatcgcggagacggagcacttcacggtgaagaagaagcagaagaagaggcaagaagaggacgggatggcggtgaagctgcaggggtggaaggaagggaggaaagggcagctcgccattgacgccgagatcttcgaggtttcgccgtcgtgctacgtcgtcgaggtgaagaaaacggccggcgacacgctggagtaccaggcgttctgcaacagagacctcaggccgtcgctgaacgacatctgctggacctcgccggcgacagcagcgtcggagaagaaccagctgccggcagtgtcggaggtgtcgccactgagtagtcctcggaattgatgtgacagattatctaggtgcagtggcagatattgatcatcagatatgtgctgtttcccttgttgtttcctttgctttgaattgttgttttgattttttttttattcttgtttgtgtttcataatgatcttgggggtagtggtctggtatttccaagttcaagatgaatttcaattattgtttttttctgttcttttgttgtgtggtggactggtggtttagtgttgattgttggacataggtgatagaatgtgttctccttttgcttaaattgcatggtccatttgtaaggtaaattaatggcatcacaccaccataatatccaatttatgaatgttttagaaatctcttttttttaagtcttcttgagtttttttattgtatttttgggaaattctcgatctcaaatgttgaaaacagtatatgggttgttgacttgttggtcccctacaaggaaaattggtaaacagacacaataggcccaacaaattgacggcccaactgtttacgcagctccctgcttttctggatgccgtgtactcttctctgaatatgctgcccctctgaatgctacgatcttgacttcaagtttctgaatgctaagtactagcttataattatatggtacctaggatagtaaatttgagtttccgaataaatcgtgtttcatttatagtttatataaatgaagagagaaaacaatagattgctttgagctgaaaattacacaaccgatttggctatcggacgcatgactgctgtatttgttttcgcgtacaagtactaggttagcaaaacacagatccattccactggtcggacatatttgtcacatgcgatcttttgtggccattgccatgtagacaaatgtccgattccaataagaacacgttggcttccaatagaaacaattgctgaagatcatttgagagattttggaaatctgtataaaatatggtcccatttaattcaatggcgcaagcaggaagtatcccccctcatggctgagtcccagccaacaaaaataaagtatgtccaccccaaaaaaatcgccccagttacaacaaatgattcgattattgtaaaagacacaatagtaccaccacggcaacatttaagctaggataacttggtttaaacttttgtctaccaaaaccaactaccgatagtgtaagcagctggaacgttattatctccactcgagcaaatgataactccgcatattaacctccaactgaagaccttatattccaatctgcttctcgaacttctggatttgattcaagaatatccatgtcatctgcacaaaataccactcagtgaggatgcatgtggagaactagagacaaaaggtggtacaagtacagtgcaaagatgtgcttaaacattaccatcacatggggagcaatcctgacacagtacacagggaagccagtgtagaacttgaatgggccaccgctcttgaaggtcttcatggcacagtccaaagaaccggtgtacgggtacttcccactggcatcaggttgcatcttctggatttgtgtcttcacatagtcaaaaggcagactgcaggccgatgcaaagaacccagaaacagcactggctcctgtaaaagaagttgtaatatttcatatgaaaactttgtcctgagcatagaagaagggcagcaggcatgtgcttacataaatttgatagtaatgtgcaatattgaaagatcatattttactcaactacagcaaattcttaatgcatgtaaagcaaaggggtgcagg

SEQ ID NO: 59071 - DNA, 47809 bp, Oryza sativa
  unsure (1)..(47809): unsure at all n locations
gttggacaggtcccggccgccgctgagtagtcgcccgcttggatggcgccggcgcacgtcaccatgagattctccgaccgcagggccatcttttccagctccttccaccgcctcgccgcctcgatctgcacggcggacggcggagcacgcccggggaccacagccatgccagggactagagacgcgtacacggcagcagcaggatcggcgtggtacaccgcgccgctgacgttgcccagagcagcggcggcggcagcggcaacgtccatggcggaccagccaccgaagccgccgaactgagccatgcgcgacggcggctaggaggaagacgacgcgggcgagggtgtgaggcttgcttggcttggtttggtggaatgggtggtcgctctcgccgaggcggggtttttatagggggaggagaggagcggggagcgtggtgcagatgacgtggctcgggacacgtgtacagggaggtggtggaggggagggggtggggtggggatacacattaacgcctggatttgtgcaagatggctggatggctggctgcccctcgtgtgtgtgccatttatttgtgctgaatttccctttttctcctttctccttttgatttttggcttggtttatcttgccttgttggatgccaaaagggatggaatttttttgtttcatactactatgctatatatgttgcataagtgattcaacatgcgtgttgttttgcactggagtgaaatgtggcatctaaggaatgagaaatttgaggaggttttttgagagaaaaaattttgatgttccttaaaagaaaagagaagatgaagaggatagattaattggtttaagtgaaaatcatggaatttagttgttttattagacatgagaatgaaggtgatatgcgggcaataccgcacaagccatgcaactatgaatctgtataattaatttctaaagactaaaaaatgaatgatagtattcataatgaatttcactagcttttaaagcaggtgtaacctataccgtgcgtgcgagaaagttgaccatgcatatcgtatctataaattacaaccattacgatctacttgttgagccataggttttaagttataggcaactttaattttagaatttaactatagaataatataattgaattcttttgactagaaaaaaaatcagtattcataacggatgttttactacattgaatttcgtcggatctttcgcatcagcacatcactagcttttaaagcgggagtaacctatacagtgcgtgcgaggaagttgaccatgcatatcatccctttgaattacaaccattacgatctacttgtttgagccgcatagacaactttgaattttagaatttaactatagaataacataattgttcttttgactagaaaaaaaatcagtattcgtaacggatgttttactacattgaattttgtcgtatctttcacatcagcacatcactagcttttaaagcgggagtaacctataccgtgcgtgcgaggaagttgaccatgcatatcgtacctttgaattacaaccattacgatctacttgtttgagccacgggtttataagttatagacaactttgaattttagaatttaactatagaataacataattgaattcttttgactagaaaaaaaatcagtattcgtaacggatgttctactacattgaatttcgttgtatctttcgcattagcacatcactagcttttaaagcgggagtaacctatatcgtgcgtgtgaggaagatgaccatgaatatcatatctttagataccaataattacactctacttgtttgagccatgggtttataagttataaccagctttgaattttagagttcaactttataatcaatataaaattgatttctacaaactagaaaaaaaaactacatcgaatttcatcgtatctttggcatgagcatactagcttttaaagcgggcgtgacctacaccatgcatgtgaagaagataaccgtgatatatctttgaataccaacaactacgatctacttgtttgagcgacgggtttataagttggagccaactttgaatttagaatttaactttagaatcaatataattgattttttcaaactagaaaaacccatgtcataatggatgttatttagcattgaattctatcatatctttggcttgagcatatcagtagcttttaaaacgggctatagactatgtcgtatatcatatcttaggatacggacaattacgatatacttatttgagtcacaggtttattagttgtagccaactttgaatttagaatttaatattagaattaattttgatttttttctcgttttctaactaatgcttggcgagtgtaagagcataaggctgtgttggtgagccattagcgtataaataattaattactatgtacataggagatctttgagattttgtgaaatgtataataaatatcacattgattactatgttaaatttagaagataattaggaaaccgattttcagcaactggctacaaaccccacacatatcaaaacaattcattgtgctttgtgatttttgaactccctttgtccaaaaaggcagtttcatcctcatgattgattgttgttttcttgtttgctttacagagaaagtagtgcactgtactctctaatgcacatgataatatcgtattgtaatataatatattagtgaataataatgtagcatttttgcatattaaactttaggatgcaatgagttgcaactatacaaaaggtatagatttgcatttactaaaaatgttattaccacatagctttataattaaaaaaatattttctaatttagagggaagattatatttgcacttttctattccaaacaaatatatttgcacgattgcaaaaagaaaacatatttgcatatttccatacaaaaataaatacgagtgcattttcgtggaaatttatattgcagataacataaaaaaagatgtaatttttataattgcaaaaaatatctattcatctttcatgaaaattcgtatttccataaagacaaaatacacgtcacattactatttttttaaaatgcatctacacataaaaatgtttgtacatttacattgcacaagtgcacatttctatcttgtgcaatgaaaatgtgcagacttttttttggatatgctcaactatggcaactgcacattccattgcatagttgcgcatatccaaaaaagtttgcacattttcgttgcacaatccacacattattgatgcaccattctcatacaaagaaaatacatatgtgcactttcccatccaaaaggaaaacatctgtgcatttccatagaaaacacatatgcacattttcacccacaaaagatacatctgaatatgtccatccatattttcacacaaaatgttctgcacacttcactcaaaatggttctgcaaatttgacataaaatggtctgcacatattcactagatcattttaccttgcacatctggccaaactctgcacataacacatttcccactgcagaaacgataagcacatatacatttgttcaaaaactttaaaagaaaaactgtagggcatgaaaaagtgcaacacgttcctgaaaaaaggcagcacaagagatctactcatttcgagagaaaaaacacatactgcaccaaaaaaaaatgcagtaggcggacatgtcctacacaaaattgtatctacacaacatacgtgaattttcagtcatgaacatccacgagcatacgagagagtgtggttttagtcccacattgcttagccaagaatacaagcatacaaggccaaggcccaagggtgcaaacaaacttaaaattccagattaacagtcttgtacaaaacgctcagtcaaaaaaaaaaaagtggggaaagtaggagctgagtttttgcgttcgtagtttgttccaagcaggaaagagcccttggaccttggccagtttgggtcttgtagtaaactagtaatgacgccaagataaccatgcatatcgttcccttggagctaggaagtcaagcactcttgtagtatctttcgaagtaggaggcagggcacttttaacacctgtttagaaagctgaaattgaattgttctgtgaatttcctgcaaaagaatccttcaaatacatcctgtaaatcaatttctatgccagctataccggtgttatatgtgtgaatgtagaaagattttaaagaagcactaacacatgctattttgccaatatctctagttacatatattcactatcactaacatggaacaggcaaaattctttagccctatagttgacactgacaaccattacagcgttgttactcctatttaacaaaaaactccctccgtgtcttttttgtatgatgctggttagttctaaccaacgtcatatatttagggaaggaggtagtagcatacaaaagctacaatattctcactgtaaaactaatcttacttggatatttcttttggacattattggacgcaaagatcatctgcatgaagcaccacttaaggggactgcaaggaagaaacactaaaaatgtaagagaaacaataaaggatctccttgtgatccaacaaatagagccgaaaagacaataccttctgtgcaataagaaatgacaaaagctggagtgccagtatctgagctagattttcaacattttttgtcatgtaccaagctgaatacttgcacaaacctaatacatataactgaaaattttaactttgttgatccatgcagggttgctggggcttcttgctatatgcctatatccaaactgctagtgagtatttgtattgttagacgtggttaataactgttgttgcaaaggatttctgtagcagtgcttgcagcagatgcataataatgcatggccacatcttgtattgttatacagccctctttctataagtttttcatccatatcctatatctccacatgaacaatctccatccttaaagcagtgtaattgcttagtgtctctaacagttatctctcttcgaacaatttcagaaattgccttgaatatcacatgacaactctggcaagtgtatcggttctttgtgacagaaatagtggtaccaggtgtagtattgatcaaaccaaaagctacagctaatctttcactgtgaccgcacaagatgtcgtcctcggatacttctttatcttctaaggactcaacaggagcaaaaccacatgctttcattcgctcatatatgccatgtagaacaacatttatttcttttatctgtggatgtgattcatcatctgtaagaaatgcgtgagttactcccttaacctcaacccagctacatccattatcttgctccaatcccttctctcgcatggtttttctcactctaaccacttgagcccatttgccagcatcagtatataaatcacacagaagaacatgatatgcaacatcattaggttccaactcaaggataacttttgcagcaagctcgccaagttcaacatgtcggtggatccggcatccattcaacaaggctccccacactgcagcatcaggtttgataggcattcgatttatgaggttgtaagcttctgttaatttcccaacacgactcaatagatctaccatacatgcatagtgcttgagatttggaactattgaaaatttctcagtcatcatgtgaaaaagctcccagccttgaataaccattccagccctactacaagcacacaataaagcaacaaatgtaacttcatccggatgctctcccatttctaccatttggttaaagagtgataaagcaaattattnnccttcccccaaaaaganccnccccccaatttgggaaaggcctttaannnnaaaccagaaagcattatattccaagagacaacatccttttcactatgcacgctgaattgtgcccaagcatagcttgtctggccacatttcacatacaagtctagaagagcattgggtacataaccttcagatccaataccacaccttaaaacatatgcatggatttccttaccagatctcaaagccccagtagcagcacaagcacttagagcagctataaatgtaacagaattgggttttacatgtcctagcatataccggaaatagtacaaagcctcaaaactcctgtggttaaagcaaaatccagcaatcattgaactccatgataccacatccttctcagccatgaacttaaatacttcaatagccttatcaatgtgcttggatttagcatacatttcaaggagcgcattagcaacgacaacatacctgatgaatcccttgttctgagcaagctcatgcaatttgatgcctacatctaacctccccaagcaggcacaagcagcaagggcacttgcaattgtaacatcatcaggacttacattatgcaattccatcagtgcataaacttcaagggctttatctgggaaaccatttttctcataccccgatatcattgcagtccatgacatggcatctttagtttccattcttgagaatattttacctgcatcccccatcctcccgagactggtgtacatctgaatcaacgagttacagaatgcaacatcaatggcgaaacctctctttacagcaaacccatgcatttcttttgcaaaacccacttcagacaacattccagatgcaacagtcacactggttattgtcatgagattcggttgtacctcattctccagcatggtgagaaacaactccaaccctgcctcacactcatgattctcaaaatgcccagctatcatcgcattccatgatatgcagtctgtcacggccattccatcaaacaccttcctcgccgccacaatatccccacattttgcatacatggtcaccagagcattcaatacatcgacctcgtctccaaaaccaaatcgaagcacatgagcatgcacctccctccccatcctccagtcagggatgcccccgcaggtacgcagcacgcaggggaacgtgtagacatccggcctcatccctgcccacagcatcctgtagtacaggtccagcgcctcctcgaggaagcccaccttgccgtacccgcctaccatgacgttccaggagaagacgtccctctcaggcattttggcgaacaccctccacgcgtgccatatctccccgaacctgacgagcatgctgagcatagcgttcccgaggcggagcccgaagctcgggtgctcggcgtcggcgcgcgcgcacgcccgcatcccggcgtcgaccgcgcggcgccactcgcagagccggaacagcgcgacgtatgcgccctcgtcgggcggctccggggaggactcgaggagccagagcgcctgcgccagctggccatggctacaaagcgcccgcagcgcggcgctccggtcagagtaggtggcctccgcggaggcggcggcacgcggcggcggcggcgccgctgcggagccgactccgcggggacgcttccgcggcgggaggtggccgtgcgccggcgtgagcgggagcggctgcggcgcgcggtgggaggcgaggaggtggaggaggggagggttcgggtgggttctagctggcggtggcggcatcgcgggaggcggccacgagcatggcggtgagagacgcgggggtttaggagaggtttggcgcctcggtggccacctgatccgggagcgcgaatggatagagctcgcctcgcctcgacgcggttgggaagtgaggagagcaacgaaattaaccgtcctagtacgtaaatgggcctcaattgggctggagattaaggcccaggtagaatttttttagtgaattgcactttggacatttttattgataaagtttcagtttggacaatcttataccaaatatttttactttggaccacataattttatactccatccgtttctaaatatttgacacgattaaattttagcatatgtttgaccgttcgtcttattataaacttttgcaaaatatgtaaaactatattatacatataagtatatttaacaatgaatcaaatatttaacaataaatcaaatgatagaataaatattaataattacttaattttttgaataagacaaacggtcaaacatatttaaaaaaatcaacggcgtcaaatatttagaaacaggggaagcatttgttatgtaatggaccactttaactatattcgctagatatatttagcgtctcctttcataaatatatgacatgcatatacatatgaaagttcgccgacataagtggtaaagatgtggtttgagatgatccgttgtgtaacaaataaaaaagctatctagtacaaagtaaaatgattaaaaaaataatccgaaataaaactttggctcaaggaaagttaactctcttttttggacgcgagaggaaaattcaggattttctacgcgtcagttcagttcagcggcgtgaaattttccgggcctgaataaaccggagacagaaacgaagcagcggaaagagacggaaatcggagtaatggcagccatggcgtcgtccgctcccacggccgcgaaacccgtcgctctactgccagccccaatctgccgctgcggcggcggaggtctcagatcgacgctcctggccctgatgccgccggcggcggcggcggcttcccggttccgagtctccgcctccgcctcggacgtgcccgatttcctctcctccgactggtcggtatcccctttccatcttgtgctttcatgttttttccttcctagtttgcttgtacgttgcaagttgcgacgtttattcatgtggacaatcgaaccaacttgcgactatattggggaaaaaatgggtagcgtagtcaggcaggcagttcaaatggactatccggaattccggatgcggtatggtctcacacacatttggagaattcctttgcccagttgctcactcttccagtactttagtatctgtgcgactgtgccttaagaatggaacaaagcgggtggaagcaatggaaggtacaaatgcgttgaattgacgcggctatctgcttatcatttacgatgagggcaatttacggatcattttgtagatttaagttataagtggaaaggaaggaatgacagacatttgctgtgggtgataagtgtgagccgcaaatatttaactcatgccatgttcgtcgagaacttgttcttcagacgattctgttaccctgaatatccatcccttctttttggcatttgtatagaacagaatattctaccattgtgctagcaggttaagtacccgctgtcaaagtgggaatttcttgaactggtatttggagaggtaccaatgaagtgaattaggcaataagggaccattcaaaaatgaaggacccattagatgattcaaccaaaaaaattcatcacaccatgaactgcaacttattcagtgcctcaactgttaagtctgttaaaagctttgttggtttgttttcatgtattctcaggtgtgcatgtagcatccagttttacctaaggactgcgtgaatcagagagaagcatgtctgcagaaatttacagttggtagatacttagtgcattgtgcaaagctagctttacctatcagatatatctgtaggcagaaagcttatgttcatccttacatttacttccctgaaaataattgttgatggcatgggccttatcttctgtattccttgtaagtgctacgtgtgtcatcttctatatctagagagtataaacttcaatagctgctcactttgtatctaatcaaggtctacataattcaaatttggggacttgaggcctttgctaagttcctgtgcaatgatatagaacaccgcatttgttatcacaggagtttgacatgccataccaagatgtgaatgtgcaaaaggcaagccagtgttacacatgttgtgtatatgatatttaaggctgacattggatatgttgaacatgaatatcagttaacccttctattgatgtttttactgtgctggtaggatcttactcttgttctctgaataattcctcatttttctgcttcaggctcgaaacacggaagaaaaaccctttcggccccaggttgaatgtaatgctcaaactggaaactgtgaaatagtctgatgttgatgtcctgagcttatagattttgcatggttccatctttcagtttaatgcagaagaagcagtagaataccaacttgaggcattaaaatacaatgatcagccacgccaagattatgggatagaagtcatgtacagggtaataggctaatagctgcttgcaaattgctcatttttgcttagatgtggtaaaggtttgacacaacttcataagtctgaatctatatggccttatcagtttgcaggctttgatccttttgagagatcaacttattttgggcgacaatttgatctaggacaggtagaccagaagtattttccttctgacatatatggttgttcatgcttcatagctgtcttgctgattgccactagtgctactccagtttgaacgtttccggcggatatttcaccattcaacttatagggttttgcttgcccacaaagaaagaactatattgagcagtttatgggttgaagaggttggtcttaacccccttaatatttctgtctatcgtacaatgagacaaattatcttgatcttgaatctgatcgtgctaacagaacctatataagcaaagagtgtgggttcgaggatcacgtccggaggaagaagctatatttcagtttacaatggttcaggtacctatcaacacatccttctgtcacctctgttccagctactttgttttttaacccattgttgttgtagagggttggtggctcatgggatgggtactggttaactgagagcttaatcaatgatgatggagatgcactctcaggtggtcttgcttactgaccgatatgtgtcttacactcaagcttctagcgtattgatgtactgatgaatctagaaaattatatagccgtgcaattatgcacggttggtccagaaataggttttctttttttttaaaaaaaaaagattgtccagttatatgtcacggaaagagtagcaatagtacatgtgctgtggtagaattgactgcgacactcccattctgggagcattcaatatgtcaatggtcaaacacgccgctattgtacataagtttggcggctgtatggttgtttatgaaataccgtcatctggaaagctttcagcgatagctcaatgtggatgttcaggtcaggaaacggcattgtcagaagaaacaaagtcctatatacacacatctatgtttttattttgtgtacgctatgattgtctattgctccatccaatcagaagttgaattgttaactgctcaggtacctgatttccgagtatatcttcgatgtttcctgattgacttgtgagtttatcctctatgtttcctgcttttaggattacatggctcatgactgcaggtgacgaggtaagcaagtaaacacaagttgtcttattgcgcttatatttttgaccgatcttctgtttttacatgtttggtcagggttgtggcgtcctttccgatcagaatgtgtaaccttcaagtacttgaaaacatgaaagaagaaccggaaggtggattgaatatgttgtttcacactcaccagaaaagggcaggtaacttgttgggaatatttttttaggtgaccatcatcgtcaggtcaataacttgcttgcaagatgaaagtaacatgatatcgatatctatatattttcgcacaacctgatgatgaggcaaagaaatttgtggatacgggtaaagttccattgcttttgtgcttgaactagtaattaatctgacatttcatagtcgagcactgctccacgtattaaaagtttcttacaaaactcgtgtgccctatttttttagcttattcatgaattattgaaatgggatatttgttcaatgtttttaaaatatgtattctcaaaaaaaaaaactttctattacattattgtaatacttagaccacttgtttttagctgtttgttcactttatttcttaaaatatttaacttgctcatatattcaagagatagtccgcccatcaacatttgatcgatcaaacggggcattagtacaaaattcataaccatttgatctaacttaggtggaggttgtagggaatttagatttactaacataatgtaaaacatttgtaaaagcttttcaagaaaaacttttgtagcgtatatgcttgcttttgaactaaactaagagctttttaataaaactttttgtacgtatagacttgccgtcgaactaaactgacgagtaattaataaaagaccacaaggacatagagttgggtgtgttagatacgggtaaagctccatttgcttttgtgtttgatgcagggcgtccgtgagccgtgtggtgtaccgccgaaccggtgatgccatgcatccatacacgtctacactctacacccattaaccatacatggcgtacaacgtcccaccagctcgtggccgctgccacgttgaacccatagcaacctctcgcgtgaaatatcacgttggaaacaaaaaaaaacgttgttaagtctaaggtctccgtcgtttggcttatttcctaataagacaaaatggtttattaaaaaataaaaatgaatttgtacgtaaaatttttataaatatgttcttggtgacttagaagctaatgttaaaaaagaaactatgttaaaaatatctcaaaattaagcttgaaaatttaaattttggctttttcttttgctgattagtccaaccgatgggagctaactccgtgtgaccatgttgcctacgatttccctgaaagcgaggacggaagtgggctcgaaatagccaaccccgggacagacaaatggatcgatcgatctatcgagcagcccactacaggagcttcccgtccacgtgcgcggaacgcacgctaccgctcccaagtccgaaacctccggtgcctcgcccgtttccccccatgaattccccggccgcgcgaatcgccgagcccccgtcacgcacgcgacgcgcgcgagcgagcgtacagccgccacctccatccacgtcgcggtcgctcgatctctcccccccaagcaaaaagcccaacaaccgcccccgcgcgccgatggagacgagccgccgtcccgcccgtccgcgccttgcgtttctgaggccgttcaggcggaacgcatgagcaaggcgttcccccacggccggttgcttatcgcacagggcctttctgctacgccggcgcccgaccggctcggcgttttcgcggtgcgcgcgcgcgtggctggcatgcattatccgatacggatcgactcgatcgaccgaccagctggtgcgtacctcgattcggacacgggtgagttacgttacgtagaatcgtagatgatgttgtaatgtctgcgtttgtgtacttgtgctgtagtacaggtcgcaatcggactcctgttccgattaggaatattggtgatcggtgcatgcatctcttatccctctcgtctatataactcagtcaggggacaaacgagttcgtccaagtgcaagtaaccccacgttctttgtgcttgtgaccgcagtcgtggtttgcaatctttgtgttcggtgaggtttgtttgctgcatgccatggccgagcagcagcagcagcaagcgccgctgctgcagaggccagccgctgcaccgccgtcgtcgagccggctgccggacttcaagcaatcggtgaagctcaagtacgtgaagctggggtaccactacctcatcacccacggcgcgtacctcctgctcgccccgctcccgggcctcgtggcggcgcacctctccaccttcacgctgggcgacctcgccgacctgtggcaaaacctccagtacaacctcgtctccgtgctcctctgctccacgctgctggtgctcgtctccaccgcctacttcctcacgcgcccgcgccccgtctacctcgtcgacttcgcgtgctacaagcccgacgacgagcgcaagtgcagccgcgcgcgcttcatgaactgcaccgagcggctcggcacgttcacgccggagaacgtcgagttccagcgcaagatcatcgagcgctcgggcctcggcgaggacacgtacctccccgaggcggtgctcaacatcccgcccaacccctccatggccaacgcgaggaaggaggccgagatggtcatgtacggcgcgctcgacgagctgctcgccaagaccggcgtgaaccccaaggacatcggcatcctggtcgtcaactgcagcctcttcaacccgacgccgtcgctgtccgccatggtggtgaaccactacaagctgaggggcaacgtcgtcagctacaacctcggcggcatggggtgcagcgccggcctcatctccatcgacctcgccaaggacctcctgcaggtgtaccccaacacgtacgccgtggtgatcagcatggagaacatcacgctcaactggtacttcggcaacgaccgctccatgctcgtgtccaactgcctcttccgcatgggcggcgcggcgatcctcctctccaaccgcggctccgcgaggcggcgctccaagtaccagctggtgcacaccgtgcgcacgcaccgcggcgccgacgaccggtgcttcggctgcgtgacgcagcgggaggacgctgacgggaagaccggcgtgtcgctgtccaaggacctgatggcggtggccggcgaggcgctcaagaccaacatcaccacgctgggcccgctggtgctccccatgtcggagcagctcctcttcttcgcgacgctcgtcacccgcaaggtgctgaagcggaaggtgaagccgtacatcccggacttcaagctggcgttcgagcacttctgcatccacgccggcggccgcgccgtgctggacgagctggagaagaacctgcagctgtcggactggcacatggagccgtcgcggatgacgctgcacaggttcgggaacacgtcgagcagctcgctgtggtacgagctcgcctacgccgaggccaaggggcggatcaagaagggggacaggacgtggcagatcgccttcggctccggcttcaagtgcaacagcgccgtgtggagggcgctccggtcggtgaacccggccaaggagaacaacttcaccaacccgtggatcgacgagatccaccgcttcccggtgcccgtccccaaggtgtcggccatatgatccaaccacacgcgttggctgtttgcactgaaacattattactagcagtagcttagtagtagtagtagaaatgaactaggatctattcgttattgcttgtgtattgatctgatcatatctggttcgctgttcttatgtgaagttgctctgtcggtctggcatgtaagaaggtctgatcataagttcacttcaaaagttaatttacatcttcataaaatggcaagtaaattggctgtcaacctggaaaacaacaatgaaacagaaatgtacaatttaggctctcttttttttcacttaacgaggaatgcacaacttctcaattgccctgtgacgaggaaaaaaaagttaaaataggttgtcataaaacggcctttttaaaagggccaacagtttcagcacccattgggctgtcaacaaacaccgaactggggctgtacagtaaaggccgaaacttccaagtggagagcatctcggcccattaggcccatatcccacagagccaacggcaacttccgaatccgacggccgaaaatctcgcgtgcgacgaaagctagaccgatccgatccacacctgccgaccaagatccaacggccacaattcctgcgtccatccaaagctaataaaccccgcaaccttcgagaaaaaaattgatgccaccgcagctataaaaccctccgcctccgcaaaatacccaattccatttcgaattctagggttttgttggcccccattcctcccccaccccggtgtcctcccctccgccgctcgggtcgccgcctttttcccctatggtgagtacgatctcgatttcgccgcgccgtgtgggtttggatctcggggttcctgtgtttgatccgcgacgttttttggcttttttttccaggcgctgccgaatcaggggaccgtggattaccccagcttcaagctggtcatcgtcggcgatggcgggactggtgagttcccaatctcgattcggatcctattccgttctgaaacggcatgttatgatatgtttgatgcgtctactcggtgtggtttctactagatctgatgggctaagatttgtaccggtggctgaaatccgatggatttttttttatttcgccattagactgggatttgggtattggatgtttccattttatgattcagcttatcccagggatgggttattgctctatttttatatgacgtctaaaattttgctactcctatcttgatgattaggatcttgagagttattttaggatattgaaatcggcataaatatgatgctatacaggtcgtatttagtcagatgtatttattatcttattttagaatggaccatcgtgctatgctgttattctaggattcgcctgggactgaataaatttgaggaaaaagtaaaatagtatataaataccttcgcatcagtaaactattgcgctttttgatcagttgagattggtcaaaacattagttgcagtctgattagtttaggccggcaatatgcctgaatggcttcatttccgtaagaaaagtttacttattgccttctatatcattgttattggatggattttgatggtatgccatgtttgattgcaggtaaaactacatttgtgaagaggcatctcactggagagtttgaaaagaaatatgagcgtatgtactatgactcttatttttgttgttcctgtattctttgctaaattagttattgaactgttatgcaaatttgtcacttcagcaaccattggtgtcgaagttcaccctctagattttaccaccaactgtggtaagatccgcttctactgctgggacactgctggacaagagaagtttggtggacttagggatggatactagtaagtgctagagaagtgcttaagccaattatcatagcttcccttaatatttttccatgcatatggatgtctccttgtgcttgcctgattgttctgtccttaacttctgttgtgcagtatccatggtcaatgtgcgataattatgtttgatgtcacttcaaggctgacttacaagaatgttccaacatggcatagggacttgtgcaggtttatttctgaagacacgataaactttacctaatatattatatggaagagaactcttatgattaggtatcaactcttgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctgggtaataattccctccttattgttttccttttcatgctttcttcttacattgtttgtgtttattatgcaacatattttaatctgtgttaatgcttttggtgtatgtagtgacccgaacctgcatttcgttgaagctgttgctcttaaacctccggaagttcccattgacctggcaatgcagcaacagtaagtgtttatgctttgtccaattcattttcagatagtgttgatgaaatacctagtttctgcaaacatttcaggaactaattttaatactcatgcaggcatgaggctgagcttgcggctgcagcagcacaacctctccagatgacgatgacgatctgatcgagtagagaggatcatgagtctatcatgcttcagcctgagtctcttcataagagtctgaattaggccaatgcatgctagtgttagcttgtctgtggaatgtggacgtttcctgcgtgcctgatgggttgaaaacttttgatgtgtggtgttacatgttgctgccatgaatttgttggctcttttttaacactgctgtgttacttctatggttatgcttaaactatttgtatcatcgagctggtatttatttatccggtgttgcacaatattcttcttcactgccctaactgcgagtgctgaccgcccaagattatgtaatgttcgcatcgcattaagttttgtatatctgtgatgaaagctaggctcaactgttcttgagaacaggggtggtgactggtgggtgtccggtgtccctgtatcggtaaacaaggacacatttgactgctggtcctcgttgtcgttggtggcgatatactgatatagtgagtatgatggcagtatagtagtacagctcctctaccaacttactcactataccgtatgctcaactaaaatacaccatttcattcgacctggtaaagctgaactgaaaatgagtaagctcttccagttaccaacttaccatatgctcgatagaaaatgtagcatcatcttactgcaactctaaaaaattaaaatccaaagggagaacgaaccgggcgtgaagttatgattaagagctttgatggggaacgaacctggaggcacatggacaggaaatcaggattaagtgatcacttaattaatcccaattccaaacgtttccgacattgattaaatcatcaaacagcattaatcgacctcatttcaaactttgccaacattgctcaaacaacataggagtacaccgtattagtcctggcagaaaaagaacagcaaaccaaagagagatcgtcatcgatgatgaatacgagtacaataaagtagcaacgtttctggaacactccagaagtcactctctctcgaagaaaagatactgcaccgaaatcaccttccgaaaggcacaagccaaatccatcgttggtgcaggcggcaggtccagccagtgtagtgcgcgtcactacgaactctagtgcgcaagtggcctcggccagataaccacacagtcacagcaacagaaaaaaaaaatcgcctcggcgcggcgggcggagacgtcgatacccccgacgaatcctctctctctctctctctctctagatcccatccaccccttccacctctcctctattaaatccgccgctctcactcccacccaccgccgcgacacacacacgcacacctgagccgaagcacgcacgaatccaacgccgagatgaggccgtcgctgctgagatacgccgcgcaggcgctccgccgccgcgactactcctccgccgccgcggccgctgagcggaaggtggccatcctcggggcggcgggcgggatcggccagccgctcgcgctcctcatgaagctcaacccgctcgtctcgtccctctccctctacgatatcgccggaacccccggcgtcgccgccgatgtctcccacatcaactcgccggcgctggtacgtctccacccacccgcctgcatccctctcctggctggatctagccgtgtgacgatgctgggttttggattctgctcctccgcaggtgaaaggcttcgtcggggaggagcagctcggggaggcgttggagggttcggacgtcgtaatcatcccggccggtgtgccgaggaagcccggcatgaccagggacgacctcttcaacatcaacgccggcattgttaagggcctctgcactgccatctccaagtactgccccaacgtaagcaccctaactttgatttacactgtagagtttagatatgcagtgaggttcatggatctggttgtgaagcatgctgattgcgctggtcacggcttggggattgcacttcattgcccatcgtgtagatctagcgtttatttgtggtctcggatcgtacactgacataaaactgatgatggagactaaaatagctggttgcccccaaaattcagtgagaatttaatagtgacaaggacttgatgggaatagaaatggacgttttgcccaaattcattgagatttaatactataggaaggtgaggtgctagttgcctgcctcaatgttgtgtggtgtcgctcgaggctgcctcaatgttgtgtggtgtctcactcgaggaggctcgctctcaccaggccttgttttgctccatttaatcgcataccgccgagaacgaatgggatgttagattgtgttctgtgcatgtctactccaatatatcagctgaccattatgaagtttattgtgctcactatatatgaatacaattgttaatcttttgattgtatgctttttaggctcttgtcaatatgatcagcaaccctgtcaactcgactgtccccatcgcagcggaggtgttcaagaaggctggtacttacgatgagaagaaactgtttggtgtgaccacgcttgatgttgtgcgcgctaaaactttctatgctggaaaggctaatgtgccagttactggtatgaccttgatcttttactcataattttaggggacattgacattaaatatagctgtggattttatgataaaattttatctccgcttttctaatctttgtgattgctgtgatcttctgcagaagtgaatgtccctgtggttggtggccatgctggtattactatcctgccactgttctcgcaggtatcatagcttacgatcttgttttttgcaatttccttccgtggttacccactttgagctcaatatacatatacagagtgtaaatactcgatgatgatgatgatagaacctcatagaataggtgttggaatcctgcatgttttaagcttgctgtataaacatgcattttttattcaatgaagaggttgtgctttgtggattggagtcaatacagaatggttatcttcatttgacaatcacgaaaacaatatgcaattgatgtcatggaattttttcaaaaaatcaaagtgcatttatggcgtgtggcctacctcctaacggagtaattttttgtgtgatgtaggcaacccctgcaagtaatgcattgtcgcatgaggacattaaggctctgaccaagaggacacaagatggtgggacggaagttgttgaagcaaaggctggaaagggttctgcaacattgtctatggcgtaagtcttcatatcaaccttaaccaactatatccttagtttactagttagtctgtcaatattagtatgctactatgcctatttgtgatattcttgataaaacatcaggaaaaagttctcataatttgcaaccaaccgatcccttggatgttcttgccatcctttagatatgcatgcctcaaagtacattgcctctaggttcaacatattggcttcagagtacatatatgcttggttctgtccattggatgttagctggttatatattttcctttaaaagtcctgtccacttgcttccagactgttgcggagttgttttttctattctttatagatcctactccatctatgagatgttagttggtatatatttgcctattgcactattgcccgctggctttaaaaaaaaacagtagcaacatatcagcaaaattcagttctaacttcttgctgttcccatgcccatttgattttcattgcagcaaagctttactgtcataattggatatatttaggttgcaatgctgccaataatagatggaaaccaaaatttttctatcccatgattatacatttttataaacagttggcatatctgagcttgttttcagttcttgtatgcaatgcaattgtacaaactaatttatccaaatgaatttccccttcagccttataactctctgttattgctttcatgtgagcacacatgcattcaaattttggaaacatatttgtgctcatttggctcattgtgctggagtactatctggaactggaatgaataggccacttggatccatgtagataaactgtgattttatggctttgcaagtttgtatacttcgccctgacatacttctccttttccctagatatgctggtgcggtatttgcagatgcgtgcttgaaggggcttaatggagttcctgatgttgtagagtgctcttttgtgcaatcaacagtaacagagctgccattcttcgcctcaaaggtgtttttcttgcttctttatggcattgttatgttgctaccagatttctatcgctagatcttcacagctcttgctttttctttcttttcccacactattatttccgtaaacaggttatggatgcaacatacaatgtgttatagacagttctactatatgtcttctcacatttattgactgaagtattgaactattgcagcttgtgttcatttgttaatagcagctgttctatggtcatagtttgaagatttgaatggaatagtttgtagtagcaatatatatgtttaccaccagggactaagcttttacaatatttgttgtgttccgctgccttttcagttagttgcaagttgcaacagatcatctcttatctttggttggatcaaaatagcttttaagacacctttttatttaaatgtgctgttctatcgttgtactgttgtcttggctgtggtttgaacactgtttcgttacttgtatccttcaggtaaggcttggcaagaacggagtggaggaagtacttgggctgggccagctttccgagtttgagaaggagggtctggagaacctgaagggtgagctcaagtcttcgattgagaagggcatcaagtttgctcacgcgaactaggcaacctatgcagattctaacaattcaaatgtgaactagagggggggtccctcgaatttttggtttgactgttgttctgccccgatctgctggggcaccgagatgttgtgctccagaataaaatcttgcggcttgatgccaacctgaactcaaaacttgtacctgaaacagcgactccggtgctatttttcaccttgtacctgaaactgcgtacagtgaacccaaatcatgacccgagtgtcggtcttcagtttgttgggcgattagaacacttgtgttggacgtcgcactgcaaacactaaacacagcagtggatgggattgcatgactgacctgactttgctgttctagcagaaatcgaagtttgttaaggttctcttggaagtgtaggctgtcgagtcgttaaagacgcgctagtgtggagcatcaggcacttggctgtagttcccaactctctctctctctctctcttccctctccccttttgtttttcacgcacatgttttttaaaacgatatatttttttcgaaagcttatatatgaatgttgctttaaaaaattatattaatccatttaaaaaaatagttaatatttaattaatcacacgctaatggaccgttcggttttccgtgggagtcgcacagtaccatcaggcgagcacagtgctcttcagcgcatgatctcggcgagtttccgtggcgcacaactgcaaaacagcacaagaccaccacttccttgtctcgttcaccgttacaaggttgcaggcttgcatctcccgtagagacctgaaggacagtgctacaaatcgagcggtccgctgctgtgtgtatggcacgcatcaagaattgtgatgcacgttgtcaacaagcagctttatgcagctgtactttgtcatcctagtaccagtattgatgttcaagagcactcacggctcacgggtatttgatccttcatcgctgctactagtacatactacatgactgtatgcatatgctcaatgcttccactcaaaagaaaaaacaaaaaatgcatatgctcaatgcaactaaatgatatcaaacggatcagtttcccataacatgcacagtactcctacaaaatcttggtttgccagtgcttgaacaaataacccattcaaacagtctatcttcttttaaatagaccgctaacggcacatttattttccctagaactcataaattcgccattcattttttttctactgcttatcagtgtaactcaaaccgatcagagccaaatagcacgcttggacacttgataatcatggcttatccgataatcacgaagaaattggattcaagagatggataattagctatccatggtcaaaatttctcaagagcagaagcacatccgcaaaaggtactgctgaggatctgcgtccgacaggttgggttccaggtgtgaacaatggatgtttctatatacttcctccatttcacaatgtaagtcattctatcatttctacattctatatagattcattaacattaatataaatgtggaaaatgctagaataacttacattgtgaaacggagggagtaattcatttcaaaccttgttacaaacagcatactcaccttagaatgtttagaggaaagatcattatattaataatgacccggctttttgaagaaagcccagaacagagtcttgatacagaaaagtaaaggacacatgcgaacacctcacttgctttctggaaacagactccaggcaagctaccaaatgacaaggcgctaaactcctacagcaaaatatccaacaactacttaacaggttacataaaacaccctagtcataagagacacatttaaaagatcttcaggtaattgaatatcaggtttccaggacctcatcctccctcgcatatcctcaatccacgccttcaatacacccttcatttcctcaatttgtaaaagactccatttctgcagaaacatcaacacattatgaattaagtggaacggagaattgataacaaccccttcaaacacaaatttgttcctggctaaccaaattgcctaacagcaagcagctaaaacaacccaccagaaaccccccttttttccttttccttctttaataaaaagaaagaaatccgagaacgaaattggagacatctcccacccagctatttccctaatggcacaccataaaaatcttgctaaaggacatctaaacatagtatgttctgtgtcctcctctagaccacacattttacaattaatctcccctttccattttttctttttcaactgagcagcacaagggatcttccctttcatggccatgaataagaagtgtttgatctttaaaggaattttagctttccacaagccctgtgccctggtatctatcacccctccaaaagttaaagctttgtacaaagattttgaagagtatccgttcttctcatccagagcccatttcaattcatcccacccttctttgatttccactccctctaacaaactttttagttctacccaattatcccaggaaactccctccaaattcctcctaaaggttaggcaccactctccttcttgccaaatctcccttacagtaccaccttgttgctcatttatcttatacaaatcctcaaaatacaccctcagagacacttgtagtaaccaaacatcatcccaaaaactggttctcctcccattattcaccgctctctttgtgtatagctgacagaattttttagcaatctgcaaacctttccaaaactgagacatattccctttttgttccctaaagaaactctctcctttcaggtattttttgtgaagcagctcagtacacaaatcatgaggttccttttctaacttgaaaatccactttgccagtaaactcacattcattttccttgtttccaaaaaaacctaagcctccataatctttaggtctactcatagccccccagcttaacatatgatacttcttctttttcttctgtatcccctgccaataaaatcttcctctgactgaatccattttcttatgcaccccttccggcagtttataaaatcccatggcatacaaaggtatagaggacaagcaggagtttattaagatctctttcccaccataagaaacatagcccccaatccaagttcccagtctcttttccattttttgtcctaaaaagaaaagatctttgttcccaatcttctcagtacttataggaagacctaggtacacaatgggcatattccctctttcacagttcagaatgtcagcaaactgttgaagatccccatcctccaatcccactccaaatacttcgcttttctggtagtttattttcatccccgacatctcttcaaagcagaacaacaagaacttcagagttatgatgttttgtttgcatggtttcacaaatagaatcgtgtcgtctgcatattgcaggtgagtgatacccccttcaatcagattaggagataaacccacgagaaccccagctttcttggctgactcaagaatcagatctaatgcatcaccaactaagttaaagaggattggtgataacggatctccttgtctcagacctctatatgttctaaaaaactccccttgttctccattaatgttgattgccactttaccaccttcaacagcatttctcacccacccaataaatttttctccaaaatttttcttcctcatgacttcaaacaaaaaaggccattgcactctatcgtaggctttctcgaaatctatcttaaagataatacccctctctttcttagtgtcgagttcatgtaacacttcatgcagaattaccaccccctccaaaattgatacaacatactcaccttagggcagtagcagtgcggtgagcctgggagaggaacccaaatgtccacgtatgaaagaaactcaataaaagtggttgaagctcccctctccacagtgcacgcgcatgtaacccaaccccaatttttttcaggctggccccaccacggaatcgcttttcagttcgcatccttccccctctctctctctcccgatggttttgtgcatgctcagtcctttttgcagacatttttgcaggcttttttgatgaggaactcgttgctcaccaaggaaccgagcaaccatgcggaagaactctggcccacaccctctctcctccacgccatcaaccatcctccatggagctgtgaagtaactcgccagctcactacactgtgaagagccttatagtgatctaaggtccaatgggaaacagcataaaaacatatgcaaataccaatgtattctgcaggtcttacctcaatctaattctggaaatttctcttttacagtatcagcagttgtgactggagaaggcaatgaacgagttactgagcccagcacatactccctccgtttcgaaatgtttgacaccgttgactttttaacacatctttgaccgttcatcttattcaaaaacttttgtgaaatatgtaaaattatatgcctacataaaaatatatttaacaatgaatcaaatgataggaaaagaattaataattacttaaattttttgaataagacgaacagtcaatcatgtggtaaaaagtcaacggcgtcaaacatttcaaaacggagggagtatatattgtctccagccacctacataggtcagcatgtaatatcgtagttagagagcattttgctgtttggaggaacaatatagaaaaattcaggaagtctacaacaattaaagaaaataagtagtactccaattagattacaaaaaatgttgcacatgctattccttatcctatattttagctagcatcgatgtgttccatatatatgaacagcaaactttgaaggtgtgccatttctgtactgatagtttgaattacagattcttcacttgacatatcatctccagcttctctctaagctgaaaaataaaagcttctggatattctagcaatctggcaaagttgtcacctacacaaagagaacaatgactgatggaccttagatcaccacaaacctaatcccatgttaccttgcagagggtttatcagtctagaattcactacaggataaaaaaaatcaactccccataacattacaaagagtaactgcagaggttagcgaagatccacctattcagtgaaattcagacaagcacatatcgatagaggcacgatgaacaagaccagacgaacaaataacatatgcaacgaggaaacaaaccaagaacagacaaaggcaagctgattaaagtagcataactactatttctccataataacaatgatagtgttccttatccaccaagatagtcaatagccagggtaaatacaccacagtaccaaactatccaaatctgcaaactaccacaactacaactagcattagcagcgacaagacgagacaggaggacagaggaaaagcctaagcggaggtgaacttggtgacggccttggtgccctcggagacggcgtgcttggcgagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagaaccttgaagatgtagatcttgtaggtctccacgctcttcttccccttcttcctcccggccttcttcccctcgccggcgccgcccttctcgcccttccccgcggggagccgcttctccgccttgggcttcttccccgccgccggggccttctccgccgcgggctcctcctccgcgggcttcttcgccgccggcttcttctccgccttgggcgccatggatggctgcttctctcttcttggatttcgctgggtgtgtgagcttgatttgtgatgtggggaagacgaaggggacgagtttattatatagtactagcaggctagaggtgggcgctgattggtggagacgcttaccacgcggatcggtgacgtggagcgacgtgggacgtccggtgctgtttcggtagacggtcgcgatgagttcccgtgcggatcggtgacgtggcaaaaatttgtaggcgggagaggggatactgtgattggttttctggcgcgggatggtgcttttctggttggtggggcctttcaatcagtttttgggctttttggcacggagcccactactatccatttaaaggcccatttatcatttaaaagcattttctaggtaatttagcaaggatttggtcaaaatttgaatttgaattgcctagatgcatttcccaagattcggattgtttcaaaatgtgtggtttttcgtatattaaaattggtgtacacatacatagcaagacagttaccatggcatcaaccgaaaaccgtgtgaatttcatcttcgacctttagaatttagaattttgaagtttttaaatctcacgacaacagctcgagtgaaaatcataggcatgtcggatgtcatcatcttctacgctgttgcttggagagcatccgctgtaaacaattttcatacagtgatactagtgccatccaagaaaattattcaagttattcctagcagaacatttcctcccacgttctttctccttgcctcttgcatgttccatgatattggtagaagtactgaggactatgtagcctgtagccagacaagtttgtcctattgcatttctttaaatgtgtacccactgaaatgtgggtccaattggtgtttctattttctcttctagtgttacgtagttgtatcgtaggcgtcacacaggatgaagaccgagttaacaagcatataggcaccagtcgagaccattcttaatattgtcgagggctcgatttacagtggttctagtagttggaagacactttcgcatcttgtttgcgattgaggaacacagatgaaacgctacctaggtagcgtttgaatctcatgaaaatgaagatgaagataaagattgagtgtttcacataaaacaagatggtaataacgtgtgattaattaagttttaattattacaaacttaaaaatggattattcttatattttagaacaactttcatatagaaagttttcgcacgaaatacaccgtttaacagtttaactgtagattttctcactagtacgaaaaggcatatataaatcaggcatagtgagagcccaatgtgcactagtcaatctgatcagtaccagacataatagtgtatcgtcaaagattaccaagacaaaaataatctttttatttttcacaagcctcgctccatggctcgggagacatattgtcttgccaagacatccggccatgcctgcccaagctcaattaatatatcacaactcaaagtgcccaactaagcagctctctcaagacctggtcattgatgcttcggaatgcttcgaaatgtgatccaggataattcttttaacctatcatctttaggaggagttgaaaggaaacagaggtgcaggaagcggtgtcatcaccgatcttggtgcgcccgcgtatatttatatggttgccaatagccggcaacatggctttacaggatcataacaaccttggctaatatctctctaactaatcctgattacaatcattatctatcagctaagataagatcgatatggccaggttgttatgcttacacatgattatatctaatactccccctcaatcacaacctacctacattgagattgtacttaaaattttcaagttgtcttgccgataacgcctttgtaaatccatcggccacttgatcacctgtaggaataaactccacttcaagtaattttcgttgcattctttcacgtacaaaatgatagtcaacctcaatatgcttagttctagcatgaaagacagggttagatgataaatatttagcaccaagattatcacaccacagtcgagccattggaggacttggcacactgagttcctctaacagagtttgtatccacatgatttctgctgtagcattagccaaggccttgtattctgattcagtactagaccttggcacagtagcttgtttctttgcattccaagaaaccaaattatcccctagaaatactgcaaaacctcctgtagatcttctatcatctatatttcctgcccagtctgcatctgaatatccactaacaagcatagactttgacttactaatctttaaaccaagtttagtacattgttttaaataccttaatattctcttcatagcagcccaatgaactatagtaggagcatgtagaaactgacataccttatttactggaaagtaaatgtctggtctagtcagagttaagtactggagtgctcctactacacttctgtaattagatgcatcattgggacctaataaatctccttcatgcaaagtgagtttctcactagttgacaaaggtgtactaacaggtttacaatcagtcataccaactcgtcttagtagatcagtaacatatttttcctgggttagaacaatgccactagatgccttgtttacctctatgccaagaaagtagtgtaagtcacctagatcctttaaggcaaaatccttttgtaggtcctttagcagagctggaactgcatcctgtctcgagctagcaacaattatgtcatcaacataaacaagcacaaaaattattagaccccctttattataaaagaatagagaagtatctgccttggatccttggaatccaaggtgttgaagcttctgacttaacttagcataccatgctctaggtgcctgttttaaaccatagagagctttgtcaagcttacacacatagtcaggatggaccttatcttcatacccaggtggttgtttcatgtatacctcttcttcaagaataccatgaaggaaggcattttgcacatctagttgtcttagagtccaacctctagacacagcaattgatagaataattctgattgtggctgccttgacaacaggactaaaggtatcctcataatctatcccatacctttgtttaaaacctttagcaactagcctagctttatatctgtcaaggctaccatcttgttttcttttaatcttatagacccatttataatctataatatttcttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttccttgtcttgttgagtcgaaagcgatgaagatggaagcgggaacagccggccatgacagcgtcctctaagaagcatctccttcatggcctgatctttgagagaaaaatgtttagggtacagttcaaagtaggctgcattgtcaaccataagacaataggctgaaatcaagtttttactagcattgggaacatatagaatgtttttcaagtgaagggaacgtgttggggtgttaacaactgaatgacctatgtgagtgattaccatacctgcgccgtttgcagtttgcacttggtcctggcccttgtatttgtcccggatggtcaacttctcaagttccccggtgacatggtccgtagtgccggtgtctacataccaatttgaatctactccataggatgctgttgtgcctgcatatttctcatcaggaacaaaatcctcatcatacctgtaccagcaatcaatcacggtgtgcccccttttgtaacaaagttggcacttggggcgataatcaacgccattgcctccttgtcgctggttggagttgttgccgcgtcctctgccgcggctgtttcctccatggccgcgttgctgctgctgcggctgcttattgttgcggccccttcctggattgccgcggccacgccctctgttggcgagattggccgagtgttcctggcgcatcttcatgcgctgctcaaagctgagcagctgtgagtaagcctctcctaggcttacatgctcagatttggacactagggaggagatgatgggctcgaaatcttcatctaatcccgcaattatatacgagatcaggtcttcttcatcaacgggcttgccggaagtcgccagctcgtcggccaacaccctcatcttgctgacatattcagcaatgccgaggtcgcccttcttcgtgttcgtcagtgcgatcttggtgttgatggagcgcgcccttgtggccgaagagaacatcccttcaatcgtgctccagagagatgcagcactgctgcatgtagccacctgggagagaacatctctactcatagtggttagcagataacctagtacctgctgatcattggcgatccattcatcgaccgccgggttggagacctcaacctccttctcatttttcttgatgatgatggtcgccgacggcttctttgtggcgccggtgaggtagctgtcgaggcgtgctcctcggatgacggcgagaacctgaaccttccagatcaggtagtttcccttgctcaacttctccgtgaccgtgattcctccgagggaacctgaggccgaagactgggacgaacttgccattgatagattggattgaaaggagtttgtggtgctctgataccatgaaaggaaacagaggtgcaagaagcggtgtcgtcaccgatcttggtgcgcccgcgtatatttatatggttgccaatagccggcaacatggctttacaggatcataacaaccttggctaatatctctctaactaatcctgattacaatcattatctatcagctaagataagatcgatacggccaggttgttatgcttacacatgattatatctaataggagtgattcttgagattaaacatgtagttttgagctgttttcattccttctctgttagctactcgccccgaagttgtaataaggtggcgcatgagcttgccgcgtatggctgtaatctccagaccgtgtcttcctgggcaggctgccctcctagtctgtaacggctagtatccagcgattctgctggtttggtaatataaatatctcggtttctcaaaaaaaaaagagacctggtcgttgagacccatttaatatgcacgtagatcggtcaagctagggcacttgcactagtgggaacacggaatagcgcatgtttgacgtggagcggcatgtgcgacttgggttcagacatgttagttgggagcgatggagcgctagatgcggggaaggtgacatcaacacttatcccgttgaaacggaatcccgttgtctagccgttctcttacactaatatgtactattccgtccaaaaaaaagataacttctagcaatgaaccaagacacacatgtgtccaggtggggggggggggggttaatcctgatcctgtccaacgttggatgtgtggtcgttttcagtggtcagaaacagttggaatgtgctactctctctgtcttttatccttgttacccgtactggaatcaataactcctcctgaataagtaaaacccctatgataatatcaacctctgttggatgcttgattccattgatatcaatatctgttggagcattgatttcgttgatttatttatgcccatgctgcacgtacgcttgagagcgatggataggtagtaagcgattttcattcgccattgagaggaaacggacatttatttttgctgagcctgtctatatatctacaatacacaagaagagaacatgaacaagaaaatggtcagaatttcgtggccacaagcaactaaagcttgcacgcaatcaagtgacaaactcactgaccatgtacacaccaatgctggccatggccagttgcctagttgctagctgggatatgcctcgaattaccatcggtttttgcctcttcttactgaaaccagagaactgcaaagttaagttcatcaagaaagtaaatactaataaaaggggcacatgattgcaacacttgccaaccacaaaatcaaagtcaggttgctactagcatcacaacctatgagcgacgacaagaatcaaaccgatatattccttgaccgagaacagctagtagccatcgacgactctatttgcattggttatttacaaattaaaattcagtgtgtatcccctgttatgtttatccacgatgacagtggatcataaactgaaataaacacagtgcgatctggcagaggaacacgcgtaattcttagccagtgtggcaaacgagtgcacgtaggatatatcgcttgttagatagaaagaccgcgtacgcacacgcctagctaacaccggctgtgacgtttgatcggagtccagctcgtgcaaaccggagtaccggacgccagacaaagccaaaaatgcatgatcagtttaattagtacgttaatttagtagtatcatgcacatgtatgtgtggttatgtacgacagagttaaactatatttgatcgaaatcatgcatatataagagtatatgtcctgcacagtgcatgcatgcacgcagttctgtgacaaaatcttatttgggcttatatacttcgttctcaagtaactaacagtaattattttcatcttagactacttaatataagtttttcctatatacacgttttaacaatatagcataatttctagcatttgcaaatattttgctgaacgatcaaaatgtgaaaatggaagtgtccaatatcaggtttttaagtaaatttcttagaggcatgtaaatgtatatagccatataagttactccctccatccctaaatatttgacgccattgacttttttaaacatgtttaactgttcgtcttattaaaaaaaattaagtaattattaattcttttcatatcatttgattcattgttaaatatacttttatgtatatatatagttttacatatttcacaaaagtttttgaatatatttaaaaaactcaacagcgtcaaatatttaagaacggagggagtaataagttatagtagttcaagttatataaggtatttcctccgtttcacaatgtaagactttctaacattgtccactttcatatagatgctaatgaatatctatataataatgtctagattcattagtatctatatgaatatagacaatgctagaaaatcttatatcgtgaaacggaggtagtatatctaaaaaaaaattataggaatacaaggccacgtcgatcagcatcgaccacatcgaaacgacctatataaatacacacgcgccaaagcagaaacgaacaaagcacaagatttagctatcctagcaagtcgccaaaaaaaaaaaaaccaacgtagctgcaagcaacaaaacaccagccgggccatgtcgtcgtcgccgatgcttggaggcatcgccgacaggtggcgcgagctccatgggcaggactcgtggaatggcctcctcgacccgctcgacctcgacctccgctcctccatcctctcctatggcgagctcgtgcaggccacctacgattccttcaaccgggagaggcgctcgccgcacgccggcgcgtgcgtgtatggccacggcgacctcctcgccgcggcgggcgcgtccgccgccggcagctacgcggtgaccaagttcgtctacgccacgtcggggctccccgtcccggaggcattcctgctgctgccgctgccgtcgctgctgccgccggcgtggtcgagggagtccaactggatggggtacgtcgccgtggcgacggacgagggcgtcgcggcgctcgggcggcgcgacatcgtcgtggcgtggcgcggcacggtggagagcctggagtgggtcaacgacttcgacttcacgccggtgcccgccgcgccggtgctgggcgccgccgccgccgcgaacccgcgcgccatcgtgcaccggggcttcctgtccgtgtacacgtccagcaacaaggactccaagtacaacaaggccagcgccagagaccaggtgaattccacttcacttttccagtgattatttgacctaagctattagcctattactaccacaagacgaaagtctcgagacaattaataacacctttaatttgcaaattaatcatccatgcatgtgtctcttttgacgttggaaaggtagagaattctatatgaccacggtaacaataaattataaatgttctttttgtgaatactgcagagaatcccactcgaatactgaatgcacctttcagtttgctccatgttaaccgatttttttatgagaaaatctaaaaaataccattaacaaacacccaaatccaataaatatcatcgacgagtgcaagttctataaaatgtcatcgtacaagcgattttgttccataaacattatcgttgttagggttctattgatcatgtgtcgttaaatgcactgttcatcttatatcacttaacggaagactagtaacgaattgaaaccttgacattggtggtatttctgaaacaaaattgtttgtacaatggcatttcatagaacctgtacttgtcgatgatatttcttgaaattaagtgattatcaatggtatttcttgaatttttgtttcttcttttttattatcattacttttgcatagttgcattaattcaagcaggaaattgggatattgatttatctttgcctggaaaattgacatattagttgaaagaagcacatttttaattatttgcgaagtattgcataggatgttaagggtggtcagctatgcaggtagatacatttaagttgtttcaaagataaggtaggtacattcaactctgaaaaatcctccataccaaaaatagggccaaaatataggttttataaaattaattaaagagaacggtatttttgttcagctattataattctacaaaggggtagaaagcaataatggaatagcgtgacagattacggatgatgtcaaattaagctcataatgagcagattacccaactatgaacaaaatattttaaaagatgctgatactcaaattttcataccttgaatattacaacacgccaatatattttgtcatgaccggaaggggtagtatgctagtttcttataataaagtgtggctagtaaattaaagctgttcaattagttaacttaattaatacaaatagcattcatttacagatgcatgtgcaaattattttttgttatctctggtagcgggcttcgtcattatatttttctaagtatcatcatctagctaattaagtaggtatacacacataacgtgttaaactatgttgctataaaaaaagtttaagttatataatatcgctcgtcaatctgagcgcgccttcttgctgattaatttcttcaattattcgatctctaataatgttcattattgtacctgtcacagcgacagtcagacttgcatatatagatatgttggattagatgcaccaaacttgtgttgttgcctttgactgaattaattgtagctatcctatatttgttatgctactcgtcagatttatctaaactgttctcaaacaatgtccttatcgttagcatttgactttgaaagatttgtttttttgatactgatatttcctatctaatcacatttttctaagataatgtctaatcacataagactagtgcatgaagtcgtgcattcacgtgactatcactatatttcgattagtgacgtaatatctatttctgatattatgtcactaaaatatttattgtgaaaaatatataaaatatatgtttgtttcaagaataaatggctttatcatttctctcaaccatgcaaacatttattttttttctatatttcttatgtgtgttttctttgctctatatctctctcccacatatcaaggagacaccggaaagctctagaacaccatcttttatccaatggctaagatttattctacctgttttgtttgcttattgatttaacggctattatccattagatgatgtggcacattcttgttctgttttgggattgtcttttcaagagttaaaatggcgtaatatctaatttcactaaaaatattattgtgaaaaatatataaaatatatgtttgtttcaagaagaaatggctttatcatttctctcaaccatgcaaacatttatttttttttctttagttcttatgtgtgtcttatttgctctatatctctctcccacatatcaaggagacaacggaaagctctagaacatcatcttttatccaatgactaagatttattttacctgttttgtttgtttattgatttaacggctattattcattagatgatgtggcacattcttgttctgttttgggattgtcttttcaagagttaaaataagactttgaaagatttatttatgtgacactgatattgcctatataatcacaatttaacataatgcccaaccaaataagataatcacatatttttacataatgtctgatcacataagctaccttcaagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaagattaattctgcaagaaaatgcttgcaggttcttgaggaagtgaggaggctgatggagttgtacaaggacgaggtgacgagcatcaccgtcgtcgggcacagcctgggcgcgtcgctggcgaccctgaacgccgtcgacatcgtggccaacggcgccaactgcccgccggcgagctcgtcgtcgtcgcagccgccgtgcccggtgacggcgatcgtgttcgcgagcccgcgcgtgggcgacggcttcttcaaggcagcgttcgcgtcgttccccgacctgagggcgctccacgtcaagaacgccggcgacgtggtgcccatgtacccgccgctgggctacgtggacgtggccgtgaagctgcgcatcagcaccagccggtcgccgtacctgcggtcgccggggaccatcgagacgctgcacaacctcgagtgctacctccacggcgtcgccggcgagcagggcagcgccggcgggttcaagctggaggtcgaccgcgacgtcgcgctggcgaacaagggcgtcgacgcgctcaaggacaagtaccccgtgccgccccggtggtgggtctccaagaacaggtgcatggtcaaggacgccgatgggcactgggcgctccacgatttcgagcaaatttaagctctcgatttcgaaaaatttgcaaaatggattacgtatagaagtgctcgttaatgggcttgacacgtcgaataaatgggatttccccctcatatcacataattcatttgtaaataaaactctgtccagtcaaatgcatgtgttgatttggacattgttacagatacaaaggtattgatttggacacgttgagatgtccagtaattatttcttgatgcatatgcgagttcatgctcatgcacattgatacactccatccaatcatttactctgcactatcctcatcttcctcgcggtccatcagagtccagcggccatcggcgcctctcaccatgcccctgttcgacgggatccaccacccggccggcacggcgtgctcgtcgcgcagcgcgccgtaggacttgttcgccagcgccacgtcgcgctccacggcgagcttgaaccgcccggcctcgccgccgcgcgcgccggccacgccgtgcaggtagcactcgaggttgtgccacaccagctcgttcccgggcctcctcaggtacggcgactcgcccgtgtcgatcgccagctctgtgcccacgccgtggtacggcggcgccggcgggtacctggggacgacgtcgcgcgcgttgcggacgcggaggaggcggaggccgaggccacgcgcgccgtcgaagcggcgcttgaagccgtgcccgccgacgcgcgggctggcgaacacgaacgcggtgaccgggcagcccgccgccgctgccgcggcgcggggtgccctgttgtacccgttctcgacgatgtcgaacgcgttcagcgtcgcgagtgcggcgccgaggctgtgtcccgtcaccgtgatgctcagttcctcgtcctggtacatgctcaccagcttcgccacctcgctcaacacctgcatggcaacatccatgtcgatcagtgacaatgtggtaggtgaccttgccgtgctactccggccattactacctgatctcgagcactgtccttgttgtggctggactcagagtccctggaggtgtacatggacagccaccctcgatgcaccatggcgtcggaagctttgtcccggaggaggcccttgggtggcaccatgacgaagtccatgtccttgatccactccagcgactgcaccgtgccgcgccacgcgacgacgatgtcgcggcgcccgagcgcagccttcccttcgtcggtggccaccgcgacgtacccgatccagttgctctccctgcacctgcgcgcgcgcgacgcggaccggaggatgagcggctccggcacggcgacgcacgacgtcgcgtacacgaacctggcgacgcggtacgccgcggagtggcccggcagctgcgcccgctcgaagaagcggcgcgcggcgaacctcgagaggcccgcgtgcggcgagagcttctcgtggttgaaggcgtcgtacgtcgcctgcgccatctcgccgtagcggatgacggtgcggcggaggtcgaggtcgaacgggtccaggaggccgtcccagtcgctctcaccatggagctccctccacctccgcgccgtgccgtcaccaagccattgctgcgacgacatgaccgatcgactagctaggtcacagccacacaattgacactggcacactgcaacctagcaaccatttatacagcagcggcaatggttgacatggtgccaatctttctcgagcgttcttgcgctcgtgggaataatgacgaacactcacagtgcatgccaatggcatgagcatgacatgtcgatgatgtagatgcatgatgacatgagcagatatgcttcgtgtgtaactgcatgccctaactgggaaagaagatcaaatggtagaagagatagcaagaagcacgccacagtaacgcgagggtggagtggaaagccatcgaaacggcatgaacgtttgacgtgttcgagctcagaaattcagttacggacatcatcgaacagaatccttgcttcgaggctcgcagagttgcagtgcagattcgcgtcggcggcgagagattcgcgccaatggaggagatgggtctcagtcggcaaagaaacggcacgtcaggaagtgggcccattaatgtgggccttactggtgggccataaatttagatccaaagtgttgtgggcctaattagcttggcggggaatttcgtgaaccataaacgggcctaggcctgaaaattcatttgggctttattggatcgcaactaccattccaaaatagggactctaatcggccatctacaaagccatctgctcaacatgaatttctgaatccaaactgatccatccaaaaacatttcagaactcttgaaagctgcagcaaactttgattagggccagctaaaataaccatgacatatgcagcattcatcctgtaagcacgcactgttgcaattcatgagcgatttggggttgcttaaagtgacgaacacgccaggattaactagttccaccaacctggggtccgatcaatcgaatctctcatcctcaactcgagcatgaagacaaacgctcaagatatcctcccatggcgatcgatagtgctcgatccacctagctatctagcaaatcctttgcgtcgatgcgaatacttcccttggcgactaatttggtggcgttcataccaagcgttccctaccccaaaacgtgagtgatcaaatcaattgcgttagccactgagcttagctctcgactttgcttcttctatcgatggcctttcttactgttcatccttgccgacacgttggtcacacgagaagcatctttctctttgatgatctgaaacttttctcgtgatctgtgactccctgcagatagacaggcatgtcatcagcgattgagatgctgtgaatccttggacacggtacgaattgtttgttcacacaggtttcttgagttcctgtttcaatatcactgtcactgagcttggctgtcatcaagagatcgacaagttttcatgtgtgagctgcagcctgcagaagtgcaagcattgcactgcagaaggctttgcattcgtgctcgtcttcacttgtttgtgtccgaggcgagagagatagcagcagcaggtgcgtgtgatgtggagtcagctttttttccgcaggagcatcaaaagaatacgacatatggtgaacgccatcattttttgtccaaaaacaccaggattttgcatcgatcgtgtgggggcaggatgtgctgctgctcatttggtcagaatgccggaggacaaatgcaggcaggacagatacagttgcccttgatttgggagttctaatcatctcattaactaccattgttaagatcactgacggcgtatttattatactagtacctgcattttttaatggaaccatatgcgagtgtcattaagaagttggagaatggatagcactagcagtagcagcagagcaagtcagggtttgtggacctgatgatagcatcttgctccagtggacacgattattgagatgtacatatgtacaactgagaatatgattagcgcacaagatcggcgatgcaaatgaaatgatgttttagcgaaattcgtttggcgttcagctgctgcaaagtgcaaactgcttttccatctgaaccatcaaaaaaaaattcagatattcagatagccaccgttgctattcaatctgctcacaacgttctaacaatgtttcaatatacaatcgacaataatcgaaaggatcacgtgaaatcggcaccgagagagcgtgtcgaccgaccgctcaaaatctcaaaatcccaaacacaaactagacggtgaatgaacgggaggagccaacggttttctccctcgcattcatggaagtcccatttattactcctacgctgtatcgacgctgaaaatgcttactactgctctactcccggtccctcggttaaaaaaaaaaaacttaacttgtacaccctctatttagatctgttccgtatttttacgacagagggagttctagatttttaaaacaaaaatctgtataaaccgtcagacatttactagtgcttggagcagtaacccaagctaagttgttcttcaaagctgacactggtgtagcaaaagccatggcacccttgtctcaaaaaaaaaagccatggcacctgggtgcagagctccttggcccacaggcactgacatgtgggtccccatggggtgaaaggctaccttgtcctctgctggttgtcttgtactacagtactattctggtgctacgagcaatatacgggcatgtaaggcagtaccaatgtactacgactactccgattagtacatgaaaatggcaaaaggtaattaagcatgacactctcgcttggatttgatcagatatggagtaatccctccgtcccacaatatatggaattatgagtttttggttataacgtttgaccactcgtcttattcaaattattttttaaaatataaaaaataaaaagttatgtttaaagtactgtaaataataaagtaagtcataaataaaataaataataatttcaatttttttttgaataaaataagtgatcaaacattgcaaacaaaaactcaaaatcccttatattatgggacggagggagtagtagacactgtgcatgcagcgtgcagccatgtgtgtgcatcgtttcgcatggcccagaaattgcaacggcaatgcggggttggatcgaaacagcatcgtttggtcaaattccaggtgaattatggcatcaggagcatctggattctggagtgtttgactgttgatgatgcatgtagcatgagtaataaccccggccgtaatgacgaggctccggcgtcttcttgtttaatggacaggggcaaggagatgcagacaaagcttacatacggatcagcggcaaacacggatcaaacgtggttggaagaatccaatccggaccgtccatttcaaatctgatgcgtgggagaggctctatccttttttttcaccctgaatggtggcagtggcaccaaagcagtagtgccacgccctaatctgtttagatcagtgataaaattaatcttggctgcgctgctagatgaacagagcaaagcagcagcaaagcaaaaaaggtcaagaggggggggcttccagattcggatcgtgcaaagaagcagatgcagttttaatccatctcatctcctccaacgttcagattccacctcatatgagctcgagctgagctgacgaggagtacacctacagtatccaaccttcactgctcggaccaaacccaagaccgttcctcggaaaccgcgcccaactccccacctctctttaaacccaaaacgcctacccatgtccatgtccgccgcgcgatcctagtggtgttcttcagaggcaatggtggccgggcgtgtcaaggcggccatggggttccagcgtagccctgcgacgcccaagacgtcgtcctcgcgcaaggcgccgcctccgccgccgccgctggtgcaggcggcggcgcaccatgcggcggcggggcagccggagacgccgcggcggaggtcgtccggctcgcccgcgtcggcctcggcgtcggcgtcggggtccaagacgggcgtcttcgcgcggtcgttcggggcgtacttcccgcgttcgtcggcgcaggtgcagccggcgcgcggcgcggcgccggaggtcggggagctggtgcggctcgtcgaggagctgcaggagagggagtcgcgcctccggaccgagctgctggagcacaagatactcaaggagaccgtcgccatcgtgccgttcctcgagaacgagctcgccgccaagagcagcgagctcgggcggtgcagggacgcgctgacccgtctcgagtccgagaacgcccgcctgcgcgccgcgctcgacgccgccgcggcgagctccagggacaacgagcagaggattctcgagatggagaggcagatgaccgagctgaggaagaggcggcagagggatgtcgcgaccggtcccgacgattgctcgtcgtcggcgtcgtcggacaactccgagagctccaacgcggcgaccaactcggccaagtcggctaaggtcgcaggatgttcgtccgttcgtcctcctccccctcctcccccgccgccgctgccgccgccaatgccggcaacattcaagtccaagtcctatttctccggctcgtcccgcgcttcgccggcgaactcttcgtccagttcatcatcctcgtccgccccatcgacgccgtcctgctcttcagacaccgcagcatcaagaagccgcctacctgagctctcgaagctccctccaatacccccgccaccgccgccgccgccgccaccg

SEQ ID NO: 59072 - DNA, 13231 bp, Oryza sativa
  unsure (1)..(13231): unsure at all n locations
cgcatagattccggctctcccgacgctctggtgtacttcgaaatagtcgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttagccattcttagttcaactagtacacaatgggggaattacgttaatgcatagactccagatgttggattagtgccactgctgtggtgttggttaattaaaatatattaaatggtgggctgtgggtgcatggttttgatggtagcgcccatagcaattaaggaccggttcgcgggaaaccctggaagaattcctcgtacttaccacaagccagcataggcaacggctgggcttgtagtgtagcttccctctagctgacgcatccaggcaagggtgggcgtgatggagttcggatgggccctgcgacggcctatgccgctttcggattcacttaggcacgagaagggactgcccgctgccttgcgaggactgggggtgaaacctgaggtgtggtgtgcttgattagatggggttatgcgaagggtcctatcacggcctccttccggtatgtcgtggtggcatgtcgacgcacgggaacgtgtcgtggggctgtgtcttgtgggtacagttgcacacctctgatcagagtaaaactattcgaatagccgtgcccgcggttatgggcggtcaaccagattcaccgtgattagtctcaccctagattagtttaatggaactgattagttcaggtggtggtttgggcttgtctcaacgtggtgtagcgttgagcagtgattggtttaatattggctaattattacaaatgttttactgctttcaactactgtttataaatgctagctttatacaaatgaactcttttagccctcctttggttataccttgcatcataccctctgttccggtatgacttgctgagtacagtgggtagttcttgctctatctcccaacccttagagttcgattatgcgtccgatggtggtttctccgaggagtaggcttcgtccgtgccgtcgaggatgcctgtggagtggtgttcccgctgctatccaagtcaaggcttaggtcagccgatggtattatgtggctagcaggaagttgtatatgtttctcccgaattagcaagtcaaaaattttatcagcttttgtatatgtttctctgaacctctggatgtaatcttgcgcggtttcatcatgcctctgcctaactgctgccagatcggagagcttcatctcatgggtcccactgtagaagtagctatgtaattgcttctccaaatcgacccaaccttgaacaaaattgtaaggcaatgaagaaaaccatgtgaatgctgatccggacaaagacaaaggaaacaactgaacccttaaagcgtcaaccgccgatgcctctccacactgagccaagaatcgactgacatgttcatatgtcgaaacattgttctgtcttgagaactttgagaaatcgggaactttgtatcggtttggcagtggaaccctctcaaaccgctcagggtatgggtgccgatacaaatttccggtattctttggcttaagtctaaactgttccctcatgacatctgcaatcaagtcggcccatggcctctgttgaggtactccttgcacctgttgttgtatcggctcgaactgattgagttgaggaacatattggggctgaggtaatcctccttgttggtactggatgcgaggcgaaggaggttggtattggtaattcaagttaccctcttgataattctagaaattcggctgtatattatgcatcaaatgcttaggaacaacttgggctgcaaccgattgatctggttgtacattatgtaccaagtgctcaggaataacttgagccacattctgctgtctttgccgattatcaggtgttctcaacccagttggtatcagctgcaccatctgctgctgaatcggctgaaccgtttgttgttgaatcggcgaaaccgtctactgttgaatcggctgaactgtctgctgttgagtcggcgtcgacaacactggtccggcagttggctgagttggtaggaacattgaggcaatctagtcttgggacagccgactaatattctgaccagcatgttgcggttgctctctagaaaagagacgaggattaattgtctgcctttgcaccgatgatggcgcagctggtgccggagtcgaagctgctgccgtcgactgaactggtggtgcattggaagtactctgttggttacctatcaccaagttcctgtaatttgggaagacaccacttggcaagtagactggccctgtgttctgatgttcagctatcgtgccaaccatcacagatttgaacatatttgttagtgtattgacgatctctccagattggttgatcaaggcatgttgcaccgcataatcaacttggtcatggaaattggtgcacctaggaggttcttcttgcacttcagcaccatcttcgccaagatcttcaaccacaccatcctgaagcccgtcacctttgtcacccaaggcatctacaacacatttaccaccttgagatgagcttgagccaacttcatcagcagcaaccactttcagcttgtatttctgaacaattatcccttggcgggtttccttgaatgagttcatgaacttgtcctttacgctactcatcatctgttcaagctcatgcctctgttcggacgtcagtttgtctagtgtgattggaataatgtttgtctcattgacctcagactcaaccccagttgatggtagattagttcctggaggtttcggaagcttggttttcggaggaattggcggcttgcttgccgacgacggagattgcttttctgttgacatcgttgtcacttatcggtcccactcggcgtgccaaaagcatgttgagtcgaaaaaacacacactggctgggaagatctgcttaacttcagtgcagatccaaaatcttgcttttaggttcgtgagcgtgccagttgatttgatcctgtaatcaacaagaaagaaagacaaaagaaaccgtggttaaatccataaacgatagccgatcggccagtcgccgatgacatatcatttatcttcgagccgatgtcatatgtgaatcaatcggcagttataaataagcaagataagactaaatctactcaatcggctgtagatattaacactatataaaatccttctgtcgatgtatatttaaaccaagtgattgggatagatcggttgccatgccaagacagtataaatcacttagatcgaagtatacattaacataaatattataaatgcttatagcatagccgatcagatagatctagcatgtaccggctaatactctgataccactctatattaagatattaaaacagatagaatatatcagacagaagcctaatatactttattgcgataagatcttaatataaagggcagatttagcatatcaattaagcatataggataaaaagctaaatcaggtaagatcggctgataacccgatactatctctttcgatgatcataaaacaagccaaatatcataattatagatattacttaatagatcgaacctaaccgatgcagcattaagcataaagacaagtatgaaatctaggcaagatgatgaaaacctacaagagatggtagatacacgatacaatctaaattaataacaaaacataactctaccgattgcttcctaacaataaaaaccagccgataacaagttatatagcgcaactaacatagattgcaacatgcatatgataactcgatgaattacataaacatgattaaagtgtcataaagatggaagcattaaccccgagaacgcaagccgccatgacaagttttacctctagttgaagatcgaaaccgatgcagctcaacctgaaagcaagaactcgtcgaaataaacgaaagtaaaaagggtggcgatgcgcggagattgtattgaacgattgttgtttgattacatgggttcaggttctatttatacccgagattacaaaatatgtccttgctggacatgacacttatctctaacaaactctaagataccataagtctttgcggcagacttttgcccaaatatatctctaaggaaattacatgaaatatcctaattaatagatacaattgccttatccgagagctttatctccatcgtggcaatcctcatgaagcactttgaacgattctagaaacaaccttgaaaccatcttcatcggaatcggctgcatcacctctatcggttgtatcggctatcctctgtccgatccatctcagctgatgcagactccagccgatgccttcgcagccgatgcatactatgttcttcgaatcgatctctttttcgaatccgcctcgatcccaatgtcaaacctggttcacaatttaccaaatttggtcgtcaacaaatggtgtgggtttaatgttcatgcaaatgattgctctatatcgatcgcaagggtgtagagtagtatttaataatgtaagtgcggtgcttagattatcagatttcactatttgggcttatatgccacgggtcagtagaggtgggccactgatggtgacaactcaatacgggtattcctccacattcgtatataatcctaagaaattttcgtggtatgggtactcctccgtattcatttccgatcagatatccatgacttattgtcgtaaggaactcgataatcagaggtggtctctcgaaacaccaggagggcatagttagggggtattggctacatgattatatactagtaagtgtctggtggcatagttagggggtattggctacatgattgtatactagtaagtgtaaattactgatatctatatactagaagtatatgaatgattattttcttattctttctccacttagcttatattatattttagcagagtaatccttagttctttcttctgtgtcaaccttatcgtacccagaattgattaacccacgcttagactttggtttatacaagtaatatatgaattattagaatagtactctcttatcaaatcttcccttggaattaaataaatacgataccttagattactccaaggtgaaatgctacaatagaatatccgtgtgcttgcggatcatatctgtaaccataaatataccaagaatattttagtgtcagcactgggaattatatttctagtaatatcgttaagaaatatcaacaattatactagttcagaccactcgcaaggtagtatacctaatctagtttatatgggattatagaagaaaccacggagtacaacagagaacaacaaaacttcgagattactgacgagatccttgtcgtgagaacttcgacgagatctattgacgaattggcttaaagtcctctggatttattttgtggtggtgggtgtcttgcactaagattcagtgccctgtacctctctggggtgtctatttataccacatatcatcttggtctccaagtagaacttgaagacaacagaccccacacgatatgacaacatccttatcccctccgagtatgactctgatatctcctattcgtagagattatcccctccgagtatgactctgatatctccgattatttccgtaagaacttatcaatttccttaactcaataggatcatttccatatatttgaggatatactatatccgtatatctcttgactcctaggatagaaggtatgccttattataccatatccgtatatctcttgactcctaggatagaagatatgccttatccgaaccctgacaattatatttctactattgtcatataaaacatctgcagcaatgcatgggatcccatgtagttaattattccatctgttctttaatagatgatgccgttgatttttagacacatgattaaccattcattttattgaaaagttttgtgcaaatgtgtaagatatcaatcatgcttacactactaaaaggacacatatacgtcggcattataggtgctggaatagctaaaaccagcgaaaactggcacctatagtgtttttcccacctttgcaggctgaaatacaaaaaaaaaaggtacgactataagtgccggttctagagaaaaacggacacctatactttaggttcctgttttataagaaaattgacacatttaatatgttataggcgtcggttaataaaaaaacgacacctataatatattatattataggtgaaaactgacacacggaaaaaccgagtcaagcgaggatacttttttagctcacaaaagacgccgagagggggccttatcgacttgcccccctcctctcgcccgcctctcctcgacggtgccctccttaccaccccatggcggcggcgccctcccctcaccttcccacgacgacggcgtcgagcacagctagatctggccgagatgtggctcaagtgcggcaaccggatctttcttggatttttttttgttgatgtggataatgattttttttggaagttgattgtgcgattgtgttcgagttgattgattcaggggtgattgggagctacatcgaacggctttttttatttgtcttggggcctcaaagatgccggttttagaaccattacctttgatttctctcattagtaccacctactatgtgccggtttcccaatcggcacctgtgcgggggttttcaaccggcacctatttgtgtttatgcagtagtgttaaagtatttttagtgataaaacaattcgcattaaaataaataataattaccaactttttgagtaagacgaatttaacgtccaaaagtcaatgaccaaggtactctctctgtcccatttgaagtgcaacatttgatcatccatcttatttgaaaaatttatgaaaaaatttaaaatgataagtcatacactcatacataaaatacttttcatgttttaccatctaataacaataaaataatattaataaaataatttcaaataaaacagatagacaaacattgaccatgaaaacatatagggaaaatttcgtttctacccctactctgatctctaatattgattttacccctactttttagagttttcgtttttaccctcacttttttgaactgaacgcttgttttgcccctactttggatggtgaagttaacggtgttaagtaattgataaaatgacatttataccctctcatgtatgctcattaatattgtttttgtccccattttatgcatgtagctttagaactttatttttttgagtatatttcaaattacatgaagcacattgactaatatttaaagggaacagataattacattttacaaaatgttgtcaaatttttgtttaagttctatcaaaatgctgaaattttgtcaaaattccatcaaattcagaatttttccaaattgttatattagtcaatgtgcgtcatctaatttaaaatatactctcaaaaataaagttccaaagctacatgtataaaatgggggaaaaaacacaattaatgaacatgcatgagagggtataaacattattttatcaattacttaacaccgttaacttcaccatccaaaataggggcaaaacaaacattcagttaaaaaaagcgagggtaaaaacgaaaaccctaaaaagtaggggtaaaattaatattagacatcaaagtaggggtagaaacgaaattgccccaaacatataagtgctgttaaattggaacggagggatgcgactgatggagtagtatactgtgacgacctgggttgtgctatttttttttagtatagtttttccctttgacattgagatggcataaccgtaacagtcgcagttttcctattgtacaatattaataatgcagccatgcatgcgggcaccaccaacgacgatttccgtcggcgaaatttgcccttacgacctccgacgacgactttgccgaggccttccacattgcagccgtacgtgccgacggcccgacgccatgtatgtagctttccgtttcctaactctgatcgcaacatatggccccgttcggcagtcctactaagcttaggcacgcgaaacgaggaaaccattgatgtttgattaattattttaaactcatgaaatggatatatttaatattttaactcaaattctatataaaatatttttcacagaacgtaccgattattagtttgaaaagtgtgttaataaaaactaggacacaatttgtatcttaatgaaaactggaacatactaattattttcacttcgtgcatgtgtggtagctagctgcagtaaataattgactatactcgctcctctgttgcatattataagttattttttattttttttcatatcaaacattcttaaaattgattaagcctgtgaagaaaatatggcaatatttttaacataaaaacaaaatatcagaatatattcaatgctattttatttaatgaaactaatttgttgttgtagatttcgctaagtttttctataagcttagtcaaatctaaagaattttaacttaaaaaatatcaaaacggcttatgatataaaactgagggagtaatatattttgcaaacccctcattgagtatgatctgataatggattattacatgtggcgattaacaagtcacttgataagaagtgtaaattgtctttaaatgaggaaagcacagggcatgttctttttacttgtcctttggctcattttgcttggaatgtaattgccatggtgttgaatttacatactgtctctctatctttctgggatggtatgagagctatcaaaacaaaaatgaaatctcaagtgggtatggtactgtttgctgggatgttgtggggtttatggattacaaggaatgagtgggtgtttgaaaacaaactaatcaaaactcctttgcaagttgtctgtacatgtctctgtccctgatgcaaagatggaggctgctactaaaataaaaaactgcgctgacttgaatgatttccatgagaaagtaatgctcattctggacggtttgcgggtggttgacaatctaccgaagacttggggtagcttgggaagagtgtgtcgttttctgttccagttgcgtatatacatgattacgggtggaaaaaagcttgggctcgtgagctcggctcaggcttggctcaggctcacatagctcggctcggctcgaaagccaaacgagccaagcccaagcctcctttttagctcgtttccgaaacgagccaagcccgagccggctcacgagccgctcgtgagctcgcttggctcagtacaatagtgtcatatgcaaaagttttacaccttttctaactatttatttgttgaaaatgataattttgattgtcatattatctatttatgtgttgtgatgacatattaaagaaaaatatcactttattacacattctatgtggtaaaatgttgcttcatttctcttagacctgccaagctagctcgagcccataaacgagccgagccgagctgcacttttagctcgttgtttgtagcgagccaagccaagacgagctttccttgtaccaagctttcacgagccgagccgagccggctctgctcggctcgtttccacccctatacaggatgtggttagtgagggaggttacgttttaggacttttttatggtctgcacctttcatggaaagctggggaccccagtgtcgcgaagccttttgttaccctgtttattgctgtctacttttgtaagattctgtaagaacctattaattttcttctgggctttttacaaagccgggtagtaatatattagcttaattagatctgtgccattaaaattttgctggtttcaaaatataccattacaatttacgcatttgtaacgatgccactgctacttgtttgtaatctcagttgtgcctctaagatacgtattttgcatgtattggacgaaaataccctcatcttctacctctctcttctcttatcttctacctctctcttcacgttgcttcactactgaagaaaccatctttggtcggttgcccaaaatccaaaataatcccggtttaaataggaaccgggactaaaaaatatctttagtcccggttaaaagacctgacgtcactttttgatctttagtcccggttgggtaggaaaatagatacaggcagcaaaaaaacaataaataaataaaacagttgggacgtgaccctatatatctgtagtcccggttggtaatactaatagggactaaagatggatttttagttccggttatttcacccaggactaaagattcctatctttagtcctggattcctattctcggttacaaaaccaggagtatagggggttaggaactgggggtaaagaccatttctccactagtgcttcttgctctgccaccacgctgctcacgctccgccgctgctgctgcttgccgccgtgctgctaagcaggaagagaggaggaagaagaaaggggaagaaagaagaagagggaaaaggggtagtttggtccaattttttctggaaatgcatccgaggggtaagtagtggtatcttttaaatatgtgtaaaattataatgatatatttccaaatacatgaatacaagtggcatatttcgaaactgataaatttttattggcatgtatccaattaaccctaatgtatttgcctgatataaaaaaacaagtgacttgatatattttgcaaatctctcatttatatatatccatatacatatgcttcttcccttcaaagttaagttcctaatatttctcaatgtatatatgtactcattcctacctccagtctggtgaacgggtgcggactgcagtttgtatagtaagtacacgaagatcgagtcaagcgagcggcgtagaggtcatgtgtaccgtgtacttacttattgatgggaaaaggaattaattttgaaattataattttaaaaaaaataagaacgaactgcaattttaagattttggacacatttatttaccaatgcttcccattggagtatgggacctctgtattttggcctatactttcagtttgaccacttactaccttaggtacttttttgtactcctcaacctcgaacttatgttgcgttcttaagttcactttcccaacttcacctccctcgtttttcgagtgcacatatttgttttacttgttttgaaaaagcatgttacttgttttaaaaaaaattatattagatcaacgggtaggtgaagaattagttatattataaaacaaaatttgaataccaaatatatatagctataatatagtattttaagagggaaagagtagatcgtagcaggtggacaaacacagctctgctatctataaatacacgcgccacagacaattggagcttattgaagggaaactaattaaaggaagagctgcagctactcctactcatatatctaggaaataagttcccagttaatgttgtacaacttacatgcgttcatggcattctggctacttgcagacctgctgattcttctggcttctgccgcggagagcatctccggccggcctgccgccggttgccagacacggtgcggtgacgtcagcatcccctacccgttcggcatcggccccaactgctcccatgggaagggcttcgagatcgcctgcgatacccgaacccgaaacggcagcggcgagttggtgccgaccctcgccgccgccaatggcaccatccatgtgcagagcctgtttgtagcgccgatcccggaggtcaaggtgatgctgccggtggcgtaccagtgctacaactccagcgacagcgtcaccgagagtttcttcggcgcggtagacctcaacaacaacggcgtgtaccgcatctccgacaagcgcaacatgttcgtcgtcctcggctgcaacaccatggcctacacgaacaacggggacagtcatggcaaaggcccttacgccggcctctactacaccggctgcgtctcctattgcaacgactcgtcgagcgcgcaggacggcatgtcgccggcatcggctgctgccatgtcgacatctcgccgggcctcagtgacaacgtcgtcaccttcggcgagtggtcacgctatttccaggtggacttcaacccctgcaantaagcctttcttgttggcaaggacgaattccactttcagaggtcagattttccaaaggacctcaaccggacccagccggtgtgggtggactgggcgatccgcgacggcggcaactcctccgcattattgtcctgccctgcgccggaggttagggaaaaaatcccgcctgagtacgcctgtgtgagcgacaacagggaatgcgtcaactcccccaatggcccagaatactactgcaagtgcagcaaaggctacgaggccaccccctacctagtcggaggttgcaacggtaagaacacgtacacgagacaaacaatctactctttcctactcgctatctttcatattgttagacattttaattttttaggcctactaccgaatgctacacagttctaatgaaatagctcatatgtgctgacgatatcttaggtaccacaggtaccaaacacgatactcatagataccatactttgatatctgggtattataataacgtcagtatggtacctacaatactagatttgatatcgggtatcaaacatgatatctcataagtatcaaatcatgatacctacctaacatactgatttcaactatatcgtttgaacggtattgccattttatagtatttttgttaattttttcaaagtcaaacttttcttacgtttgacaaaattagtttaaaaaaaatagcaacatttataataccaaatcaaaatgtgttatattatgaaatagagggagtattgagtttgcactattgtgcatcccacgctagtcatgccatctatgtctgtttaccaatacaattttttttaaaaaaattcaaattaagttatttgtacacccgccattgaatcgaacagtatatatgcagatattgatgagtgcgctcgctcggatgaatatccctgccacggggactgcagaaacaccgtaggagattatcactgcaaatgtcgcacaggttaccagcc

SEQ ID NO: 59073 - DNA, 4505 bp, Oryza sativa
gccccccttggcctagtcagcacgacgacgacaccctactgccacagtggcatgggcgcgacaccatggtggctggcgccgccatgtttggggacggcgccagccactctggtgcctaaaaaggaccattttcgatttaagtttttccaagggtccatttgtaaaataagtttacaaaaaggaccaaaatgtaaaaatttcaagtgagcaagtactcggtctttctattcttcccaaccacagaaccagtgtacttttggaagacgattactcgaaggagtaggttcataactgctgtcaaggatgtccgtggagtggagtcgccacgctgcgagcatcaagttatatagtttagctcactttaattttccgctacatatataagacttttaataatacttgtaagacgtgaatctgtgtatcaactttgtcatttgtgtaccttggccggtcatggacagggtttttatgcacattccgctttgggaattctggttcgtgaatttctaggcgtgacagtaggaaggctgctatttctgaaattttgatgaacaatgtgattcgacttgaattctatattgtttcatcaaattctgtggctccaagttgacgctttgttttgatgcatgttcatactcatctgttggatcagcaatgaaccttacttattcttctcccaaacagttcgactgtaggggaatatatatttcactggtacttttggataactcaaatttactggtgcattacagtcaagtttgtcaagcagactgaaataagggaggaaaaggttatactccatctgtttcaaaatatagtaacgggatacttgattagacaccagctagtactaggctactatattttgatgcctaatcgtatgaatgtgtatatacaaatgcgaactaaaattcgaaatgattttttattttgtttgcacctaaaaatcaaaaactggagattcatttttattggcaactctaaaaaaaccagccgtgaaaatatttattcacgggtgactgactttgctcctgtttaaatgattgattttcacgggttattggttataggcaggtggaaaaacatccatatatataaattatggaccacctaaacaaacggttttttatgtaccgatgagtgtcaaagtctaagtttagaatttaaactatttagatgggtcaaaaaaaaattcctaggagcgtttgcagcagaagttccaccaaatagggccccagcgtagactcgtagttgggacggatggccaaaacctccaatattgctgcaagacaaacttggctcatccccttaacatagaactgtaccattatattatattggcaaatcctttacatgtccagggtataaacattggggtaactcgtatgaatagtccctcaagggttatcattcatgaaaacaaaattttattaatcagagaaaatgattatcttttgattcttagaatctactagcttggtagtggttattataagccgtgatatgtgcctgaagcaaccaggctgcgttcggatgaggggttcccagcccctctctcccgtattccacgtgcatgcttttgaaactgctaaacgatgcgttttttaaaaaaagtttctgtacgaaagttgcttaacaaaatcatattgatccatttttgaaaaaaaaattagctaatacttaattaatcacgtgctaatggaccgctccgtttttcgtgcggaggatttggtttcccaactcatggtatcgaacacagcctaattttagggaggacatatatacctatatattcatagtggtttaaaaaggcaaggctaaaaaaaatctatactagtctaaaaattactaagttttagaaataaaagttggttgtaacctaaaacaattcgtgcaggtggtgcttgcctgtcatagcagagtaggcaccattggtttctctgcttgagcgcttggtatacattcacacacacaacccaagcccccaggaaaaaacattcatgtacggtttgccattttaagtgaaattatttttttcacagaaaactgcacatgagaaaaaccttaaaaatttaccaaataaagttcatgacaacattcacttccaataattttggcacaagtttttgagcactgccaaaggtgtgcatcccatctggtgggaggcacatcgcgcggcaagacaggcttgtagagggggagaggtggagagagaatatgagatgatgggaggcacatcgcgcggcagacaggcttgtagagggggagatgtggagagagaatatgagatggggtatagaggagtgaagggagagtagaggaagaagatgaaaatgacacgtgggtctcatgtgaggattgggaggcttaaatggtgggcagtttgtaccgagggcaatttgggtatttcaaaaaaagaaatttgtgtaacacgaacggcgatggcatttttaggacaagttggttcgtacgatgatatttttagaaagttatgttcatcaatggcattttttttgaagtaagacatttgtcaacggttttattggataaatttcataaaaccctatattatatattttgcgttcaatgtagaaagccaccgaattatggattgtagcacataaaacccgttatttaaattctaaattaatttcagcatatcttaaaaacaatatttttcatagcagtgaatagtaaaaccaacaaacctcaaacaagaattcaacaattaaaattttatatagactccatattttaaaaagttagtaaatgcatgttcatgagaattctggaattggctgggttgttcagtttaagaggggaagcaacttaacatggaaattcatgaaatatctacggcaggctcctaacacagcgtagaatcttatgtattttcctagacttctctctcttgtcctatagtttggagtttgtcaagttctactccatttatacagtacgcatcctaatttcatgaacattctaattcaacagagtgacatggattctaccagcaaacactaaacatatgcatacttatgaaatagtagaacaattttcacatttatttacattttttaaagacttctaatattttttcactaaggtggccaagatctcattcttctggcaattctgatatcaatttcaatgctctgtctgcacttactgttcatctacgagtaatggttcacctcccttagcgccatctaactaaacgagtactggttcacctcccttagctagccatcgaactaaactccacaacgaaccaagcatcaagttgatcctctacatgacttccctatctactcccatgccaatcatgcatcaagaattcaagcagacaataaaatttagattcttctgtaacaggtgaatgaaaatttagattttcgtggcacgcttttcaaactgttaaacttattcaaatccattttagttccgaatctatttccgaatccatttatatatcagttcgtacgtaaactatatatatgaaagttgttctaaagtatcatattaatccattttttaagtttgtaataattaaaacctaattagtcgcacgttattatcacctcgttttgcgtaaaacacttaatctttatcttcatattcatcttcatctttagaagattcaaacactgccaaaatataattcctattgcaatgacagacagattaactcagatgatccatatactgctcggcctatacattattcagaaaggtccagctacaggagtgaccacacttaaacagtgaaactatatatgagaatctgaactacagttgattaattgagactcttcagtcaattcaattctcacctgtcagatttttaactggataaataaaaatgactagtaattgggatgctataaaaaatgggcccaactggtagagctagtggcatgtacagcaacaatttattcaattttcacgcagtgacagattgcatttctgctgacataatggcatatacttcctccgtccctaaatatttgacgccgttgacatttttaaacatgtttgaccgttcgtcttatgaaaaaacttttgtgaaatatgtaaaactatatgtatacataaaagtatatttaaaaataaatcatatgataggaaaagaatcaataattacttaaattttttgaataagacgcactggtggagaaatgctttttagtcccggttcgtaaccccccttagttccggttttccaaccgggactacgaatccgggactaaagatcgctatctttagtcctggttcaaataaccgggactaaaaatcaatcccggttggtgttaccaaccgggactaaagtttttttctttttttttttctgcttttaatattgaatattgatttcacaccatcccctcccatatcgaaatcatcacatatcacagaacatctccaaatcctcaaatcctcaaacaaatcatctccaaatacatcacaaactcttaaaaaaaattacatcacagggttctaaaaaa

SEQ ID NO: 59074 - DNA, 15837 bp, Oryza sativa
cggagatcgaagacgatgcagccccgcgtcgggtgccaagttccgccggaacgtaaaacaaaagttgaagtaaaaaaggtgccgatgcgcggcattgtattgatcgtgaggacagattacatagaccccaagtgtacatatttatatccatgggtggatataagtccttgtcggacaagaaagaacctttcctaaagataaaaggaaaagataaagtccttataggacactaaacacactttcctaaagataaaaggaaactaacaaactattcctaattaatagataacttaccatgccgtattctctttaaactcggtctcttctggataagcttcctttagtagatcaatttccttaaccgaatatagcaagaatccgacaactgacgacttgacaactctcatcggctaatctcaagacttcgaagccgatgctgactctacgccgatgactactccgggcttaccaaatttcactgttaacaactacgtggcggagctggagcgcgcgttggaggtggtcgagacggagtccgcgagggcgcgtgtggagctggagatcgaccgtgcagggaggaaggtcgccggggaggagatggacgacgacgacactgacagcgcctccgccgccgtctcgcgccccgccgtgcccgtggtggcggaggcgacgaccgtgctgttgctcccggtggtgcacgaaggcgacggcgacgaggcgctcgcccacgcaccgaggcggaccaagacggacgtggacgtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccggcgccgctcacccagccgcgcccgcagccacctccgctcgctcagccgcgcccgccgccaccgctcgccccgccgatgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatatcctatcttactataaagttatcccccactaacttcttaagcttaacatgcaaagatgccacatcatcatccactaacaagatgccacatcatcatccactaattaacaagataccacatcatcattcactaacaatcatcacatttaaacatcatgcaaacatgctatatctttatagtttttataatttaagagcttttcaaatacaaacatgttaaattataatctaacataattatgtgaattcacatcatgtttcaatgtatatctttattatgttttatgatatcctatatacttatatagttcatcctcacttagttagtgcttaaatgattaatctatggttcaaattatctttctctttttttcctctaattaagtcatatcacatcaattgtttttagcctttagatgattaatctacggtacaaactatctccctacttttcttcttccataaagtcataccaccttactttttacgtttgaatcaccattctacatactatttaaatttaaattatcgtaaaccacattaatttacttaatctgatgttatctagttatcttacacgttattttttttattgttatcatactaaatttccgcagtaatgcgcagagtttcatctagttattgaaatattcatgaagtaacagaaaaaggaacacctgtaactgtcgatctattattaactcaataaaacaatataaaagccaccatattcactctcatgacctagaatttcccatattaataaaaaagaaaaaaatagagtccaagtgtatagattaaaaatatctgtaattcggaataataataaaaggataaaagaagtacatgtagaaatgcaattttgaaaagaaaacttaaattcgtatttaaaaattaaattaagacaagagtcaacgtagaaataccttttaggctgaaaaatatgaaattcggattaaaaatttaaaataaatattgaaataaaattatatgtataaatataattcaatctaaaagtcggaataaaaattaaaactacaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaagaaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttgaacctgcaaattcggcgcaaatttctaatcatgatgtaatataattagctgatctcagctcactcccaggtagcctttatcgatctacatgatgctatgcatgctggcgcctatataaaccatgcatggcctctgcttcttcttcactcatccacacatagtaaggaggaggggcaatagagtttgctaattgctaggattgattcaagcaatggcatcagtagtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaatttcaacatgtagcacgaacactactactcttcgccgccgtcgtctgcgccgccgtgatggcagttgccgctgctgcggacggcgaggtggcggcggtcgtcgtcggtcaggccaagtgcggcgagtgcaccaggaagaacatgatggcgcaggatgctttcaagggtatatatatatcatgatgatgatgatgatgatgatatgttcatcattgattaattgcgatcgatatatcaccgtccttgattaattgtttggtgatgttcaggtctccaggtggcgatcaagtgcaagaacagcgatggcgagtacgagagcaaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtaccgctgtcgtcaacaacggacaacggcggcgacaaggctaacaccttcgtcgtcgtcgctggcaagaggatgcactcctccacatcgccggcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaatataagttgtgagatgtgagaggagtgtgactgtgtgagatcgatcgatcgtgtaggatcgaatcacaagaactaagccaaccagagggggtgaatggttggtatacccaaaaaccgaaaacttttagcggaaataaaagttaccctcgaaatcgatggagatcggtctgaccgaagtagattagccggtctgaccgaagcgtagcccccggtctgaccggtgttgatctaccggtctaaccgccgtgatcgcctgccgcctactgtcgccgccgtcggtctgaccgccgtgctcccgccggtctgaccgccgcaatgccgctggtctgaccaccggtgagttgtcggttagaccgccgaaacccggtgaaacacaaatcgaagaactcttaaagtgaatgacgactttattaattctctctatgtttacaaagtgcaccaacaacactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcgtaccaaatttggactccttccaatttcgactccgcatcccatacgcacacaataactccatcgtatgccatatggaatctccatcaaccacgtgcatcaactctagccttagtatcccgcatgatctctgaccacaacggacgtcgtcttatccccaagccaactcccggtccatcaccgtaaatactctcccgagacatcgagtcacctacacatggaatagacaaagaaaccatattccgagaccaagctatctccaacttgactcattagcagtaaacaatagtattacatacgtataatatccatctagaagtcataatcatgaaataaactcggatatccaaataaacaacccgaaaccgaaaccgacacagtgtcggccggtcagaccgcgggctggccggtccgaccgcttgatcaccgctggtctgaccggcaacacctgcccggtctgaccggtccacataaaatgataacctgtagattcacctgtgaaatccaatcatctccaaaccacttcgtgaataaatttccaattacaaaaccaataatctctaatgctcaattgttcatcacagaataattatcaaaaacacctttgattttacagatcgatgtatgtgttggagacttggagtcagtgcataagcattggctttcaggtgataaataatttcagagtgcttatgtgtgtcgtgtctgtatttattcgcacatgtaatgcgacatgtgttctacataatgtaatttaaatatttataagattgttcatgttgacgtagaatcgcaatgccacaccttgagcacgttatgtgtaactcgcggcagcactcggagacgcgccatcatagggagtgggtagatgccgcccaacgaccacccgcgaaggaccccatcaggatgaacgtgcgtcggtttgttctaggctcagcaggccaactaggacgtcctctaataccgtagagacgagagatgacaagtaatcgaggatttgaggatttagaatttggataggtagcaagaaggagagagatgtagaatatagagggtttggataaataaattgattttgatgcatgattgattgcttgttgtttcaatcatccttggcccccttatatttataaaaggggtggacttgcttcctggggtttttccatatgcatttaggcatataaatcaactaagacttgaaaatttcggtctaaaacaagaaaacacgagaaatatctaaattggacttggactatgtgattaagatctaaccgcctggataccaatggtctaatctcagtgcattgtctgctttgaccggccacataatgacggttagaccagccttcgcgggaaagctctggcattttttaaatttggctcaaacttgctataactcgaccctactaccaaatttgattatcaacacatgccccccctgtctttttggcaaacttatgagccaaaaaaatactatgcatgagatcatctaagggcgatatccaccaataccgaccatgaattcctctaaggcttaaatgtttaatggtgatgtaagaaagctacgagaggcctctcttgttcagattgtattttgtttttctttggcctccactcttgcctcaccactttcttgtgtggattcttttgtgactgattcttttctctcaaccggctatgagatgagtgtggttgattatttaaaatgggtcaatgtggaaactggcaatgcccataatggataataatatggtatataaaaaggcatcatccacataccattaaaaatctataatacatttataccaagcgtaataccatggaaaaggagaagtaagttgccggtggtgcatactcgcttggtagatgaacttgatctccttggtcgcttgccatattttgatatctccagattgtcgtcttgcctcctaagtatttgtcgaggaatgatcctctctagcaggtggtcgtgagacccccccctttgtgagttcggccgggggaaatggcacgatgatcaagggcctacttccgcttgcggtctaatcgctagatcgctctcgtggctgtgtgggagatcaaggattatacaggttcgggccgttattgagtgtaataccctactcttgtgtatgggattatggtgaatttttacatgaggttttgagctctaagggaaacctagctgttcttcctccgagctcaagttctctgagagtcgtcccctttctcggtgggcgaggtcctccttttatagtccaaggggataccacatgcactgtttgcacctacccctccatcggagggggggcacatggccctaatcataccgctatcctttgcttcaactggaagcaacatggtcgcctggctccaggtggggcccagcgccgcccccgcctgacacgggggacatccctgtcattccctattattgtatgaagacttcggcggctcaccacgcgcgtggggcgcccctggaagcgtgccgatgggacagggcatacctgcccccactccgcctgacacagggcggaacgtgggggcactgcccccgtcccgtcgcctgtgaccggtcacaggccggtcaagctcgattgatatggtgttgacggtccttaaatcataatatcggaccgtcaatacctgcatataatgaaataaaacatggtatccaacttagtggtaggtattattactaatcatttccactagtattggtgaaatatgtgtatgcaagtaatttgaggagaaaacacatccgtcatgtgacaaaatgcacctccgcgcattcaggacgcgtttacacggattagaggcccaataagtcaataaaaaccatttagaattgggccaaaacatagcccaggttgttgggggcccaataagcaacctcccggctgaaggagaggccgggaggagagtttttgggtttggccgaacccaccagttcggacaaaccaatcctggcgcttcccatcatctgctttcacctggacggctcggatttctcccctaaggcagttgcagggtgttttggtcatttcccatacccctaaccgtcatttggagcctatataaggaggtcacattctcatttccaagacacacaattttgagctgaattataagaggctctattgtatcttttgtacattataataaggtagagagtgaggggaagctctggaggagtgcccggaagtttggcgctcatccgacttctatctcgacgagtgtagcttcctaggaggaattcggggggagtaccggagctgtcggtacactctgctctgggttcggagaacctcttctataaagtaagcattcgtgttcctttcttatattatttaattactttgtctaagtaagatagattttcatctttgcgggttctttatctagtattcatactaagtgctctagtactaggactctggataaagaaggaagttcatgtacaagtattagagtagtaattaataacttagacgtggtgtctaggttagagattacctttgtttgttgtgtatcccacggatttgtcagaggtaggcgacaagtggtaacagccctgaatcccgtcctaataattctccacgttcggatacatcatagagctatagccggaaccacgctggcagaccagcaggggtcggtgcccgaagcaacaaataggaaattaccttcaacttagcttagataattaaaacacatagaaagtcctctctagcttgcctagcctatctatagttgttgtcattggatcgtcttagccttaggtaaattacacacgttccctgagttcgatatctttttggggtcacccgaaggtgaagtgctacaacagtattccgtgcgcttgcggatttatctgtggacgtaagaaataccaacacatgggtcaatcgagcggcgccgcacatccctccacgccgcattaaatgctgcttggggcggttggtgcaccgcgcattgaaggcgcggagcagtgtctttcgccccgcccgctctccccgccacgaggtggtcaggcgagggcctcggggtagcacgccccgaaagcccgaggagtgcgacgtggcaccccgaggtccctctggccacctcagcgctacccgagggccgggggaaggcgagcccacgtagccacgcgactagatgggaaggatacttccctctactgtgcgtacccccgggcccatttcaccgacagtattgaagtcttcaatgtggtcttctccttgccatcgggaatctccttctcttgcaattcaacggtctgtataggaaaaggtagctcatccacctgcatctttgtaaaagtcaatcgtcattcgtcaattgccgattgaacttgtctatggaatacattgcaatcatttgtggcatgagaattggagttgtgacacttataatatgctcgccgctctattcttcaagtgaaggtatggcgtggccatgtgacaatttaattttcttcttttactagtaattattcaaaaatcctattgcatttggccacatcaaacgtgaactttatttcctcttgctgattcttacgactaaccagcttaagagcggagcaaacggatggtttagagttggagttcaaaacccatttgtgtatgtatacatcaactgtctctttgttcaaagattcttgttgatcaactatattaacatgggcacaatcagacttaactttttgcgagattttggcctctttaactcggctctcttgagttaaagccttttgaagtaattggcttacatctaagaaagtatgaccatctagcttttcttttaaatattcaagtaaaccagaataagccaaatctaccaagaccttatcagaaagtgttaaactataacatcagtttcttatatatataaatcttctaatgtattcaaaagtaggctcgttatacttttgtttaaccgaggttaagtacgacaagtttaattcggtctcaccactaattaaagaagtaatcatgatatttttgttctaactcagaccaatcatgaatacagttggtgcaagtgaaataaacccaaaaaattgcgcgcatcaccaaataaagacaatgggaaaaagcctaagtttcaaaatactactagcactagcttcttcgcattgaataataaactggtcgatatcctctaaagtagaccggccatgttctccagtgaacttacacaatgaggcaatcaaaacccttgaggatattgaacattatcgtagtggccagtatagagtttttgatatatacgccttttaaccctagtatctatgccgaaagcatttttgaaagcttcggcaatctcatcgctaagactcttgggttatgctcatgtgccattgactacaggatctgacaagactcttacttgttcatatcccatatgaactcctcaaattctacttaacaaaaaattgattgtccatataaatatatagcccctaggagagaagagcatcgaatcataagccatagccacaagtcacatcgaatatcaatcaggaggaagtgattaaattggcactataaacatgtagttttgtaataattttgttacttaatctatagctttgtgaccatatatttcaaatctttagttttgtgataaacttaacactatatgtacttagttttatgatataataccttaaatcaatagttttgcaatagtttgatcaaagtatttgtagttttttgtgaaatttactcatttacttacaaatagtatcaatcatgcaatttggttggaactgtcctatactacagaactattctcccttttcataaaacaggctagtagtactgtgcgctctaggagtaccagtcgattaaagcttaactttgcttgttaaacaccaccaatcggcggcaagagcatcaacagtcaccactgcatgcagtgtgaatgttcacagtgcctccatgaactgctagctgctactcttaatcgatcggtgtctgatcaaatcaaataaaatgcacggcgtgaatgattttaaacctgcaaaatcggcgcaaattgctaatcatgttgtactgtaatataattagctgacctcagatcactcccaactagtagcctttatcgatctatataaaccacatgcatatgcctgatttttcttcactcatcgacacacacagctctagcctcttgccacatagtccaaagagcaatagagttttctaggattgattcagcaatggcagctgtagcacgagcactactcttcgccgccatcgtctgcgccgccctcgtgatggctgtcaccgccgctgcggacggcgaggcggcggcgatcgtcgtcggccaggccaagtgcggcgagtgcaccaggaagaacatgaaggcgcaggatgctttcaagggtatatatatcatgatatatatgatgataatatgttcatcgataattaattgcgatcgatatatcaccgtcgttgattaattgtttggtgatgttcaggtctccaggtggcgatcaagtgcaagaacagcgacggcgagtacgagagcaaggccgtcggcgacctcgacggcgacggcgccttcagcgtgcccctcgccgccgacgacctccacggcgccgccggctgcttcgcgcagctgcacagcgcggcgagcagcgcgccgtgccccgggcaggagccgtccaagatcgtgccgctgccatcaacgacggacaacggcggcaataaggctaacaccttcgtcgccgtcgccggcaagaggatgcactactcgtcgtcggcggagtgcacctcggcgttcctgtgccccttcttcgactatttctacaacagaccccaaggccccaagccgacgccggcgaacggtggtggcgcggcaaacggtggcggagctgcggcgccggctcccagccctccggccggcatatcacagctgaatttttaattcatccattccatcaatatccacacttgcttttttgtttgatttcatggcttggttaatccttttggttcttgcatgattaatttccaggtcagcttgttggtgcagaataataaaagttgtgagatgtgagaggagagtgtgactgtgtgagatcgatcgatcgatgtgtgtgagaataaaattaagttcgtgcagaagtgcttgtgtagtacctccatttattggcatatctaatacactagtaataatatgtccgtgctaacgcaacggtgataattttgattgaaacgcaacggtgataattgataatgtaaaaggcaaaaggtaatatttaagattcacgaataaaataacgatagagagatttgtattgttctcatgaatgttattacactgttaataacttcccaaaattggccatgaatagagttctgcaatattttcatcactgtgagtgaaacttttcaaaacacaaacaatagctcatggtatctaactttctataccacatatacaaatattacctgcacgttctacaggtgctattttttcaaaacatgcatcgcctggaaacattcagcaacttctgctcctcactggtcaccttcctccttatagagcacctcaagaagccacataaacttctctatcgaacgcatatcaggagaagcaccatattgaagacagtgtattcgcctaccacgaggcacacgcttataaagatatattcatcacttagcattagtaatttaactcccaaaatatttggaaaaacatcccggtttctactaaggcaaaaatatgtagcaaagcaaatatataggcattaagcatttaatagcaaatgataataaattatttattttaactgaaagcgctaggcttttacatggctgcaattttgttcgtgtaaatgagttgaaaaaggtaaaatggacatgaatactatgttaaatctgcagataaacttttcggatcatggaaatgcatttgtcaaatttcatatgttcagatcaaatttcattataccctgcgaatacacaggacgcataaatcatcaatattgcacagcaccaagagctaggcaccacggaaagcagtccaaaaaaaccataggatgcatgcaacatttcaggaaaattaagaatgatatgatgtggttcaggagaaggagaaggagaataattctcactcatattcttgtaaactatttaattctgatatataagaaaaaatactgaaggaacataaagagaataaaatccagtatcaacaaacacttttgaaagtgcagtgtgacagtagaattcttctgtttgaccttttttcagtgaatagtttcagcatatttggttcaattttaaatgaacaacaatagtcaggaaacctattcatctagatcatagcattttataaacctgctgcgatctctctagaatctcccatccaagaaactctaagcaattaaacgttcctcttccctgccactcaccagcgattctcagcctagcttctcctgcggttgtagaagacaatccaacgcataatcacacacgaaaggaacaaacagcacctaagaattccagatatacagaacaggttgcatgtaataatgtcgagcacgcaacaaattctccacaaattggatcaagaaagagagcagggaaaataatggaaaggaccggacctacgcactcggcggggggagcagatccatctcccaccgcctgacgtcctccgccatcgagaggatccaaacttgcacggttggaggggctgcgtagcaagaccgaggacggcatttgggcacgagaaagacgatctgtcctaccaaaaaaggagtatttggttgagattagctttgttagaaatgaaaagacaaataagataagcaagatgatcttgattttagctgctagaattaaggccatgtaataacaaatagaagaatttcgaaaaattaaatgatttttccattcaatctaacagtgttttgactttgtgattccttcatatggaagggcagccaatttgtaacaaaggcagaaactgggactatcatatcgtaaaaaatttctaaactagtgcataatctcggaagtgaagcctaacctattttccttaacagctaaacacatttgaaacaaaggcagaagctgagacacctgaacagaacaatttgttaagctatttctaaatctagcaaatcaaatcaaaactttggagctgcattagtttgactacaaataagcgtgcagatcgatgcgtgagaccctggggtgcagtggcgatcgaacctgaaatctacttctctttttttttctgcaatgtcccctgtgccggtatgaagtatgaacatgtgtgccgacgttcacctatacagctccagcaatcatgtgccatcatttttattgatggaagagtagaaaaaaatctaataccatgggagattgatttattgcaaggagcagggtaatctggagatggcaaatcacaatagaaaataattcaacttaccagccgtgaccagatgaatttccagccactataggagcatctccaaacctccaattctgatattttg

SEQ ID NO: 59075 - DNA, 3130 bp, Oryza sativa
cgccggcgacggggacgcagaggttggtgggctttttgggtttgagcctttcaggtggagatggagaggccgtggataacagggatttggactggaagttacgttgcttgatgggccttataaattgggcctaaataaaacatgggtctatttgtgcagcgcgtttcaatttgggaaaaagtacaccgaaggtctctcaacttatcatcgagttacaaaatcgtccttaatcgcaaaactagatacaacgcatccctcaacttacagaaccagtgtaaactcagcgtagacctacgcgggtcccacatgtcagcctcttttttccctcccctctccacctttcttcctctctcctctctcatcccctctcttctgtgtatctaccagaacccgctcgcgtgccgcccaaggaggtggtggctggcggcgtcagcgccgtcaaggagtacatggccaggcagtggcgcgacgcccgcgccgaggaggcgcgccggggcagcgtcgtcgccaagagccccaaggtgtcgatgcccaagaggtggcttgtgcgcagcatgtcattgatgggtagatgggtgtccgacgtcacgaggtacaacaccgggtaggcggcgagagaggagctgtgcgcgagcctctgccggtgaaggagtggcacgcaagtggtggggagcagctgcgcgcgggggtgggtcgcacttcttctgcccatggcgaggggatagcgtggagagccgccgcccatggcaaggacgccatcaaggttgaagggcggcgcaaagatggaggagacggggaagagcaagatgtggcgcgcgtcctcctccttctcctcgaacccgtcgacatcatcgtcgtcgtccaccactgccccgctccgcgccgccagcttcgcgtgccaccgccttgcaggcctacctgctccacccaccaccgcctcgctccacgtcgtcggcttcgagcgctgccgctctgcccaccgtcgcccctcttcacctacctggtacgcccaccgtcggcttcgcgcgccgtcgtcctactccgcttggctgctccgctcaccgctactccgctccgccctacctgccgtcaccccattccacctgccttccccagcccaccaccgcctcgccggcttcgtgcgccactgctacgcctcgccatcgccccacttcgcccgccgccgccgccccgctccatcccgccggcttcgtgacgcggatagatacagagaagagaggggaggagagcgaagaggagcgaggaagaaacatggagaggggaggggaagaagaggctgacgtgtggggtcacgtgggtaccagctgagctgccacattaggcaaaaccagagtcaaaaccgccaagggacttagtttgtcctggttttgtaagttgggttatccgctgtatttggttttgcggttcaagaacgaatttgtaacttgatgacaagttgagagaccttcggtgtacgttttcctttaactttgttgctttactcttgcagaaccttttcttttattttctttttttccttttttgaaagaaagaacactacacagcctgtttaaatttgctgaagacgcttttgtttcgttgatgctaacttttgtggatttcacgccggaattgtaaaaagaagactactggtagcaaatactccctccgtttgatattataagttgtttggattttttttctagtcaaacttcaatagatttgactaaatttatagaaaaatttagcaatttctacaacactaaatttcattaaatgtaatattaaatatattttataatatgtttggacgaaaagtatttatgtattttttctataaaattatagagtttgacaagaaaaaaaaatccaacaacttataatatataacatataacggaggtaatagaagtgatggagcaaaacatatgaagagactttcgggaaggtataatgctgcagtctgcttgaagatctggattgagctccaagcaaatagcaatcccctcttttatccttcgcaaaaggaaaaaaataacctcctccttttctcttttcgagaatacacacgaggaccaataaagtatggatcgatcgatcacaaaaatttaaggaggtggaaagccctgaaacaaacactcgagtaagaaaatgctgaatatgtagtgcatgttggggaaactgttcggatggtgtccctcatttatttaaaaaatcatcgaaatagttatcagaaatattaaaaaaataacagcattcatatgttgaagtttaggccgggaattgttaaagaagactactatcaaagaggggcacggtgatggctacaagatgaagctaaggtagaacaaaacatatggaaagacttttagggcccatttgaaatggaggattagcaaaggaattttggaggattcattttcctaaggattttttcctatagagctctttgattcataggaagaggatagaaaaactttcataggattgcattcctatgatcaattccataggaaaataagcaagaggttagacctcttgcgaaactttcctttgttgagggtatcctgtgctataatcaaagggctcttctctcaatttcctatgttttcaattcctgtaggattggaaaaacatacaacttcaattcctacgttttttctattcctgttttttttctatcctgcgtttcaaaggggcccttagggaaggaattaatgctggataaagatctgggattgtgctcgaagcaattaacaatcacttctttttcaagaaaaacacatgaggaccactataatacgatacgggtcgatgacaaattgaggctggtaaataacccccattttaaatggaggtttaccgagacgccagtagtacggtctgagaaaacaagctatttatattatagacaggtgggagaacaaaatttccgaagatttcaggaattgtcatacttttttttgcacagaattatttgaaattttagcaaattttattttgactaaatttgaataaactttgaccaaattcaaaaaagttggaaaaaaacagaaaacttttggctgagatatttgcttgcctagggccggggggggggggggggttattttcgaaacaaaattgtaat

SEQ ID NO: 59076 - DNA, 3465 bp, Oryza sativa
tctgtttgtatcttattaaaaaatagaattattacttattttatttgtgacttgctttattatcaaaagtaatttaaacgtgacttataattttttatatttgcattaatttttttaataaaatgagtggtgaaacattacatgaaaaaagtcaaagcgaccattaatttagaacggaggtagtactaggctatgtccaacggggcgcgcgtgtgtgtgacaatgacatgtggggacagggagctggggccgttgcgtcagttggttggggtgaggtgggatgttggtggaaagtgtttttttttggggcttggaacagcaattattggggtgcacatggggcaaggtatccaattctgcctattgaagattagggaattttatttagggaataatgtagggggtatttctcttaagtaacaggtgttctttccatttccatctttctttcttttcttttcatagaaaatgacagattaatgactaatgaggagaacaatgggaaatgaatacacattgtttcactggaaaaggagggtttcaaagcctttgtgttatattacttgtttaaatattttaaacacatcactaatcctacaaacttggacatagatagatcataaattactggtgatgatttttttttctggaaattattttactttcttattgcatcaactttacctatcattttcattgtcttttttcttaaaaggaaaaacgataatcaatcaaatatttggttggctaatagcgtttgaacgatgaaatcttccacgcgttgaagttggtggtcaccaaaatgtttgcttaggttaggaccatcaaggccctacttggacaaaatgttttggcacatccatattagcatgtgataccctgttcacttttgtctttagaagtcaaaaggaaatagtgggctgtgaacttcgttgaatctgaatcacttggaagaattatacttaccatatctcaaaatagcttttctttgtcttggaaaatatcctcttagacaaatattttgcatatcgatggaatgaaaattgacttgttgcaattcctcagtgatcaacggtgcaattagacccagtaattgcagtcaccttagttgaagctgggatataggtttcagggttgtcatggatcatctaacagtagcttatgtaaccaactttcagcacaaattttaccatactactgtatttcacacttgacagagtagttaacttgatggtttgcagtaatatttgtccttagggttgatcaagaaatccaaagttaaaagaacccttacctcaaagcaaagtcaaatgtggtcctttaaagggtcctcacattaaaccctgcattaacccttgttggaggttggttaagggtaagtattaagtaattacaacttgcattgtattgtattatctttgtatgagtgatgatgcctcaaaaccctgcagaattccaatgtggagcccttgccaaaaggttaataaaaaaaaggcaattgtcctggtaatactttattaactgtactgttgctcctgcaactagtttaccttttgtactcttacaacacacatggggtgtgggacttaccgacttagtaatctactacttctcagctaatctgaactctgaagaagcatataaattttacagatccggataatctgatgctatgccagtactaggtgtttgtcagtgtgttggtgtccgtattaattaaatggcattgaaatctcaaggaagaacctactggttttaatatagatgcagatactagcagcttaggacatgtgagaagtcgaaatgcagcataccttattcatgaaccattaaaagtgtgatttataggaagcagaagtatatcaaatgcaaatgcataccatggtatgtttctggtctggtcagagtttgttagaaagtggaaccactttcagcacttctttttctgaacatgcacagctcatgctagagaacattgcatggagtagaggaagaacttcagattgaaatggtctataaaatggcagctccataaggctgaaacattgcaacagacagcatatggttttagctctgaaggtaagagttgtaggaaactgaactctttcttgtcagtgacagtttcaggagctcagttttctccaacatcttatcttcggcgccttaatctttgtagtgactataaatatgtggagtggtagcttggttaggtatcacaaccataatctttggcagctgaatttgaggtttggatgggaccaaatcttactgcagacttgcagagcaagacaagatttggtttcctccaatatctcatgttcagttgtcagacagtgaatagtggtgcaattagttagctttaacttatgggtggaacaaccttggaagctgaatgtgagagttggatggggccaaatcctgagcttcagatcttgccatggcacaagatttggtttcctccagtatctcaccttcaattgtccaagatggccagatgcaacataaaatgtgttttgtttatagcattttctgtttagaaatgggtacagagtgggattggaattagagtggaacagatgcagtgtagggaaatatggctgtcctgttatttccaatgctgagcattctgcagtaatcaagttgctaaacagataaattagcagtagaagcaattacatttcataccagtttttttttttttaaaaaaaaaaacctttcatactcttcaatcttgtatttctatgtaaataacttttattcctcttaatacaaagatacgctcctagcgtattctcgaaaaaaaatactccttttccactgaacaagtagcatatgctaattcttgatcatctgcccacacaagtatcacattttgctgaaatgtgcaggcagcagcatacagcagttgccatttgcttaaatctaatttttggtagcttagctccatgaaagatgcacataaaacttccttcttttagttaaagactagctcgcagccatcaatttgagacaatttctcaccgcatacaagcataactcttttccaaattttctgaagctaatcagagataaagcatggtgctttttctttttacagtttcagactttcagcaatctcaccgtggagtcgtggactatacacagtcaatctccaaggatgcctcaggctctcttcgcgtgaagaaaataaatggaactaaaggaagggatgcacgaaccttggctgcaggagagttagctggaatggtcgattgaggtcgccggcgacgtggaagatggaatgcacgcgcgccgcctcaccggcaaggctaggagggtccgccagagcggcagagccacgaggtcgatgttaaatatgtgatccgaattaattttaggcttacaatatattcggattagttttctaataggactccatgtctttcctattaggtgtctctcctatatatatactcttgtaaactg

SEQ ID NO: 59077 - DNA, 8718 bp, Oryza sativa
  unsure (1)..(8718): unsure at all n locations
ttggctattggttttgcaaaccatgactattagagggcagcaaacatctgattatacactaattgcttttgtatttccttttctttaatcttatcttaacatgcactgttcaagaactaatgcatgtacctcacttgttttcagattcctcatactggatagtgtccttaaccttggtggatatggggctgtagcatatgattaggtctgaactgctaagggtggtgctactgcctctggtttttccttagttcaattttatcacctcttaatcaagtgatttatgtgaagccaaaaaggacttgccacccttaggatcgtcaatgtacaaattctttcttagcttttttttttttaattcacaatcctctgttaaaatgctgaggagaatggtcaattggtcatgtacatgatgaatgaatgaatgaaatgaatcagacatttgagggtggttgtcattgtgaatgtcattagctattgaaattggtatgctcatgtaaacaggtgtaatggacaataatgtgaaatagttttctttttaatggtagcagagcttgctgtcagacagtgtgtcggcaaatctacttttttcatcaactcgtctgtcggtaaagatgtttctgtcgctagacatgtctgtcgttgaaggtaatataggggtcagttcatctgtcggtaaagatttatctgtcggaaaagccctttgccgacaggctttcgcctgatacacgtaatctgtcggaaaactctctaccgacagacaggatgatgctaaaggtggtatttaccgatagatgagctgttgcagctttcaggtcatggtgtagtgacttttgtgaagtatgtaaaactatatgtatacataaaagtatacttaacaatgaattaaatgataggaaaagaattaataattacttaaattttttgaaaaagacgaacggtcaaacatgtcttaaaaaaatcaacggcgtcaaatatttagggacggagggagtatatggtaagacttgtttgcgactctagggcagcagagattatcttacagaacatatcccagacgaccgtcagggagcaccattggtaccatcattcgagctggtgctggtcctctaccatatatcatgggctgtaacgaaaatgtccatagagacaaatacaatgtaacagcagtggcggatgcagacaaagcatttgaaaacgaagaaatatttgtgaataaaatttttacatgtgtgttcttagaaatctaaaagcaaaggttgaaaaataaacttcaatgagaaaatttcaaaatcaactctaaatttaagattgaaaatttaaattttggctgataagcataagcgaaaagatgaggcttcaggattcctagcattggtattcggagttacttaaatcatgtttcatagaatttatataaagatgtgttaacaaccaaatttggaatcatcggtgtcaggaaagaagattagatcgaagcgaagcggaggcggagatcgagttcggaaacagagcaagaatcggctggagtccagatcggctacgattaggatcggctgggtctgagtcagactaggtaagccggtacagccgattccgacaatgcaacttgatgtatgatattgggttgaattgaggcgcttcaaggtgattgccgcacatggatagagtcctgagaaggcaattgtatctattaattaggatgttttatgtaatctccttagagatacgcttgggcaaaagtctgccgcaaagacatatggtatcttagagtttgttagagatagtagtcatgtccgttatggacatatcttgtaattctcgggtataaatagacccgagccctatgtaacttttaacacacatgttcaatacaatttcggcgcatcgccacccttttgctttagttttgtttcgacgagttcttactttcaggttgagctgcatcggtttcgatcttcaacaagaggtaaaacttgttatgacggcttgtattctcgggattagtgctttcatctttatgacactctaatcttgtttatgtaattcgtcgagttatcatatatcttacataatctctggcaatatcgctatctaacctacaatcggctaagatctatcgaagagggcagccgattaggttagattttgacgttgattcagattatataagatatctaccactctatgaaacttccagcggcttgattttctagatattgttcttcttttcatatttaatgctgcatcagttgagtttgatctattaagtcgtgcttagaatatcaatctctagcctgccttctggttgccgattagggtagcatcagagtttcagccgatcttatctgatttaactatatttgctctatatgcttcattgacatgttaaatatgccctttatgtcaagatattgttgtatctaagtacattaggcctttgtttgatatattatacctgttttaatatcctgatatagagtagtatcggagtattagccgatacatgctagatctatctaatcggctatgctataaacatacatagtcctattattaatatatatttcgatctaagtgatttatactgtctcggcatagtgaccgatctatcccaatcacttgatttaagtatatatcgatataagaactatatattggaaatatctacagccgatcgaatagatttagttctttattgtctatttacaactgccgatcgattcacatatgacatcggctcaaagataaatggtatgtcatcggcacctagtcgatcaactatcatttatagatttaaccgcggtttgtttgcttctatttcttgttgattacaggatcaaatcaactggcacgctcatacattcgaaggcgagctttggacctgcactggagttaagcagatctcccacgcttcgtgttttctgtcaacacgcttttggcacgcctggtgggacatttaagaagtcagccaacaattcttcttcatggccgagaaacaaccaccaccaccatctagcccaggctttgttaaggacaagatgctaaagctaggattgactgacgtcaatgaaggaaacgtcgtgccgatcgatccagaaaaattcacacctgagcagaagaaagagtttgaagcaatgttgcagcaagtacgggattagttcttgaactcattcatgtagacccgcaaggggacacttgtttagaagtacaaaataaaagtggttgctgatgatcctgggaccagttcttttaaggatggagatgggaaacaagctccagacggctcggctcagccgagtatcaaaggtgctactgacggctttctaggaaatcaaggcgacaattctcaaggagtccatggagtacaaggtgacggggtgcatggagttcaaggtgatggtgctcaggggctgcagggaggaaatcttaatcagaatagtgatgtggcacaggattttttcaataacttccaagatcgggttgattacgctgtgcatcatgctttgatcaatcagtctggggtgttagtcaatagcttatcaaacatgatgaagtcaatagccgatggttcaatagctgagcatcaggctgcaggcccggtttatttgcaaggaggtgtcttcccaaattatcggtctttgattaccgatgttcagccatctactcaggcggttacctccgttgcaccaacaacttagccaacggcgccggcaacaactcccctacctgcttcatcagcgatggcgccaggccagccggtgaaccctcggttgttaatgagagagcagccacagcatggcgggcaggttgtgaatcggctgacccaagatcaggttgctgccatgtttctgccacctcaatctgttgttgatccaatacatcagcagccgattcaacagacacccccaattcagcaggttgtacaaccaatccggcaacaggtcatgcaaccattcagcaaacaccaccaaggcagcagcccctacagccgattcagcagacgctgttaagacagcaaatcgttcagccgatccagcaccaaggttcaataagcgcatcggccgggtttgcaacgcctggtggtcagcctgtacaacaatttttaaaccaagttgtcccagaacatttggttcaccacgtacagccgggtggcacagtaatgcctcaagttattcctgagcacttggtacgcaatatccagccgaaccttcataattaccaagggggtaacttgaattatcaatatcagcctccttccccgcaagcccaatatcagctaggggcattggctcaacctcagtttgcgtctcaatacggtcagttcgagcccatgcaacagcagtcacaaggggcagctcagcaacaaccgtgggccaatgtgattgctgacgtaatgagggaacagtttgggcttaaaccaaaagagactggaagtttgtatcggcagccttaccctgagtggtttgagagagttcctcttcccaattggttcaaagttctagacttctccaaattttcgggacaagatggtgtgtcaacttatgagcacattagccgattcttggctcagtgtggtgaagcatcggctgtagacgctctgaaggttaggttattccggttatctttatatggatcggcttttacttggttttcctctttgttgtatgggtcgatcaatagttgggccgatttggagaagcaattccacagctatttctacggtggggttcatgagatgaaattatctgacttgatagcgattaagcagcggcatgatgaacctgtgcaggagtatattcagagattcagggagatgaggaacaaatgcttcagcttgagtttaactgatgcccagttagccgatctggcctttcagggtatgattgctccgattagggagaaattctcgtctgaagactttgatagcttgtcacaactgatacagaagctaaccttgcatgagcataggtctgcggaagttaggaaaagctctaagaaggttaatcatgtttgtctgtacatgtatgggtcggatgatgatgaggatgattctgaaatagctgcagccgaatgggtgaggagtaaaaaggtcataccatgccaatgggtaaaaagttctggaaaagaggagaagtatgactttgatattactaaagctaacaagatctttgatctgctactccgagagaagcaaattcaacttcctgctggtcatacaatcccatcggctgaagaattaggcaaaaagaggtattgcaaatggcataattctaggtctcattctactaacgattgcaaggtttttagacagcagattcaagtggccattgaggggggcaagattaggtttgattattccaaaaagccgatgaaggtcgatgataacccttttcctgttaatatggtgcatacagctggccaaatagccgatagggtccgtgcaaggggttttcaggcgaattcggctaagattatcgacaaatatcatgaagaatacgatgatggttttgatccccattggggttgtgagttctttagattctgctggaatgaaggtatgagattgccatctattgaaaactgccctgggtgcagtgatatcgttgagagctcaagccgatcatataataggggtaatcgactaaggcagacaagagtttctgttcatcaaagattgggtccagtgaatcaagatcatggccaagaggacaatgtaatcaggaagaatcaatggtgtccttctggtattttcacgaagaatcagaagaacatttaataaatctagatttggaaataaatgtggatggagaaacataagaatttctatatgaacagaattggttgtagaatggtaagctctaaaggagaagtgttgactctagggagatggtatttcatgtactctagagatgtttgggaaaggatccaaaggaaatatatcccagagcaacggttagaggctagagaaataaatggaggggttttgtaaaagtcaaaagaaataaaaaggagggttttataaagtttgaaataaataaggattttataaaatttaaaagagaacatttaactttacaaataaaatttaggtccaaagtaaaagagattaaaagaaagtaaggttgcttcaaaggaaaagtcgagaagagcacaactaaaacttttcgcgaaaatttttcccagaaaatttgagtgcattgcatcaacccttcgctcattcatcttctcatacattgcaacaagaaaaactaatattataaaaaatcacatgattaggttacgatttcgatgtcaatatagttttgaaaatgataaggtgatttttttggataatggattaaattcctgcctttacttcaaataagctacaatcacttattacaaaattctctcaaagagagcaaacattcagaccacttcatagcgacgggcacgtccagcaagaacagatccaatatacatcatcaccatggagaccaataccatgtagacttctcacagcatgactgccagcaagcaccacatgtaggcgtgagcgttaacgaaggaacgttaacatagagatcgaactaagaaggcaggtagatcgccattactcaccttgcagcacgggatgacttaatgttgacttccccaaccatgagtggcgttcgacggttggagtccgatgatcattattggtggcactagcattatactacctctaatgttttgacttttttctaagttaaacttctatatatttgatcaaatctatagaaaaatatagtaacattttcaacacaaaataaaccaatttaataaaaccaattatattcaattctagatttaataaaagcaatttggtattgtaggtgttgctatatttcattataaatttgattaaaattaaagaagtttaacataggaaaaaaatcaaagtgtatatatggtaccaacagcagcagcagccgcaatagccatcagagggttcagggtatcgccgtgtcacaccctgaagttcttctcccaagcctaaatcattttaataaatgaccccaagaaattgtttgagtaatggcaagagagaaaccctaatttaataaatgcaattaataattggaaatagtatgtggattttttcttgggttctacatgtcaaaatatgctaacaggatttttagtgaaattttcagagctctagaaataattttaaccaattaaaattgagcacaagcaattattaaacccctggaaaatccttttccttttttctttttcgttttcccgcctttttccctaaatgggccgtcggcccatttcccctcccctttctgcccagcaagtggcccagccgccgccccgcgcccccttctctctccgggacaccgacaggtggggcccacctgtcgggcccgcccccaacctttggacggcgcccgccgcgcacgttacccacttcccgcactcgccctgcacttccctgcaaccggcgncccacttttccgcccgcgcccacgttcgagatggctaggattcaaanacaaatcccaccactctccctctctctccacctcccccacttcgccggccactccctgcctctctcggccacgtccgacctccccagacctatataaagcaccaccgcttcctcctccacttttttccctctttcgtcatccactcccgagctctccttcgccctagcaccgtgcaccacccgccgccgccgctttagccaccttcggccgccgatcgtcgccgctagagccgtcgccgagcctcaccgtcgccgtcgtcgggttcgcaagcccgcgggccacgccgtccaccccttccccatccaattccgccgtaggagtccgctttccaccgcgcgccggtgagctcgccatggccgcggccttcggccggcgattttgcccgcctcgctctccctcactaatctctctcggttgtttccctaggttgccccggagcccgtccaactgtcgctgtcgttttccatcactcgccgtcgtcgatcgtcatcagtgagacccctccccttttcccctctctcctgcgccgcctagccacgtcgccaccgtcggccgctcgccgccggtcgcggcctcgcgccgccgccgctagcgccgcgccgccgctcgccaggaccgctgggctggcttaagccgctcgcgcatgctctcggccatgcgccgccttcgccgtcagatctactcgtgttctttttatagtaaaaacatagtgaatcttctaaatatcatagaaaattcatccgtgctccgtttaagcccattcaagtctcagtaaatcaagaaaatgcaaagaatccattaaaaatggttttgttctctgtttcagtagtgttatagcctatttgcattgtttgctttgtatgtcgcatagattccggctctcccgacgctctggtgtacttcgaaatagtcgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttacccattcttagttcaactagtacacaatgggggaattacgttaatgcatagactccagat

SEQ ID NO: 59078 - DNA, 7568 bp, Oryza sativa
cgacgaggaggtggacggggaggagctgttgcagaggttcaggcgggaggtggcgcgccgccggcgtcatggaggagatcaggtggcggcggaggcacgaggacgcccgggacaagcgcaagcgcaaggcccgctccgccggccggaggtttcgccggaggtgaggccctcgtcgatccatcggtcgattgcttccatgatcctgcctagattgtgccgatcaaagatgatccttccttttcctttttctcttccccctttcgttaatctgcagccttctactatcttggtgatccatttcatttgcttaccgttttaggtgctaattaatcatgcaatttccgtcagcttcgtgaagccaccttcgatctgttctaatattgggcatgctgcatcggaaaactacaagcatacgttgtttgtgctccattttaggccgctttgatatttcagcgaccaattcacttattacatgaaagcttcgtaccaatactgcctcttcagcggcgaatttttatctcacattagatcgctataatacattgggcttatgtgaatatcattagcatttcagctctctgatggtactgactgccatgttcttctgaatgtggtcattggactgtactggtcatcttgtaaattcattgtcattagcattttagttctgattggaagcaaattgaaattatgagataatcctcttttcttatcaagagagatgagctcttatgtttttgttccgataccactagtagttcttttctttttgatgattgcattgcttctgtcctagctttcaatacattgatcctattctgagcaccatgaattcatcatggccacgttcattatcatgtcaagataaggagctgccatattcatcatcgattgtacattagttatgctagtgatggattgattcaatgaaaaattgtgaatgatgtaaagttgtggatttgggaacatttgattttttgtggattggatctgattggagggatcgatcagggccgatgggaagctgtcgctggttgaggagcagcgtcagctgtgaattttttttagcactaaaaaagtgcagtcggacggtgtaaacttagtcccgtgtgaaaatcaattttagtgcaacaattgaggtatactacctctatatgacgtattacgtcatctagaaaaagaacagaggggagtatataaaagagtaacactggcccttggatcaatgtgcaatggagggtgtaaactatatacttttggtttgccataaaaaaatcctgatgataatcatagccaatttattcggttgtgtgttttctcttcggtctccacacaccacacacatgcatgcactgggacaatcgacaacattttatatggattaagagctcacgtacgtgaaatcagcaacattaaggtgctggtgcatctagcgtgcttgcgcacagtgagtggtcatggtgaccttattggaaatcaaacaactcatcattcgaagatatatatactggatcaaagtaaacagacagacaaataatagaacaaattaaataaaacaataagcatacatatacggtggttgatgtggccatggcatgttgttcggttagctggctagggtgccctagctaggggcgcttgagagagaggattgccttgaagatccccacaatcacgcggcgaggtgaaggtgagaagcggcagcggcgcgaggaagaagaccggagggtgaggggtggccactctggccatctccttcttggattcggtgggggagaagggagttggaggcgcaggaggccggcggaggcggtcggcgagtaagacggtagccagcggaggtggttgtggccagcaaaggtatttgggcagcgaattgaggtgcaggtggccagtggaggcgagcaaggcgatggctggcgaaggtgctatcgaggtggagttggctgttgaggtggctggagaagctgttggccggcggggttttagtggtgatgggtgatggccggtggtattgccacttggagaggtcgtcgttgggttggtcggttggttgctgacgtggttcgttcgtttggaaagctgcaggacacggtgaacaacagtgttgtcagtggcttgatcaccaacaagtgtacctccaagtttatctggggctcctcccgtttcctagagctcctcccctcctattgaccgttctgctttcagattccggtcgtggggagttccatggcgaggggcggggagctagctttggttggtagatttgcttggagttcgagagcctcaacactaccagcgctttgtttttcttgcgtcggcgaggtgcctggttcggtggagttggtgcatgagacctctgcgacgcaacctgttgatggtgtttggggtggagtcggagctgcatgcttggccgggtgtgacaagctggtcaacaataacccccttgctccttccttttggtagtttcgttggggttactatgcagttggcttcctagtgtctttgggtaggtgtgttgggggaaatcggagctgcttgtcggtgacaagctcggcaacgataaccctctcccgctttctatggtagcgctgtggtagccagggttgtcgtagttggcagggagagcgagctggggcgaatgtcctgctcgatcttgggctagagccaacgatggcgatgcctgtgggcgccattttccttcttgaaggcatcgtttctgtgctctactcatttcttcgggtgaaaaccttgctccgattttcggacggacgttgtttgtgtttcgacgctatcttcctccttggaggcttcgtcttgaagaccctgccctacgcttgtctgtggtctgttcataggaagtcggagctgctcttgggagcttggcaacgatagcctatgttttatcctctagttgtgccgtcgcaagttcttttttttttgttctccgtgtgggttttgcccggctttccccttcaaaccatgcttatgtgaggtttttgtgcccggtttccctcaaaaattgggccaagtctcttcttcttaaatgaaagcaggctcttcctgtcctcttctgaggtttttcctcaaaaaaaaaggacaaattcatatagatagaaattggaattcggatacaagcaagaaataattgttgcaacgtacagctagcaagctctgatctgctactcttgggacgtttatcactactgctggtgttgcttgatagacatgagtgttttgaagatgccgacgagaacgccgattatggagaacaccgtgacgatggtcttcaagttgttgtagatgaacttgtgtatagggatccacatccacctcttacgcctgtatgcttcaagattgtccaataaatagctgtgctgaaaaggaatgggaattagatcgacaaggttcttgaagaatacgagtgtgcgctggttgctgaaatcaccatgtaggatacgcttcactcgcagctcgtgcacgtcttcctcccggctcatcagcatcgcgaggagggatacgtaagagcagacagtgtcttcaccatccatgccagtagaggccgagcaaatctcgagtgccatcatattgatgagccagcatgcattttggtcgtccatgacgagaggtgccatgaagagcttgccgaacaaggcacctttgctgatgctcatgtcattaaaccatgttttcttgttggctaccaggttgatgcctatttctgcaagctcgatggcgctgctattctgtgatattgaagtaattccttcagggggttcgagggccatgcttccattaggcatgctcagccctgattggtagtaccgaaggaggccaaggagatgtgatggtgtgtagctttcatccaagacgaatgatctcttttctaaatctgtgtaggcatcaaaactggcgcttttttgagagatgaactctcccacgggaacagacctaaaggtcatgagggcatccagcaccacccatgggagctggttctctagcagaaagatgtccctctccatgctagcatcgttggagttgaaccaactttccaatgatggagcaatgtcgtcagttgagcaaatgatatactggagcaagaagcaaccatcatggaacataatagccgcaaagtcaccttcgcctatgcttgccaccgtgtcatcatccacgtagcagcttcgggcttcggctgcaaccaagaggattctctggtagacctcctcaaccgagtggcctgactccccgcagaagtagtaggcggccgcacgcttgacctcctctgcctccttgaggtggggtgcgccatggtggtaaggaccgatggctacagctcttgggacgaagtagcggtcatctgtgctaattaagcttcgaaaaattgaagggtacctgtggatcttggttttgatcttggagaagttattctccatcttttcggctgctcttttcagctcctcttcgaccggaattgctacggcttctgcagcggccgtggccatcgccgttggctgctcggcagtttccagtggttggacctgatcgctgctaggaatagctgagagttcttccatttgtggatttgctgtcatgctatgtattcctgctacagcctacactcaactcaaaacatgcgagcaattggtggtgaaacaatgaagtttaaggagatgaaagatcccatctcaaccaacaaatatagaataggttggtagatgatgcatgtggccaaatatagaagtacgtttgccaatcaatttgcttttgattatattagagagtacattagctagaagtagtgttccaaatctggtgtcacaagaacatgtaatgatacaagttgttaggaatccaattcgccaaattcaaacaatgaagttcacagtacaagttggtggtggaattgagatgaaggagctaaaaaatgggcaattttaccatcattgagaagatgcctagaggtaccatattttttattttttatatttgcaaaatttttttgaataagacgagtggctaaacgttgcaaataaaaactcaaaatcccttatatcgtggggcggagggagtactagtaattgtgttacgtgttgttcgtgtgctgtgtttcggtacctgcataaatcaccgatcaacggtgtattgttaagtgatcaacaagttcatgatgaaaaaaaccgacagtaatagtggcatcggtatcaaagtgaaagaaacattgataacactaagtcacaatatttgttaacaatatttaagccaaaactttacattctctataaattgctcacgggtatcttcaccaccaaactgtcataattataatgtattagcataccaatgaattttgatcgtccaggttaccgaccagtcgtttttttagcttacctatgttagttgtcatcttgttacatcatatacgtctctctattcaaaagagataatagaatgtactccaattttactttcatcctaaacatttattgcaattatatatcccactttataactggctttatatataggcacaaactctagcaatttatatgttcagtgcaacaaattaattaggaaatataaggggtgcagtggcaacaatccggaagttcctacgtataatagcgacctacggtgatagcagcttcttgcggtttcgttgcttgttttccacttgcatcagttgtcacatgtctcttttggaattaaaccccaagagatttttggatgagctgtggtcatataagagaatctcgatttgcatgatgaacgttccacaccacttgttggcggtgagccggtgagaaacgggtcttggtgatgcttcggtagaagcatgcatgcgtgcgagataatcggttggattgcggtggtggcgactggcgagcacaaatagatttgctaaaacctttctgaaatgtattttcagataggtaatccctccgtattttaatgtatgacaccgttaactttttaatcaatgtttgaccatttattttatttaaaatttttgtgtaaatataaaaatatttatatcatgcttaaagaatatttgatgttaaatcaagtcacggtaaaataaatgataataacataaattttttaaataagacgaataatcaaacgttggttaaaaagtcaacagcgtcatacattaaaatacggagggaataatttttttcccgtattatccttattggcttgacacagggcaatatcgtctaaatatatattgtgctgaagagtagacgagtggtcatttggagtaaattgcatacggcggatctacgactatgatgtatgcgagtttggactaaaaaacaaaatattcgatgcaacttatctaagaaggattgttttcatgccaggcttgactagatcatgaaacatccgaagcaccggaatgcccccatccactagctttatcggattattagccctttgaaatggatgactagacagattgtggaagattgattatagggtgaaatatattatatattatatagctaacaatagcttaaatcaagttgtttaagtaacactgatgtaaaaaagtttttggcaaaattattcttttggaagtgtggcacagataatcatcacatattacacgctttccagactgttaaaggtaaattttgtaataaataaaaaaaactttctatatagtttttttttctaaaaacaatcaaataaagctaattttaaatttacaaccttatatatttaattaatcatatgttaatgatttgtctcgtttcacatgtgcatgtgcttggcagtggcagagccgggaggagcagaggaaggcctggcctcccccaacaaattgcaaatttccaagtacatctagttaatcacaagatcaagtaagcattaatgctagctgccctgagtctttgggcctttgtctcaaaggccattggttgtgaaatttatgctagctgcctagtacatatggatgggtgtggaacactggaacaatcaagtttgatggctccaatcatgaatttgattacttaagtcctaactgtcttgttatacatagttcattgtgaaaaatcttcacattgctaaatgattggcttaaacatgattagtttgtattgttaaattgtcaaaatatagggtatatattaatataaaattactactgttaaattgttaaattatcatatctatcttctatctatcttctatctattatatactaaaagtccattaaactccctacaaacgctcttaagctgccacgtgtctccctcaaaacactctcaacttgccacgtggcgtaacgagaggaattcagcacctcgtagggcccgcacattatttccataaatatatgtacgtgtacacaaggcaagatttgaaatctatctaaaagcaaaacatgtacttgtcgtgaacggacatagattagttccatatttgtgtgtgagaggcaatattccaaatctctcaaagcaaaacattccaaatctcaaaaagcaaaatttagatcactaggaaagattattaattgcaacaaggattagttccatatacatgagacaatattcgtaagg

SEQ ID NO: 59079 - DNA, 10497 bp, Oryza sativa
gtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaatttcaacatgtagcacgaacactactactcttcgccgccgtcgtctgcgccgccgtgatggcagttgccgctgctgcggacggcgaggtggcggcggtcgtcgtcggtcaggccaagtgcggcgagtgcaccaggaagaacatgatggcgcaggatgctttcaagggtatatatatatcatgatgatgatgatgatgatgatatgttcatcattgattaattgcgatcgatatatcaccgtccttgattaattgtttggtgatgttcaggtctccaggtggcgatcaagtgcaagaacagcgatggcgagtacgagagcaaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaataaaagttgtgagatgtgagaggagtgtgactgtgtgtgagatcgatcggtcgatatatgtgttggagacttggagtcagtgcataagcattgcctttcaggtgaaaaataatgcgcgtttcagagtgctcctgtgtgtcgttgtctctatttattcgcatatgtaatgcggtatgtgttctacgtaatgtaatctctttatgtatttttaagattgttcatgttgacgtagaatcacaacaccacatcttagcacgttatgtgcaacttgcgcccaacgaacacccacctgccagggtgaacgaacgttggtttatcctaagctcggcaggcaagctagggcatcttctaataccgtggaaacgacagatgccaagcaattgaggatttgaggataataaaatttgagataggtagcaagaaggagggagatatatgtagaatatagagggtttggataaataaattgattttgacgattggttgcttgttgtttcaatcgtccttggccaggaatgctactgggcgagcgatcgcccttaatcgctcagggcgatcagtttttgcgccccccccccctccttccctccatctctccaccttgtttcctttgttggcaccgcattactttcctattttagtaaatttatacacctaaagtttacacatctaaagtttagagaccaaaaatttataagtcaaaagtttatacatcctattcaaatttgaatttgaattcaaatatttatatatatatagtatttctatacatctaaagtttatacacctaaagtttatagacctaaagtttataagtcaaaagtttatatacccgtttcaaatttgaatttgaattcaaatatccgattcaaatttgaatttgaattcaaatatttttcatatatagtatttctatacatctaaagtttatacacctaaagtttaaactttagacctaaagtaagtttatagacctaaagtttatatacccgattcaaatttgaatttgaattatatcttattcaaatttgaatttgaattcaaatattttctatatatagtatttctatacatctaaagtttatacacctaaagtttatagacccaaagtttataagtcaaaagtttacatactcgattcaaatttgaatttgaattcaaattttttatatatagtatttctatacataaatttttctaacttttatttttcaaaaaaatttgtgtagtctactgtagtataaagaggagaaggggaggaggaataggggagaggagggagtatagggggaggggggctggatccgatcgcccaggcgatcgcctggcgatcgatcgcccattagggccccccgtccttggcccccttatatttataggaggggtggacttgcttcctggggttttttcatatgcaattaggcatataaatcaactaggactcaaaaattttggtgtaaaacaagaaaacacgagaagtatctaaattaaattggactcggactatgtgattaaggtctaaccgcctggatacctatggtctaatcacagtgcattgtccggtttgaccggccacataataacggtcacaccagtcttcgcgggaaagctctggcattttataaatttggctcaaacttgctataactcgactctactgccaaatttgattatcaacacatgcccccctgtcttttcggcaaacttgtgagccaaaaaatactatgcatgagatcatctaagggcgatatccaccaataccggccatgaatgcctctaaggcttaaatgtttaatggtgatgtaagaaagctacgagaggcccctcttgttcagattgtattttgtttttctttagcctccactcttgcctcgccactttcttgtgtggattcttttgtgactgattattttctctcaaccggctatgagatgagtgtggttgattatttaaaatcggtcaatgtggcaaccggcaatgcccataatggatgataatatggtatataaataggcatcatccacataccattaaaactccataatgcaaaccaagcgtaataccatgaagaaggagaagtaagttgccggtggtgcatactcacttggtagatgaacttgatctccttggttgcttgtcatattttgatatctccagattgtcatcttgcctcctaagtattgaagtcttcaatgtggtctccaagtgtaataccatgaagaaggagaagttagttgccggtggtgcatactcgcttggtagatgaacttgatctccttggttgcttgtcatattttgatatctccagattgtcaccttgccccctaagtattgaagtcttcaatgtggtcttctccttgccatcgggaatctccttctcttgcaattcagcagtctgtataggaaaaggtaatgcaggtggatgagctacctttgtttctaattgcatttggccacatcaaaagtgaacgttatttcctcttgtcgattcttacgactaaccagcttaagaacggagcaaacgaatggtttagagttggagttccaaacccattcgtctatgtatacatcaactgtctcattgttcaaagattcttgttcataaactatattaacatgggaacaatcagacataaatttctatgagattttggcctctttaacttggctctcttgagtcaaagccatttgaagtaattggcttacatctaagaaagtatgaccatctagcttttcttttaaatattcaagtaaaccagaataaggcaaatctaccaagaccttatcagaaagtgttaaactataacatcggtttcttgtatatataaaatcttctaatgtagatcaaaagtaggctcattatactttttttaaccgatattaagtacgacaaatttaattcggactcaccactaattaaagaagtaatcatgatatttttgttctaactcagaccaatcatgaatagagttggtgcaagtgaaataaacccaagtaaatgcatcaccaaataaagacaatgggaaaagcctaagtttcaaaatactactagctaggcttcttcgcattgtataataatgtaacatcctcaaattttaaactaaaatttgactgcatcatgctggtttttgactagattagtacaatttaaaattttatttgaatccttttattggttcaagtattattcctttagaactcttttaacttaccctaattattccctttatcctaaaacttagtgaattttagcaaattctcacaaatttcgaactttagtatatttctttagtttaccccctttcattagtgagaattttctatactctaaaccctagtgaaaccctttcaaacttatagattaaattcattcttttctaggaaaaatattcaaaatttctgaaaacactattcattgccctcaaggtgttcgatgaaatgcccagcccaactatctcagcccaacatctacccaaacctttgcaaagtctaagtttgatccttggggaccacaacccatccaaaactgtggttcactttgccttttccaccccctttacttgcgccaccctggcatcctccatcgccgcacgccgagccgccgcgcgtcggcttcagggccgttcgcgtgtgcccgaccgccttggcgcgccgctagtcgttcgacgccctaagaccaccgccaccgcaccaatcgtgatgaagacgaagccaggatgacctccgccgcaagttaccgccgctcgacgctgtgcacgcccgtccaaagccgccgccaagtccgaattcgcttctacccggggtgaatcgcgccaattcttgccgcactgttggattgaagataagcggtggtttcccctatcacaattcaaaccgaccaccgccatgctgaccgttttaaccctcgccgctgccgcgcgtcgagcccggattggcgccaacacgtcgccagacgttttcacccatggtcaagtcaagccttcgtcagtaagaattcgaacgtggcctcccgccactcaaattgatcttgccctccctctcacagctccctgccacccctgccgtgctcaatttccaagctcatcaatggcgttgatggcgcccgagctcatccacttcttctggccctataaataggaccccaatcccttccttgtccatcatcgatcatcatcaaccataaccccacaaccctgaagctctgctttgccaaaccataccatcaaccacttccgcccgtcggtcgaacaccttgtgtgcgattgacttcacgcccctccatccactctccatcctaactaatccttagaacacctaatatcaaccatgctctagcatattggagcctaaccgaagctttgcgtcgagtttcacctcgtcgcaccgagctaagcactgtcgcccctgctctgctctggttctcaccgccgagaagtttttccggccgcaatccgtcgtctcagcctatctcggtgagttctttcattttaaccatctacgtactccctagattccatattcgcaatcggccagcattaccatgccaccttctgggctgccgacatgagctcgtccgtcgccaatggaggtgctcgtcggcaagttcttccacaccttgccgaaagtcggcaagctacctaaatccttctaagtaccccgtagatgctctaggaaccctccccgtgctatgcctaactctcaccaccccgatcaccttcacggcctatccatgtcaccgccgccctagccgttagcccacccacacatcaaattaacccctccgccgccactcgccgtcgccggagaaccctagctacctcccctcctcggccgcaaccccctttccccctctatcaccgccgaaatcgctaaccctagcaccgccggccgtaaatggggaacggctagaggttgaagaagagaagagagaaagagactgacaggtgggacccgcacacagtatcatttcacatttaatttgattttcaaactttagaagctcatatcttttaaaatatagatccaattccagtgaaacttggaccaaaattcttctaaaatcattctctatcttttgagtctacttttgctatttttctattttattttatttttcctatttttggattttatttgaattccttttgaatttgaattttatatgtttaaccctaggtcttgaagagtcctctgacatattagataatatcagtcaatctcaggacatcgagcaaggcaagttactattctaccttttgatcatttaagcctatattttacaaattatttatttatagccttctattcaatactctattttatatgcataattcaaccatagaaacccaaacaatttagtattgcttattttgcttacaatctggtctaaatatttcatacttagattgggacagtacgtaggaattggatgattttcgggtggctagtactgtctcgatcgatatagttattaccaggtacttatgtcgaacgaacaggtacgaccatagtttctagaatagggacatacctagtcattatattaattagcaatgtggtacctctgtatcgtggttcttatttttaagtcctcgagcaagaggcaactatagccacgaagggcaatttttaccattaccatgtacaagtaaatggtcgatgatactcgagtataaattattatgttataattctaaaccctgatcgagatgacgtggtgtcatacgagatcccccttaaataccccgggaacaccagaactcctctcgctgctgataacgttacgttcagagcgcatgaggactagagttcatggaacaggtaccacaattgttaataacctaatactgggtcatgactaagctaatgaatattggcaagtcgtggactgcgagtaaagcgtacatctactgtagtagaatattcatgaaactattcgaatggccgtactcatggaattgagtaccgagacccatatagtactctggttagaaacctaaagtctatgtatttacaaactcttgctttaatacttccagattgtttattattgtcttttgcaaagaactctactctataccaacacataacatgtttccatggtaacttgccgggtattgtgaatactcacccttgctcttataacccctttttcagatttgggtcaagaagaagactcctatgattattactacgatgactccaataacatagaaaatccctagaggttatacctccctagtcagaatgtataaaacctctatgtaatagtcttacttatgtgagtacctattcttgtaaaaccttagtattgtaaaatttaacgtatgcaatgaagaaccagttgcatattatgtatcaatatttactgatccaggggttgatacattaatctcagccggatccaagtttttaattttgggacccgacaaataaattggtcgatatcctctaaagtagatcagccatgttctccagtgaacttacacaatgaggcagtctaaacccttgaggatatggagcattataatagtggtcagggtagagtttttgatctatacgctttttaaccctagtatctatgccaaaagtgtttttgaaagcttcggcaatctcatcgctaagactcttgggttatgctcgtgtaccgctgactacaggatctggcaaaactcttacctgctcgtatcccatatgaactcctcgaattctacttaacaagaaattgattgtccgtataaatatatagcccctaggagagatcaaagagcatcgaatcataagccatagccacaagtcacatcgaatatcaatcaggaggaagtcaatagctagccgatgattctaagtcgttggattaattcttggtgaatgcttgttggtaggctagattagctagcttgctcccccattgtaatcagtttgatacattctagagatattcatataaactggattatggctattacccacatcggggcctgaatcaatataaaaatctctgtctctcgtttactttacggcaatctcgcgtatactttgataccaacatcttctatactttaaaaaaactattatataccgtcaacaagtatattctctaccattatacagacaagatgcacgtagtcaccactaaatacatacaccgcacttatacactcacgactgtgttccaatcatatgtttataaggcggatatgttgatcgaactatcacaaaaccacagatttagcatcaaatttatcagaaacctacatatttaaggtcaagtatcacgtaattaattatatatttaacattgaagttatcacaaaactacaaaattttgaggtcaaatctatagcaccaccattatgtttgagctataaatgttgtagttttgtgattaaattggcactaaacttgtagttttatgataattttgttacttaatctatagctttgtgaccatatatttcaaattaaatctgtagttttgtgataaacttaacactaaatctgtagtttttatgatataacaccttaaatcagtagttttgcaatagtttgatcaaagtatctgtagtttttgtgaaatttactcatttactgaaaaatagtatcaatcatgcaatttggttggagctgtcctatactatagaactattctccctttttataaaacaggctagtagtactgtgcgctgtaggagtaccagtcgattaaagcttaactttccttgttaaacaccaccaatcggcggcaagtgcatcaacagtcagcactgcatgcagtgtgaatgttcacagtgcctccatgaactactagctgctactcttaatcgatcggtgtctgatcaaatcaaataaaatgcacggcgttaatgattttaaacctgcaaattcggcgcaaattgctaatcatgttgtaatataattagctgacctcagatcactcccagctagtagcctttatcgatctatataaaccacatgcatagcctgctttttcttcactcatccacacacagctctagcctcttgctacatagagtttgcgaggatttatcagcaatggcagctgtagcacgagcactactcttcgccgccatcgtctgcactgccctcgtgatggctgtcaccgccgctgcggacggcgaggcggcggcgatcgtcgtcgggttggccaagtgcggcgactgctccagcaagaacatgaaggggcaggatgctttcaagggtatatatatcatgatgatgatgataatatgttcatcgctaattaattgcgtactcagctcgatcgatcgatatatcaccgtcgttgattaattgtttggtgatgttcaggtctccaggtggcgatcaagtgcaggaacggcgacggcgagtacgagagctaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaataaaagttgtgagatgtgagaggagtgtgactgtgtgtgagatcgatcggtcgatatatgtgttggagacttggagtcagtgcataagcattgcctttcaggtgaaaaataatgcgcgtttcagagtgctcatgtgtgtcgttgtctgtatttattcgcatatgtaatgcggtatgtgctctacgtaatgtaatttatatatttataagatttttcatgttgacgacttgacagaatcgcaacg

SEQ ID NO: 59080 - DNA, 11585 bp, Oryza sativa
ttaaataaggatgtttgaattgcccaaaatgagtaagttggtaaagaaaataaataagggatggttatgatttttttaaaccacttagtttatattgctccaatggtttaccaacaatattgtcgctttctacaatatgccactggatttatcaattgtttctacaatatatgaacatttaaaaaaaaatcaaaatacccttgtagacaagcatccaaaggttgacaattgatttatctcattatacgtttaaaaaattatgaaatttttggtgtagtttccttacacaacatagaattttctgtttatgtttcaaaatttcttgcatgtattttttgaaaagtctttttatgtggcattagagagaaataacttacacaaaaaaatgaaaatattttgtgtagcacatgaaagatgatttgtacagaaatacaacaccacagaaaagtatactatgtgagacataacagaaatattatattttatagaaaaataataaaatgtaaaaagcgtgaaacttatacaaacttatattcttatattatgtgctaggaggctaatttttttaaattgttgattttttttttagttttgtcaattaactgccaacccttatatttttaggcattataagaaattctttgtttggctgaatggtaaattgtagaaataattgaaaaacatagtcgatgggaaatcattgaattggtgtaaactcaagacatatatatagtatattatttcatatattttttaaaaattttgaggtgcatatgtacctagggcaagccttgctgcaagagggaattttgagctgcactcttgtttcttggggccttcaccactccactggtaacccacacggcagtggcattcataatcccctgggatgttgttgcagacaccgtagcagggatatttcttcttgttggacacatcacactcgttgatgtctgtgcatataaaagggagcatatatattagttgttagatcaactgttactagtaaaaaaagaattaattttcgtaggctttggcttctttttcctttttctttttgacaggaacctagctcaaaatgaaaatcacctgtcaagatggcttaggctgtcccaggattataaaccatctatgaaaacctattttttaattggcaaattcttaaaaaaccgcctataaaatttgtagctcttcatgaaatctacattgaaagttttctttccattttagatagtacatttagatgtctaaatattcgttacaaactcttcagacctatttttgaaaatgaacttttgagtatttcaaatgatcttggatgaagacattctatattaaaattgtagagcataactagatctacaactttgtactagtaaatatttttataagctctagtatctatttttgtataagtggttctttaagaaatcaaatttttaggaactcatagaaaattcattttaagtcctattgaggttaactaaagttctccaagatcgttctagtaagacttaggctctgtttgagtctcctgaagatgaagatgaagataaaaatgaagattaagtgttttacgtaaaacaatgtggtaataacttgtgattaattgagttttaattattataaacatgaaaaaatggattaatctgatattttgaacaacttttatatagaaaattttcacacgaaacgcactgtttagcagtttgaaaagcatgccacaaaaatccaaaactttatctcccatgtgttgggttcttaaacatgaccttagtaactccctccgtcccaaaatataacaacttcgagcctccagatctttatcccaaaatataacaacttctacaccaatattctcttctcaagcaatcataatctcctatcattcaaatttcccatggagctccacttttcatccaaacacaaccgtcccctatttaattctacatactttcttaataaccatatccaaccctaaatatgcttatattctagaaggagggagtaatatttttcttagaacattttttttagtatggtcattcactaatgtcacgttagataacatatcaactcatatagaggtaaatgataagtaaacaattatactaacataaatataaatgaaaaatattgtaagggtcatatatagctttggtcacctcatttgaacttaaaatgaactttccataaatctttaaagtttagacattttcaaagaataacaagttttttcagatggacttcctaaagaaatgtcattttagacgattctcgtatggaaaggctcgcaaaaatcaacttttgaggcggttctcttgaaaataccacccttaaaaataatagcactactacaataggaaaggagtagtatcttgatatatatgaagtcgtatgatgaaaaaatctttttatgaaaattggagagctctacaactatatagttgaatgttttttcattcgagactttttacgggtcctgatattcgttacgaaatctcaaatctattgttgaataaacaaacttttatgtttttaaatgaactcagatggagctgttccctatatcaaaattgtagagctcgatgtgatctacaaatttgtggttgataaattttccttttgatatcatttatagtgcaatttatatattacaagttttagagaggcgaagtcaaaagaataagcatctctcccacatgcacaaagttctttataggcgagatggtaaggacgctacttgaagaagaggtccccgttcaaatcctatataccacacgtgtgcaaaattacgcaactcgtgaaacttgcgacatgcggccgtgtatatatagttgcttactaaaatacaaaatatgtttttccttttttttgcgcctaaatcaaatagcgaaaagatcaaatgaaacctggtagattttttttagataatgaatttaaacaccaacagggttgatgtacacaacgaaaggtaaaaataaaggtaaaatggtggcactatttagcaaaactgttagctaataaaataaaaacattaatcttacccttgcaaccttggtccttgtcgtaggggttaccctcgtagccttgcttgcacttgcagtagtatccgggaccgttggtggagttgacgcactcgctgttgtcgctcacacacgcgtacccagccggtttcttctcctgcacctccagtggagggcaggtaacggagtcacggatggcccagtccagccacaccggcatggttcggttgaggtccatcttgagatcggcgctacggaactcgtactcgttcttgtcgacgaggaaggagtagtcgcaggggctgaagtctacctggaagccacgcgtccagggcccgaaggagacgacgttgtcggtgaggcccggcgagatgtcgacatggcagcagccgacgccggcgcaccggccatcctgcgcgctccgggagtcgttgcagtaggtgacgcagccggtgtagaagagtccgctgtagtgggtgttgctgccaccgctgttcccattctgtgtgtaggacagggtgttgcacccgatcacaacgaacatgttgcggctgtcggagatgcggtacacgccgttgttgttgaggtctacatcgccgtagaacctcctggtgacgttgtcgccggcgtcgtagcacttgtacgccacgggaagcatcaccttcacctccgggagctgttccaccgacaggctctgcacatggatgctgccgttggcggcggcgagggtcggcaccaggtcgccgttgccgtttcgggtgttgcaggcgatctcgaagccctccccacgggagcagttggggccgatgccgaacgggtagggaatgtcgacgtcgccgcacctagcctggcagccggcaggccggccggtgacgacgctctcgtcgccggcggcggaagccaaaagcagcaggctggcaagtagccagcatgtggccatcgacgtgtatacgtttatatacgacgtagtagtattaactcgtttctttctttttcctagcttggtttgaatcagctggagtagctagcacactcgcctatgtcccccgggcatgtacttatatagcagccgatcccatccatcatccagcctgttctgcaagttgtcatgctcttcctcatattataattcctccgtcccagattcccttgagtactagtaatgcttgagtactagtattgtaatgcttgagtactagtattgtaagtggcactacttaattagatccttaaagtatggtaaaatatattcagtacgcgctctctatttggttttatcaagaggccctttcgtaagtcgtccgattagttgaaaaacaagaccacttgcaagaaaaaaaggaccatatgctatttgctacatgtcatgtcgattcgcatgcatgctatgaggttaataccattacactaatacattttatttttggtacaaaatctttgataacttatatgttttagactgcatattatttgtaagatccgtagcaacataccgttagaagtgttacttccatatttttaaaaagttactttcctccagcagtgtagttacttttaatattatcataaagagttactttctatatgacgccatattttaattttttaaaaaatataacacagtgattactttaaataacgaatatatgtatttacttgaaaatcttttctacactttgcttgtaaatttattccacatattttttttatttcaactcagtcataatgtaattacttttagtgctaaagagaattacttctattatatagctaagttacttctgcaatgtaaatataaattactttcaaattaataaaatgtttgaatatattaaccgttggtctcgttttgtcatatattttgagtggagtacaatggtgcaaatatatttttaaaataatatacagtttaaaagataaaagttatcaaagaggtttagaaaaatgtgcactattgttttttttagctaaagaggattcatatgtgagatagagtggtcgttgctttaaccaaactagcgaccggtaactgtgtagtcgtgtcctggcttgcgtggtgtaacgtcccgattttcgttcgggattaaaaatcattaataatgcattttctagaaattaaattaaagttaaagcaatttaattaagtgaaataatgggagaattaaaatttttccttaaaaatcattggctgaggatattttgtaatattctttgtgccctaaaataccctccggatttttccatgaatttttggagctcaaaaaataatttccatgaatttttggagctcaaaaaataattttaaagtcacaaagttcattaaactcatttatataaaaagaaaacgaattaaatcttctcccctccctcccttgggctcggcccaagtctccttccccctccactggccgctctcttcttctcctccttcctttgggtcgtcagcccagccggcctctctctcgtgcgaagttcgtttcgcctccctcctctacccgagccgccaataggtgggccccacctgtcggggttatccccttcctccaaccacccagccgccatggccggtcattgccacccacgtcccgccgaatccggcgccctcccgctcgcgtcctcaagcccaaaccgagtggaatcggttcccctccatctcccccactctcccccacttcccccctcaaaaatcgtcggccgttgttgcttcgattccgccatgtccggccatgttctccacctccgagcttataaaaatgcaccccggcctcccttcatccgtttcctcaactcgccgctccttcccgcgcctcctacctcccccagtctgccgagcccacgcctcgccacttgtgctggcagctccgctgcatcaagccctatcccagccgctgctccgctccaccaaactgccgcctaaacgctttcttccctgtgcacctgagccaccaccaacttacaccacctccagccgccagccactgccgccctagtggccgccgcgctgcgccaccgccgtcatcggcatcgctgtgccgagctccaccccggcagccgctcctctgcctccaaccaccaccaaaacacaaccccaccgcaaaacccacgccgccactgcccttgccgcctccgaccagcaatcatcgccgtcttagccgctgtcgtcgctcgccatcacctccgtcggcttcgccgtcgagtaccgcacctcggccacctcctggccctagtcatccaccgctggagtcctcttctccccgtcgaggtgagttttttccccgtcgccggcctccggccgctatttcccaccgccttgtgcctcccctttcccgtctaacccctcccttctcctcctcagctcgcggccgtgcctgtccgccccttcccaagcgccacccaccgtcgtgcacttggcgaggactcccacctccttttccttttcaccggccgcgctgcgctgccgctgcccacgtcatcgccgccggtggccgcgccgccgcgtgccgtcgctcggctgggctgtcctgagctgtgcccatgccatgccgtgcttgcccgtggccgcccgatcggccgccctcactaatctaggccatccacgtgttgccatggtgccaccccatgtcggtgccctcgtggcaccacgtcggccttcccgtctgccgtggtcaccacgtggccgccacatggtgtgcccgcggaccggtccaccgtgcacccgcttcccttgagccaccgacaggtggggcccgcttgccggtgccaccaattcccctcggtgacgtcataattcacattaattgtgcaaattatagaaattcatttaaaatgtctcaaaacttctaaaattcataactaattcatacgaactccatattgggccattcaacttgcaaaattcatctaaaaatgagctatacatgtttgtttactttttatgtactgtttacttggtttttattagagttttttctcattttgtgtgccagcgcgtagattccgccggttcagaagtttgctttcgcctcagataagagttcagaagattgttttgaagaagcaaggcaagtcacacattccccttaagcatttttagcctaatttataaatgttttatcgtttacaaataaatatgcatgtttttctaattacatgggaatatggtttacctattgttggctgttgttaaacaccgattctataccaccaacatctgcataaagttcaaataataaaacattcagcatagtgataggtgcttaatctcacatattccacaagtgttggtgtatatttgtatgcagatgataaaccctgaagttgaaaggaaaatcagactaaagtgagaagaaacatgtatccatacaaggatgggttgtgaaattcctcaaaatatcaaagactcagcccaaaactccgagaaatggataaaggaggaccaggggaggagatgggccgaaggccaggccaggtgggcccagcccaggttcgagcgaaccccttggttcggctgaaccaaaatctcagccgtttaggctggggtttggcgtggacggtcctggtcatctcctgatggcggttgctgggcatttctgacaattcgcattgtgtaagcgtcatacctacctctatataaggagcttcactctttcactctcacacacacttccaagcttgtgctgaattataagaggctctattgtactatattgtatactagaataggaagagattagagtagaagaagtcggatgaattctggagttgtcggtaatcttctctcatttctcttattctgtttattactctgaattcaatataatattcttcttgagtaatttagatttatctcgtgagaattatctcttggttagttcctaaatagcatacgagacaattgttcactatagttcatttatttatagtgattgctttagtgtttgattggcactagagtagttattaattgcgtagacgcggtgtctgggtaattaatcttcagtggttgctgcgtatcccatagtacatttgaggtaggtgtagaggtggtgacagccctagacactatttctctagacactgttaaacttaagtattgcgttaggattaaatttaagctttccctagacactgtttctcactagtaaatctactctatcctggcctatcatttgcttgctgtccttggatgaaccggaggaagatctgaccacatatgctcccttggattcgataccctttggaatactccgtaggggaagtgctacatcggtatatctgtgcccttgcggattttatctgtgatccaatttggaggtagttttgcaataatgcacccgaccacaaatttgtcgggtaagatacacttcaagagttcgagttctttagccagtactcacccagaagcatttcatagctgtcagccaaagagtgacccttatctgcaatctctaaaaatgcacaccggtgaatttatccggcctcagtgcattggcaaaaccagcttacgagcgacggcgcagcacagagtaggaggcaaacccaaaacaaacaaaactgaatttcccgtagcaaaacaaaactacaaaaggaggctgaatctgcgcaagggtgaggaaccaattttgcggaccattcgacgcgtacgttgtgcatgcgcgccacttgccctgcctggccaggcgaggcgagcgagcgcgcgcatgtgttccccctcttccctccacctcacatgcttcatgtagctaggagggtatcttcccttttaaggaggtccccctcttctagaataaacaaggtggtactaaactctctatgcatgccatcccatgagctggttttttgtgattttctaaagaattaatcttcgaatgggctaaggctcatctattaattccaataagtgcgagaccgcacggtctcgtggaatggaagagcgagaccgttcggtctcgctgaagcaatgagcgacactgtctaacggctccttttcattagtgattaattactcaattaacaattaactaataaaaaattagtgattaattatctgattagcgattaagtaataattaattaattactaatcagataattaatcactaattaaatcggcatgacacggtatcgctgttgcttccgcaagaccgaacagtctcgctcttccatttcggtctcgcgctttataccgcccgtgacgttgttcctgcgtcattttcacgtaattgttatgtgagaccgacattatatttctgtaaaaatttttgtatcccgaatatttctgagaaaaaatagaataaacagtatattttgaaatttgattcccagtgtttcagggattgtttagctagcttgctaccactttcatccttatgaatttttacatcaccagattttgctaggggaacaaaacatactcttgtcattatcaccataccaaaatttattatttctggtaattcttcttataaaacattgccggaatttggtaaagctacaaaccaagcatgaccaacgttaaaaaaatttggtaattacgctataatttaccaaaatttaccaatgcagatttcgaattttagcaagaggttcgttttggtgacaaactgaacaactactaccgcttgttgggcgagaatcctcttgctcggttgcccaatttgaagagaaaaaatgggcatacttgctacggcatgcatgcaagacgagtactaactagtttctttttctttttttctcatcactttaaatgttttttctcctaaactacctacccgatttatgatccgatcataccattgaatttgttgcaattaaatctttataataagatatcacatgattatattttcataaaataaaaatatatgttttagactgttaaaacttaatgtttcctgtgtagtaacgacatgtttcaaagtgtgcattcgctatatttcacagaatttattgaagtacttgccccaactctttctcctctctatctatgcatgcatgcatggatttagcaaccttcaaaatgagttttctcctaaactacttataatctatgatccgataataccgttgtattcgttataactaaatctttacaagaagatctcgtatgattatgttctaataaaaaaacatatatttcaatttgttaatactcactgtttcatacgtgatagcaacatatttcatcatatgtcttcactgtgtttcaaaaaaaagtttaaatattcgttataactaaatcttcacaacaaaatctcgcctgattatgttctgataaaaaaaagcatatgtttcagtttgttaatactcattgtttcatatgtgatagcaacatgtttcaacatatgtcttcactgtgtttcaaaaaaaagtttaaatgttgctgtgactgattttttttactatatataacttaatgtttcactggtagttaactgtaacataacatttgactgatggagtttttttttcccctactctccctcctctctatccatgcatggatgcatgaattcaaaatgaattttctcctaaactacttatctaatatactatccgataacactcttatattcgttgtaattaaatcttcacgacaagatatggcgtgattatgttctgatgtaaaaaaacatatgttttagtccgttaatacttaatgtttcatagcaacatgttaatttcaatgtgtgttttagctgtgtttaaaaaaaataaatgttctagtgactgttttttcatttcaccgtatataacttaatgtttcactggtggtcaaccgccgtatttgacaatatttgactaatgtttcactggtggtcaaccgccgtatttgacaatatttgacttaccgatttttttgagagggtcggacgcccgatttggaagtacctccctcgttgggtagtgctagccggtttttgaaccggtgctaatagcacgattctgcatttgtgtgacacctcattttctctagtgccactttaggtgtttatcctatctggtaagctatatttattgtcacggaacattgggaataccctaaaatcacacacacacacacacagcatatcttttatttgtgccatggtcacttttgttgacggaatttcccacatatctgtggattgtttctctgcatgtcgatcgaaatatgagtctagatcaactctcaagtgatgggggtaattactatccgcagtagttagcttttaatgatggggtaattgctatcagcagtatgccatatgataggaacggggttgcgggtataataattaatttcgcatcatgaattatatatatggccttgtcaagttgtcatcttcaagacttcaattacatataataagagtcacttcaataagtacctgtccgtcaaagtatattaaggactagatgagcttgaagaaaaagtaaagaatttagattggtataagattaatttttacgagtaccattcggtttgtagaaagaaagtatacgaaggatcctataaattagtttgtatagagaaaatataggattttttccatctaatcaaaccttttgaaaaaaaat

SEQ ID NO: 59081 - DNA, 6918 bp, Oryza sativa
caacaatttatatattttgaattttcagggtgtgacaattttcttgggggtcgtttaaaaattaaatttttggcttgggagaaaaacttcggggtgtgacagcctccctctagaaccgtgcagcccaactcaaccgacgagcgagccaacttacacataccactccacttttcgttctcgcttcgtataaaagggttaacccggaagtgatatggttgaagggaaaatgccttataaattggttccactcgtgctaaacttgcaaggtgatgctaaacatgcgcacacagctctcatgggctatacatgcctcatcctaattgagccaggatgtcacaatttttcgggcctggctaatgggcgatcgatcgcttatccccatccacccctatacactcctctcccccttcctcctccccttcttctcttccttctacaccataaatttaaaaaaaataaaaaaacagagttgggaaaatttatgtacaaacataatatatatatatatatatataatatttgaattcaaattcaaatttgaatcgggtatgtaaacttttgacttataaactttgggtttataaactttagatgtatagaaatactatatataaaaaataattgaattgaaattcaaatttgaatcggatatatttcaaattcaaatttgaatcgagtatataaacttttgacttataaactttgggtctataaactttaggtgtcatcggagcgggccaatttccttttgcccctcctatcacgccgcttagagcgggggacagactcgggggtagccgcagccaccgcgccggtgccgggggaattccaggcccatgcctcctccttccgagccaccttgtccgccagctggaagagctcggcggtggtcttggtctccttggagacaatcttctctagcatgcggttatgccgcacgccattctgaaacgcataaacgaccgcgtgggccggaatgcatggagtagtgttgccgacctggcagaagcgctatatgtacgagtggagggactcgtcgtccttccgctgcacagcgtgcaggtccgcctcttccccatgcgggcagctcggcgcttgtcccggcgtcgctcgatattgattcgagcgtcctgctccccgtagaggccatcatgacacctctgacttcccgaggcccccgacgatgttggagccgtggaccgccttgaggccgtggctgatcgacgggccctcctccttgccgacgaggagagggtaatggaagtacgcgacgtaccggtgatggcgggtcggccgcccgcggccagctgccgctgggcagtggtgaccaagttggccacatcatccaaccagcgctggacaggggtctccggctccaggttcacggggtgatgccgcagaagggcacccgccgcttgaagcgcgcctcggggtgagccgccgtcaccataagtgaggtggcgccgtgccccgacgcgttgtggcctccctccgcccgggggcggggagagggccgaaccatctgaccgagtggggtcctccctccgcgagggatcgtggcggggaggagttggagagttgtggcggcggtgacgagggccgcggctctcgctagcatcctcactcccagacggagtgggggtgtacaccaccgcctcctcctccaggacctcgactatgattgtcgagggccgagggaaacttggggcggaaggaaacgacttctctttaaagcgcgcgacctccccctacctggcgcgccagctgtcgaggagtgatcctctctagcgggagatcgtgagaccccccttttgtgagttcggctgggggaagaagctcgcctctggaaatcgtgtatccgtatccaaggcccctagctagcttgcacacagccaagttatacaggttcgggccgctatgaagcgtaatacctgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatatatgccccctagagggcctcctgcccaccttatataggatggggggcaggattacaagatagaaaccttaaccaatacggtatctgtttcctaaatcaggactttaggccattccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaagtgcatcgactagatgcacctaataggtgtaacccccgactatgtggttaatcgaacaaaccaaacatatagtcaaagaataaataatccaaccaaccgagtggttttgataattatagtcaaccaagcgacttaatattaatatgtagcatatgcggtgtgaatccctgaataatatgatccaagtgatataccgactgttttgtaaaatatgatgaatgtaacctaaagttggctacattattgaaaattcacatagcaaaacagctataaagaagcttgtatgttgtgaataaataaattcccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaaggcacacttacgtggcgaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttaagtaattgcggtataaaaggattttaaggtattgggcacttgatcacgcgcactttggcctaagcaaaaagtgcctaagtccctaaaagaacgtgacaggccacacctgaaaatatgggctgcagacatatcaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcagttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgacgacgtagacgcgcatcaacggtgatggcgaaatccaccaatcatgaagatgaagaaaataatcggcggcgacaaacgcatccgacggtaatgatgattagcagcaacagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagtcacttgttgtagtaaaataacatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagtcgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggcagcggcgaaggcaagccggtcggtgaagacgtagacgcccaacaacggcggcataaaggccagccgtgcaggcggaaacaccagtcggcggcggtgaaggcaagccggtcggtgaagacgtagacgcccaacagcggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttccccgagctgatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaagcggaggcaccaatcggcggtgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaat

SEQ ID NO: 59082 - DNA, 5888 bp, Oryza sativa
cgcctccttcgacggcgatgctgcagcaccagccaaagagacggtgccgcctgcctggcaactgtgcccgaggccagcgcccagtgaggtggccagcgtgaagagagctctgtcaagaaagcatggctcgttccggcgtcacccagccaccgctcgcgcccggcccctgtgtcgccccatgtctccgtgagagagagtgagtgaagagagagatagaggggaagggtaggtatgacatgtgggtcccaccatttttaaaaaagaaaatgttgactggattgccacgcgtacattacgtaggacaaaaccgctctaaattggctcgaggggggtaattcgtccggtattgaaagttcagagtgagtaatgtctggttttaaggttcaggggtaattccgtcgaccacgatagttggggggagggggttaatttgtactttttccttatcgggtaagctatctttattgtcatgaaacattaggaataccctaaaatctcagacacacatagcatatctttaatttgtgcgttggtcacttttgttgacggaatttcccatgtatctgtggattgttttctctgcatgtcgattgaaatatgagtctagctcaaatctcatgtgatgggggtaattactatccgcggtagttagtttttaatgataggggtgttagagcgaggctaataatatagccgatctgctggctataaggttttttttagcattctcttaatctacctatataatagttagctctttataattaatgcatgatccacttgtctctctcacagaatttcttggttctggtgttcaagctagctgtaagtttacagcccgcttctcctctctcttttctcttttctcttccagctcagcatttagccagcatttagcatttagtcagtatgccatatgataggaacagggttgtgggtataataattaatttcgtatcatgaattagctagttatatatatagtctttccaagttgtcatcttcaagacttcaattacatataataagagtattgaagtacctgtccgtcaaagtatattaaggattagatgggcttgaagaaaaaataaataatttcgattggtataagattaatttttacgagtatcattcggtttgtagaaacaaagtatatgaaaaggatcctataaattagtttgtactagaaaaatacctgtgcgttgtaatggatgaatgctattgtaatattattattattatctttatcgggtatgggtgaatgctactgtaatcttattatttttatacgttttagtttaggtaaaatttactgtggaaattcgcttggattttttttaagaaaatcatgagttgcaattaggagtccgactttcatctcaagttagcatgcagagttttttaaacaagattttttatatgactctttttgtatttttaaaagcaaattagcttaaaatccaacttaaacacttatctgtatttcgaaaagcgaatgaacttataaactgactcaaacacgaatgacgtaccaaaataccgacgaaaacatttaaaactggctcaaacacaaatgacgtaccaaaataccggtaaaattatttttaatttttataataatagagatagagaaaatatatgatttttccatctaatcaaaccttctgaaaaaaaccatatatatgtatatatatatatatatttatatatatttggcgaacgctttacatatatatatttattcgtcactttttctatttttatgcgcttaaattacttcaaaccgaatatacccaagaaggaagtcattaggtgatgcctagctagcttgcttcttgcccagcgaagattgcgcgcgagtgcatagtcacgtgttcgatcagcgtggctggcggatcggagtacagtacagataactaacctcgagaccttgaagacatgtacccaaaacatattttgctagtcattcaataaggaaatggactcactgcttttagtcaaattggtagctgtgccatctccctcaattcacaataaaaacaaaaaaacgcgacccgaggttatgatgcaattagtaaatctcggctcttcagcgtgtttaattaattgaagcccccataattaagcatccacgttgtccgctggttcagtcaaataaattttagaatgacctactgatataaggttggtcagtcaaaaataaaacgacaagcttagctgaaatttgtatgttttggcagttgacgaaagcgatgtgagaattaattactcacaaaaaatgtaaatttaacactacgcatcgatctgtctaccagctgttgtcagccctgttccgtggttcaatgatctggcagctgatcagcgcatgcgacaagactaatcgaaggcatgcatgccgtggagtgttcgaccctccttcttcctcctcttcttgttgttgttgaaacgggatcaattaatcatatataattaattaaccgttattcaattaaacgcattaaaattaaaaaatcgtaaaaataagtgcaatacattaaaagtggctaaaaatataatagaattttaaaaatcatatataattaaccgtggcctgattaagagcataaaaataaaaatcagaaaaatatgtaaaatacattctgtcgatgtttgagatcccgactacggtattttgtatagtaagaggatcgttggtaccagggtatatgcaagattgaagtaaaagatataaagataaggatttttatacaggttcgggccccttatctaacaggtaatagccctacaccagtataatatttaggattacctatctattcacttggcggcctgaaatatcatgacgtagtcgacaacggatagtcttcctcctcgaatccacactcggcgagatcagagatagcgctagatccctcttgttagcctccgtagacaccatattaggtttgtctaggcttatctctgatgttgatatccggcagcttgtcttgtcgtgcgttagcttgatctattgtatgtcgtgtcttgattttgttctttcctcccctcctcctaggggacctatttatacccataggtgtccccttgtccaagtataactaaagagaccaatatggatacaatccgagcagttgttatagtttccatatagaactctattcgtccttccctatctgcagctccttctatatatgaggtacgattccgtataagacttggtacatggtgggccctgccgagcttagtcaactactattaggtatgtggtatccataaccaaaagaggttaaaaattataataaattcttaaaaatcgtatataattaaccatgctcctattaagtccattaaagataaaagcaatcataaaaataaggagaatagattaaaaagaagttaaaaattataacaaaatttttaaatcatatataatcaaccgtaaggctagctaggataaataagaaaatcataaaaataaggagaatacattacgaataatttacatcgtccacacaccaacctaggataaataatttacataagacttgttgtattagtcacattatacaaccaatctcatagcgtgatggttgacacaaagtactttctccttatgaatgctccttcactgtgatcattgttgcgaataatttacataagtaagggatattctcatttgataagaggatgcttgggtcaaccgtcaccacgaacggaggttacccgtcaaacttatcgtaatcttcatctgtcttatcctcctttttccttgggagaaccatgtggcactttggcttgtcgagccctttccccttctttggtttgctacacatgtcctttacatagaaaacttgtgttacatcattggctaagatgaatggttcatctgagtacctaatgttgttaaggtcaattgttgtcatcccacactcatcaaccattacgcctccactagtcagcctaacccattggcaccgaaacggatgagaccttaaaatgtgttgcttttgccttccttgtccatggcatcgatacaaacaacgttgttttggttcatgctctttttgtcttgagctcttgtataaaatgtatacccattgatctcatatccttggaatgtcaagactaagcaaaatggtcccctcaccaaccaggctagttgttggtcaatcgtctcgtgtcagggttgtggatatataatgcatacctcttatccttggggtcgtgagatatatggatacagtataccctcaagtatatgggaaggtacctctgaattgaggaaatcggctgatcagtaaggaatcgtttctttgaatagaaggtgttagagtcctattcggaggagataaggatttttgtgatatcgtgtaaggacaggtatctccgagttctacttggacgacaagataatctgcggtacaaatagaggaccactagaggggggtaaggcatcgaatcttagcgtaagacacccaccatagcaaaaccaatccagaggacttgaagcaaactcaccgataggtcttgtcgagccattctcgacacgcatctcatcggtaatctcgggattctgttgttctctattgtactctgtggttttctttataagcccatataaactagattaaggctattacctcacgagagacctaaaccaatataatctttgttccatgtgtgcttgttgtcgtatcgtgtagattctcatatcaacgtaccccaataccctcagaatacggtccgcgggtatcatccgtcaatagtaagatcattttccatcaatcataaagaacgtactcggaatagtttcactgccaacagttaactccacatttaacacccatttagcatctaatgaattccctccaatagctgatgaagatacaactagctcggatataaccatgactaccttatgtattaatcaaccaaatgcgcatatgttctatattagatttacttgttatatatttgaacaaatgttgctacacaatgagttccatgtgttttcgcctgcagaggtacttgcttgggcgaaagaaaagtgaccgagcgtaaggaatgcatagatgattaaagaagttgattggggaccaaaccaagactttctccaagtccacttccatctcaccacttcactttttgtccatagaagacaagagataaagttctacacattttggatttggattcaggcctcctgatagcatcaacttcaaacggatcgagccgctgaaatagtaggaattttggaagcgatgagtacttgttgtaaagcttatggagtctactttcagatggttttgatcccacatcaaaattcctacctagctgctgggaatctacaaaacaagccatgtacctcatccagtccgaatctgatttgggtttttgtcttctaattatgtgtcacatcttgattttcgtttcaggatttataaattatttaataaattaataatagaatttatattaaatgatctttaatttacaagtgaagtaaaatgtgggaaataaaatttcctaaatataaagcatggatggatttaattttttattaaattctccatgattaagtaaactctctgaaattttctcggattttttggagctcaattcctaaatgatacaaagaacagttcagtaattatttgattattaatgatctaattatatttggtaagagcttttcttggttaagatccttaaattataaattgttgtttaaaaggaattattagaaatgattttaaaagcctaaaagagaagatctaattttaatttgttaaatttcaatataaaattgggctagataaaattttattaaatactttgcttaattctataattcctagatttttctgggatttatttgagctaaggaa

SEQ ID NO: 59083 - DNA, 4970 bp, Oryza sativa
aatcccggccatctcgggcgcgggcgcgggcgggagagagaggggagtgggcgcggggaacgcggcgcacgcgtgggcgtggtcgacgtggcccggaggaggcggaggcgtgggcgcggcggcggttgcgggcgcggcgccggctggaggagggagacgggcctgacaggtgggccccacctgtcggcgaccccgagagaggagggaggcgggacggcctggatgggcctcggcctgcggccggcccaacagggaggagggggaggaaaggagagaatgggccagcggcccattcgaaaaaaaaggaggaaaaagggaggaaaaaagaaaaagaaaaaggaaaaaggattttcccctggaattaaaatattgcttgctcaattttaaatggttaaaattatttctagagttctgaaaattccactaaaaatcctgttagtgaatttcgacatgtagaactcaagaaaaattccacatgccaaatccgattattatttgcattactttcttagggttttctcttgatttgcacctgcatttttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatagcataatagggtttcatttgcaaaagcagcatttagcaaacatttgagtatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggtcggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgagaactatcaataagccatcatgaaataatagtgagtcattagttatcccataagtgtactaatgtttctaagcagggctaagcaattgtatctaatatctagttgaaccaatataaataaagctcaactagtcaaattataataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagatatgaatttttaaagattaaaccggattaaaacacttaaatcggtttaaaattgaattatgacgcaataatgaattatttttgaaaaggaaaaggggatttattgcgtcagcgggctagggtttgggtggaccggcgcacgggcggcggttcacacgaacggacggccgagatttaaccgatccaagatggacggccgagatcgatcgggtccacggcggctcacgggagaggactcggatgacgtcagcggtgacgtcaccgacggcggcggcggctcggcagctgggacggctcgggcggcgcacgctcaccggcgaacggcggcgcttcggcacaaacggaggacaccaacgggtagcggacggcacggcgaactcaccgacgaccaaggcgacggcggacgaccaacggacggcgacggcgacgaggaggaagcggcgggaaccttcgggtcgacgacggcgaagctgctccggtgatctccggcgacggcgaaggggcggacgaggacggcgacgacttggcgagcacgacggcggccttcccgagcgacggcgacggctggaacgacggcggcgcacggctggagcggcggcggcgaaggcaaagctagggcacacggcgctagggctactccggcgacgagaggcgaaggcgagggtggcggcggaaagagaagagcacggggatccttttaaaggggctcggaggcgacggcggaggcccacggcgacggcaacggcgaaggaaactcgcggctcggagagagggaacccgatccgaatcgaacttgattccaacgctttccaaagcgatttagccgatgattccaaagagaaaaagatagaggagatcccggagattgtttcccctcaaccaattcggccggagaaggaaagaggcggccggatttggaaggaaacagcggcggcggctcggcggcggcgcgctagggtttcggcccgaggaagacgacgggcctgacaggtgggacccacctgtcagcggctgcgagggcgcgcgcgcgggcggctgcggactgggccggctgggccgaggagagagagaaggcggttttgggccgactttcggcccaaagccaaaagaagactttttaaaactttttcaatttaaattatttcttaaatgcaattccatttattaaaaatactttcttagctcaaataaatcccagaaaaatctaggaattatagaattaagcaaagtatttaatgaaattttatctggccactttttatattggaatttattaattaaacatagattttcttttcaatacttttaaaattatttctaaaaattccatttaaacaacaatttatatattttgaattttcagggtgtgacaaacctaccccccttaaacagaatctcgtcctcgagattcagaagaactggcgaacaggtgcggatgagctgacttcaattcatcttctcgttcccaagttgattcttcttccgagtgattactccactggactttgcaaaaacggataactcgattcctggtccttctctcacttgtttccaagatacggatcggtttctccacataggtcaaatcctcttggacttctatctgttcaagattagcttcttcggtaggtacccttaaacacttcttcaattgcgacacatggaacacattatggactcctgccaaagattgaggtaactctaactgataagcaacctctcctcttctactgacaatcttataaggtccccaaaacgcggtgccaattttcccttggtatgacaacgatgaactcctcgaaaaggcgtgacacgaagatacacataatctccctcttcaaaactcaaatctctgcggcgattggggcataactcttatgtcgagagtgagccacacgcaatctttcttgaatgatctttaccttttcttctgcttcccttaggatatccgttccgaaaacctgacgttctcccgtctgatcccacaaaagcggagtgcggcacttccgaccatacagtgcttcgtaaggagccatctgtagactagcttgataactgttgttatacgaaaattctgcatagggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagcttcttccaaaaatttgaagtaaactgactgcctcgatcagacactattttcttagggatgccatgcaaacacacaatccttgccatatacaattccgccaaccgacttccggaataggttgtttttactgggatgaaatgagccactttggtaagtctgtcgactatcacccaaatagagtcatggcctgatgacgttctgggtaaaccagtgataaaatccataccgatttcttcccatttccattcaggaatcttcaaaggctgcaacaaaccggcggttttctgatgttctgccttgacttgctgacaaacatcacatactgccacgtattctgcgatttcacgcttcatacttgcccatcaaaacctttccttgagatcctggtacattttggtactaccagggtgaatggagtataatgtatcatgagcttctttcaaaattgcatcttttaaatctttgttgtcgggaacgcagattctctcgcccaaccatacagttccttgctcatcttccaagaaaccgatagcttttcctcttctcatattcttcttgatt

SEQ ID NO: 59084 - DNA, 40633 bp, Oryza sativa
tcatcctaaccattacaagcaaaatattgtatgaagaagggcgaacatgcagattgctaagctggcacgtggtggacaagaatgaccgatttgtgaccggtctgagactggtcatgtcgtcagcagacagccatgttcccacgtcgcgcctgcttccggcggaagtggaggtaggtatgggccgtcccatcagaaggtcattcggacggcagccatacatagctccgtccatttatgaagagaaagcaagtcaagtttgagaaaagggaggataagtccccacacaaaagagagagatggtgcatgtggtatccccttggtataaaaggaggaccttgcccacttagaagggggattgatgggagattcagcaggagagaggttgggattcgggaccagagagggagagagttagagttctctggttctccagctctttgtagcttcttcatacacagattcaccaaaacacaggagtagggtattacgcttctcagcggcccgaacctgtatacatcgcccgtgtcttgtgtgtttccactctcgcgaaccttccacagaccaagagcttagaatctcacccagggcccccggccgaaccggcaaaggggggcctgcgcggtctcccggtgaggagcctcacgctccgtcatcatgtgtcttcttggcaccaaaatgtcccatcaaaccgcctccatgcgcttcctgcaacaacaacaagcgaacggagctagctggaatgcatagcttgttagctctgaaaacaaacccatcattgatgacgaatttgttccatgttcttccatccttacaatgcagcaacacatcattaaaatcagcatcatgcgcatattggtctttgattgtttccaggccaaaaatcttgtagtcaagttgtgtcaacaaagtgtatctcctagacaaagcatcagcaatgatgttctccttccctttcttgtgtttgataacataaggaaaagattcaataaattcaacccatttagcatgtctacggttcagcttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaagaaactcgatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaatgtgctgggtgcattagttaaaccaaaaggcatcactaaccactcatacaacccaaacttcgttttaaatgctgtttttcattcatcacccaacttcatacgaatctggtggtaaccactacgcaaatcaactttggagaacacaatagagccactcaattcatcaagcatatcatctaacctaggaataggatgacgatatcgaatggtaatgctattaatagctctacaatcaacacacatacgccatgaaccatctttctttggtaccaaaattaccggaaccgcacatggactaagagactcgcgaacataccctttatcaagcaactcatgaacttgacgctgaatctccttggtttcctcagggttggttcggtatggcgcacggttcggtagggaagcacctgggatcaagtcgatttgatgctcaatgccgcgcaccggtggcagccccggtggcacttccttgggaaacacatcagagtactcctgcaaaatgttagcaacagtagggggcaaagaatggtgcatatcgtgaagtgaaatcaaagcatctttgcataccaaagcataggcaactgaaggtgatgcaatcaactcattaatatcagatttagtagcaagtaagcatttgggtttcaaattgattgtctcaggtttcttgccatcagattgggcttttttatcactctcacatttggatttggcagccttagcaacatcatcacgcaaaatatcttcaggagacatgggatgcaacacaattttcttatcatggtacagaaaagagtactggttggacctaccatgatgcatagaatccctatcaaattgccatggtctacctagcagaatattacatgcttgcatgggcacaacatcacattcgacaacatcatggtaatttccaattgcaaaattatgtgcaccagttttgttaccttcgccttaccactgttgttcagccattggatgtagtatggatgtgggtgcggtttggtgctaagtgcaagcttctccaccatctcgctgctagccaagttgttgcagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgtgctcttcaggtggctcattatctgcatggtcagccgcaagcaaagcaagtgtatcatcatcaaaatcactagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgctggctgagcagcctttgtcgctgacttgtcactagatggaggaggtgctgctcgactagttgtgggtgtggaagatggagaagcagtacggccggccggaggagtggtgcgtgtctgccatgatgaagttttacttgcagaaaaattagccttggcactagcacgtcgtccctgcacttccctttcagccttacaagcaagatgaaacaatcgggtcatattagtgtaatctttatagtctatgatgtcataaatctcgcggtttaacctacccaaaaatctagccatggcagcgtcctcagtttcctctaaattacaacgaagcaagcccatttgtaactcctgataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgctctcaggaaactcatggcatgcaaatttttggtcaacagcaatctcccaagagaggtacgcatcaggatcatattttccatcaaaaggaggaatcttaaatttaattttagaaaaagcatcatcattgttgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcgtcattacccccaccattgcctccagcattgagagcatcaaaatgccgcacaagagcagcaaggctagtgtcaatgcgggcgaccgctgtctccagccctgtaagcttagtgatggtggagatctgcgtggactccaattgtccaatcttctcatttgtcacctacaaatctgtatcaagtccttccgtgtgctgcttcacttgccttgtaaagtattggatgatgcctttggtgcgtggggaatgagatgcaccctcctcatctttatcctttggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacaccacaagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtggaaggtggtgacaaagggggaatggtgtggtgtgctcgctggatcctcttttttttttttgcttgctctctctagtgctgaggagagaggcacaactttttttttattttttttattatttttttgatatttttttcacaactaggagcacactagaaccaaccacagaaaatcttatctcaaacggacaaagtatgaagcttgtagaattttttcaaagttctatgcgaataggtcccgaagcttctcgccacaaaaacagaattttgcaagaggaatttggcgattttaaatttgctgaacccggatgtaactttttttgtagatgtccgtggatatattataagcctaatttcgagtccgtatgaaaaagatatgactgttttaaggaaggtcactcgaatcagggttctatttcctttctagtggcggcaggatacaaggcaactcacaaaagctatcggcaacagatcaaacacaaatagaaagtgatttggtgggtgactgcgacagtggtgacggtggtgatgacggcaaaattgatgaaggtggcgatgtgcggtggtggcaagaactcgaaactctaatcgcctaacactaagaccagcaaattaacacaaccgatgcaatcgaaaactcaacaagccttaactaagcagtactagtaaaaaggcacaatggtctataggatcacggaaaaactaatctactatttttttttgttggtcttttctggactataggaaaaaaaattaatgacgaagggaagggtaaattctctcaccgatgaaccacgctctgataccacctgatgcaaacccgctagggtttgtggcccgatctttcgatgagaggtaagggataactcgattagatgaagtcgacgttcacggcccgactacaactgtccaaagacgctgcgccttagcaaccgatacactgtctccaatggtcgccacgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctacctctatcatcaaaacccgcctgttcttagcggcgactagaggtataaaaagaggggaagaacgaccatagggtcgtgctccaaccctaggacgcgcccctaatgggcccaacatggatacacagcccattgggccaaaagaggtgacgcagcaccatggacagaaaatagtcgggagtaaaatgataattgcggccgctccagaacagatatggacatgtagctggatccattcgaaagtagacttgataagctttccatgaagtacttgcacgcccaaatcggagttcgcatgaagtcgtggcggccgtcagaagttagcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaggacttttagaaagtaaaaaatgaacccgaacaataattgtgttcgatttttaaaatcccaataacaataaagagaaaaaacagtggacggtccatagaggagtataatggcagcgtttgacgagacttctagaaattataaaaacgaaacccaacgagataataaactgtaaaaactataagatccaatttttgaagataccaaggagaatgactaatagtggtagatcgagcaagcaaataaagaaggatatgaaaaagtaagtggtagtaaccagtatgacttttaaaaactatttaattagaaatacagagatgataaggtttgttctttcaaagtcttgagacaacaagatagctatttaataaattttaagtaaaatcatactgaaaattatatgattttgtttggacgctagccgcgcaattgcgcgggccacccagctaatttataaaatatagcaaaaaaaattacgggtgtggagaaaaaaagaaagattttccggaaaaaaaaagaaacagccgcatgtgcgcgctcgctagaaaaaaaacgaaaaaaaaaaagaaaagagaacgaagcgatgggggtaagtgggccgcgtgcgagcatggccagaaacacgcgcgagtaaagttgacagcacggacgcgctaattagcaatttggaagatccatggcctcgctgcccctccatcaacagctgaaggagagccttaaacccaaaaagcccaccaacctctgcgtccccgtcgccggcgaccaccaccatgcacgccgccgccgcagccgccaccgcggggatcatctcgccgcctacacctcgtctcctccgcgcgaacaccagggccaccttcgtctccttcccgcggcgatcgcctcccacgacctccctcctctcggcctcgtccgccctggcccccgccccgccgtcggccaaccccaagtaccacaacgcgaaggtggacgagggcgacgaggaggtggacggggaggagctgttgcagaggttcaggcgggaggtggcgcgcgccggcgtcatggaggagatcaggtggcggcggaggcacgaggacgcccgggacaagcgcaagcgcaaggcccgctccgccggccggaggtttcgccggaggtgaggccctcgtcgatccatcggtcgattgcttccatgatcctgcctagattgtgccgatcaaagatgatccttccttttccttttgctcttccccctttcgttaatctgcagccttctactatcttggtgatccatttcatttgcttaccgttttaggtgctaattaatcatgcaatttccgtcagcttcgtgaagccaccttcgatctgttctaatattgggcatgctgcatcggaaaaactacaagcatacgttgtttgtgctccattttaggccgctttgatatttcagcgaccaattcacttattacatgaaagcttcgtaccaatactgcctcttcagcggcgaatttttatctcacattagatcgctataatacattgggcttatgtgaatatcattagcatttcagctctctgatggtactgactgccatgttcttctgaatgtggtcattggactgtactggtcatcttgtaaattcattgtcattagcattttagttctgattggaagcaaattgaaattatgagataatcctcttttcttatcaagagagatgagctcttatgtttttgttccaataccactagtagttcttttctttttgatgattgcattgcttctgtcctagctttcaatacattgatcctattctgagcaccatgaattcatcatggccacgttcattaccatgtcgagataaggagctgccatattcatcatcgattgtacattagttatgctggtgatggattgattcaatgaaaaattgtgaatgatgtaaagttgtggatttgggaacatttgattttttgtggattgaatctgattggagggatcgatcagggccgatgggaagctgtcgctggttgaggagcggcgtcagctgtgaattttttttagcgctaaaaaagtgcagtcggacggtgtaaacttagtcccgtgtgaaaatcaattttagtgcaacaattgaggtatactacctctatatgacgtattacgtcatctagaaaaagaacagaggggagtatataaaagagtaacactagcccttggatcaatgtgcaatggagggtgtaaactatatacttttggtttgccataaaaaaatcctgatgataatcatagccaatttattcggttgtgtgttttctcttcggtctccacacaccacacacatgcatgcactgggacaatcgacaacattttatatggattaagagctcacgtacgtgaaatcagcaacattaaggtgctggtgcatctagcgtgcttgcgcacagtgagtggtcatggtgaccttattggaaatcaaacaactcatcattcgaagatatatatactggatcaaagtaaacagacagacaaataatagaacaaattaaataaaacaataagcatacatatacggtggttgatgtggccatggcatgttgttcggttagctggctagggtgccctagctaggggcgcttgagagagaggattgccttgaagatccccacaatcacgcggcgaggtgaaggtgagaagcggcagcggcgcgaggaagaagactggagggtgaggggtggccactctggccatctccttcttggattcggtgtgggagaagggagttggaggcgcaggaggccggcggaggcggtcggcgagtaagacggtagccagcggaggtggttgtggccagcaaaggtatttgggcggcgaattgaggtgcaggtggccagtggaggcgagcaaggcgatggctggcgaaggtgctatcgaggtggagttggctattgaggtggctggagaagctgttggccggcggggttttagtggtgatggttatggccggtggtattgccacttggagaggtcgtcgttgggttggtcggttggttgctgacgtggttcgttcgtttggaaagctgcaggacacggtgaacaacagtgttgtcggtggcttgatcaccaacaagtgtacctccaagtttatctagggctcctcccgtttcctagagctcctcccctcctgttgaccgttctgctttcagattccggtcgtggggagttccatggcgaggggcggggagctagctttggttggtagatttgcttggagttcgagagcctcaacactaccagcgctttgtttttcttgcgtcggtgaggtgcctggttcggtggagttggtgcatgagacctctgcgacgcaacctgttgatggtgtttggggtggagtcggagctgcatgcttggccgggtgtggcaagctggtcaacgataacccccttgctccttccttttggtagtttcgttggggttactatgcagttggcttcctagtgtctttgggtaggtgtgttgggggaaatcggagctgcttgtcggtgataagctcggcaacgataaccctcccctgctttctatggtagcgctgtggtagccagggttgtcgtatttggcagggagagcgagccggggcgaatgtcctgctcgatcttgggctagagccaatgatggcgacgcctgtgggcgccgttttccttcttgaaggcatcgtttctgtgctctactcatttcttcgggtgaaaaccttgctccgattttcggacggacgttgtttgcgtttcgacgctatcttcctccttggaggcttcgtcttgaagaccctgccctacgcttgtctgtggtctgttcataggaagtcggagctgctcttgggagcttggcaacgatggcctatgttttatcctctagttgtgccgtcgcaagttcttttttttttgttctccgtgtgggttttgcccggctttccccttcaaaccgtgcttatgtgaggtttctgtgcccggtttccctcaaaaattgggccaagtctcttcttcttaaatgaaagcaggctcttcctgtcctcttctgaggtttttcctcaaaaaaaaaaaggacaaattcatatagatagaaataattgttgcaacgtacagctagcaagaaataattgttgcaacgtacagctagcaagctctgatctgctactcttgggatgtttatcactactgctggtgttgcttgatagacatgagtgttttgaagatgccgacgagaacgccgattatggagaacaccgtgacgatggtcttcaagttgttgtagatgaacttgtgtatagggatccatatccacctcttacgcctgtatgcttcaagattgtccaataaatagcagtgctgaaaaggaatgggaattagatcgacaaggttcttgaagaatacgagtgtgtgctggttgctgaaatcaccatgtaggatacgcttcactcgcagctcgtgcacgtcttcctcccggctcatcagcatcgcgaggagggatacgtaagagcagacagtgtcttcaccatccatgccagtagaggccatgccagtagaggccgagaaaatctcgagtgccatcatattgatgagccagcatgcattttggtcgtccatgacgagaggtgccatgaagagcttgccgaacaaggcacctttgctgatgctcatgtcattaaaccatgttttcttgttggctaccaggttgatgcccatttctgcaagctcgatggcgctgctagtctgtgatattgaagtaattccttcagggggttcgagggccatgcttccattaggcatgctcagccctgattggtagtaccgaaggaagccaaggagatgtgatggtgtgtagctttcatccaagacgaatgatcacttttctaaatctgtgtaggcatcaaaactggtgctttcttgagagatgaactctcccacgggaacagacctaaaggtcatgagggcatccagcaccacccatgggagctggttctctagcagaaagatgtccctctccatgctagcatcgttggagttgaaccaactttctaatgatggagcaatgtcgtcagttgagcaaatgatatactggagaaagaagcaaccatcatggaacataatagccgcaaagtcaccttcgcctatgcttgccaccgtgtcatcatccacatagcagcttcgggcttcggctacaaccaagaggattctctggtagacctcctcaaccgagtggcctgactccccgcagaagtagtaggcggccgcacgcttgacctcctctgcctccttgaggtggggtgcgccatggtggtaaggaccgatggctacagctcttgggacgaagtagcggtcatctgtgctaattaagcttcgaaaaattgaagggtacctgtggatcttggttttgatcttggagaagttattctccatcttttcggctgctcttttcagctcctcttcgaccggaatcgctacggcttctgcagcggccgtggccatcgccgttggctgctcggcagtttccagtggttggacctaatcgctgctaggagtagctgagagttcttccatttgtggatttgctgtcatgctatgtattcctgctacagcctatactcaactcaaaacatgcgagcaattggtggtgaaacaatgaagtttaaggagatgaaagatcccatctcaaccaacaaatatagaataggttggtagatgatgcatgtggctaaatatagaagtacatttgccaatcaatttgcttttgattatattagagagtacattagctagaagtagtgttccaaatctggtgtcacaagaacatgtaatgatacaagttgttaggaatctaattcgccaaattcaaacaatgaagttcacagtacaagttggtggtggaattgagatgaaggagctaaaaaatgggcaattttaccatcattgagaagatgtctagaggtactatattttctagtgtaaaatttagtacctctaggtactaagtacatcaaggtactaaaattagtaaaatttagtacctctaggtactaagtacatcaaggtactaaaaattttagtgtaaaattttggtacctcaaggtacttttttaaggattgttaaattcctcaattaacaatcagatatatgatgtttgttacggtccagcatatggtatctccaggtactggtaccttcaggtaccaaatgaaatctagccgttcaattaccatgggcatgattggaaacaacggagcggcgatttactcgccctcacgcgccgacgctgctatctcctagcccccctcactcgccaactcctcatgcgtcagcagcgtcgcagtctttgaaactctgaccgtcgccgccgccgcccccatccccgccgccaccggcgccaagcgtagaaaccgccgccaccacctaccgcaaaagcccaagagttcatctacctggcgctgcctccagttctgcctcatgttcaagatagcgatgaaatataaccaaaatcttcaaaaggcagccaccagttctccattgaggaaataatggttggggtttcgaacgcataatctgcaagcctaaccctagcttgtagccaatagaccatcccgtaatgaagtgacctaattacaaagccaatttatttatctgaacgaatattgttgaaagggaatttgttgttttatcaaaggctcaaattatggatatgtacaatagaaacacattgcaagtagtttaatgacctccgatcttgaggacagtgacaacgttggacttggaactgttgctggtgaacccatggacatgagcagtcgccgagggttttcctgtcgccggtgaagaaggggatgtgccgttgcaggactgcatctccagccatatgctcgttactcgtcgtggccgaggtcatcgctgtccggggcaaagaagccaaggccctcccacctaagtctccaaacgagtggcaccaccctctggccagaggaagagagacttcgggacgacgcaaccacgctgggaaagaggaacttggcccggtggagatggcgcggagcacctgcagggaaggcagtggtcggcgaggatttcatcgacagcctgcaggtaaagctccttccgtcgcagggggtaggttggaggtcggagacgtgtgctcgccgtcggcggcggcgcttcgagtgaggtgtgacggcgctgggggaaggaagaggaaaagccgaagctttttgacgcgataagaccattgtaccctttcagggcgctttggatgctcggtacctcacggacggagtggtggtaccaccatgtacctattgttttggaccgtcggattacacatactgaacggtcacgagttggtaccgaggccctctgctggacggtaaaaaaactccagatgagcctgacgatgatcttgagattgtggtagaagaacttgtgcacggcgatgaacacccttttatcgtgcttgtaggcttctatcttttgtatcgccgcgaagtagcgggagccgaggcggaggtgccttgcgaggcccttgaagaaggcgagcatttcctgatcactaaaaaagctgtcgacgatgtgcctggctcgcagctcgtgcacgtcctcttccttgtccatcagcatcgccaggagcgagaggtaggagctgacgacgaagccatcgcgaggatactccttactgcaacaagcctcgagcgccaccatgttgaccagccagcaagcgatggaatcatttaggaacaagggcgtcagggaaagctcaccgaagagggggagcacttttctgctgctgaggttcatgtcggcgatcgaaccatgcgttcctgcttggggtcagctgcgctaatggacagtcttgtgtcgtggtcgtcgtcgtcatcgtcactaaacccaagctctagatgatcagttggcatgccatcgattaggtgtgatctggcgaggcctagcaaatgcgggacggagctcttcacgataacatctctgtcagtaataagaagacgacgctctctggcaacatagatcggatcagatatcacggctgtaagaaacatgtgtacatctataggactgatgatactcatgagggcatccagcactagccatggaatctggttctccaacagcacaatgtctctctggatgcatggccccgtcgacaaaaccatccggttttccaacagagaacaatcattatcgaggaccatatacttcagaaggaagcagccatccaggaacatcatctccgcgaactcgtcgtcgctgaactgagcgacggcgtcgtcgtcgttgtcgtagcagccgtgggcctcgccggcgacggcgaggaccttgccgtagacttcctcaaccgagcggccccacttcatgcacaagtagtgtgccgttgcgtacttcagctcctccgtcttttgcaggtgaggctcgccatggtggtacggacccagggcaacgaaggttgggacgatgtagcggtcgccttcacccccgatccatcttcttaggccttgtggaaacctatggatctttctctcattcttgcagaaatcagcctcaagcctctcaaatgtcaccctctcttggataggcggtattattgtcccctctaccgtgggatctatctatctattatatctattatattattaattaaaggaatagaaaaagaagcctgcatgttcgctcttatggcctagaaattctcacattaatcggagaaaaagaaaaaacagagtccatataaaaatatagttaggaaataactgaaattcggaattaaaaataagaaatattagaaatagagtatagagtctatatagaaatacaattaggaaataatataaatttggaattaaaaataaggaatattagaagtagagtatagagtccatatagaaatacaattaagaaaaaaaaatagaaattcggaattaaaaaataaggaatattagaagtagtgtatagagtccatataggaatttaaaactaactaaaatttggaataaacataataaaattaaaagtagaatttagagtccgtataaaagtacaatttacaaataactaaaatttgaaattaagaaaaacatgggaagaagagtttaaggtcaatataggaatacaaatataggaatacaatttagaagtaactgaaattcgaaattaaaaattaaagaatattgaaagatgagtttagagtccacatagaaatacaattagaaataataaaaattcagaaataaaaataaataatattggaagaagagcatagattctatatagaaatacaatttacagaaaattcggagttaaaaatatgaaatattaaaagacaaggctagagtccatataggaatatatataatttacaaataactaaaatttgatattaaaaataattaataactaacacatatataaatataatataaaaattcagaaataaaaataaataatattggaagaagagcataaagtctatatagaaatacaatttacaaaaaaatcggaattaaatttttttaaaagacgagtctaaagtccatataggaatatatataatttacaaataactaaaatttgatattaaaaataattaataactaacatgtatataaaatataatatgaatattacacattagtagttttgtaaagttattgcaaaatttaaaattatgttgtcattttaatatatttgaataatataatgagaaaacatatatgctattacatgagagaaaatataatgatgctagccgcgcaatctgcgagggccactatgctagttattattaaaggaatagaaaatagagccttcacggccgctctcatggcctagaaattctcatattaatcggagaaaaataaaaagcagagtccatatacaaatacaatttagaaatagctgaaattcggaattaaaaaataaggaatattagaataggagactagagtacatatagaaatacaatttagaaataattgaaattcggaattaaaaaataaagaatattagaagaggagactagagtccatatagaaatacaattaggaaataactgaaattcgtaattaaaaataaggaatattagaagtagagtatatagtccatataggaatacaatttagaagtaactgaaattcgaaattaaaaaattaaagaatattgaaagatgagtttaaagtccacatagaaatacaattagaaataataaaaattcagaaataaaaataaataatattggaagaagagcatagagtctatatagaactacaatttacagaaaattcggaattaaaaaaataaatattaaaagacgagtctagagtccagataggaatatatataatttacgaataactaaaatttgatattaaaaataattaataactagcacatatataaaatataatatgaatattacacattagtagttttataaagttagtgcaaaatttaaaattatgttgtcattttaatatatttgaataatataatgagaaaacatatatgctattatatgagagaaaatataatgatgctagccgtgcaatatgcgcggaccaccatgcttgttattaatataactcctagtaatgttcatggtggcgccaatacacgtaaatgcgcgcgcgatgcaggattgttgcaagggaatggctaggttttaatttgtttggctaattgattcactcgctgcacacgcccatatatatactgaccattgcccccaactcggaaatgtacagatgtgtggtctcatttgcttgagtactaggacaaatatatatatatatatatatatatatatatatagtcgatggtggtcttaaagaactgtctatgaaaaattgcgagattgctacctggcgatcgatcgtcaggggcgatcagatttcctccacctggtttgcttttttgataccgcatgtattacttttctattttagtaaatttatgcacctaaagtttgtacacctcaagtttacatatctaaagtttagagacccaaagtttataaatcaaaagcttatatatccgattcaaatttgaatttgaattcaaatattttatatatatagtatttctatacatctaaagtttatacacctaaattttatagacccaaattttataagtcaaaagtttatatactcgattcaaatttgaatttgaattcaaatattatatatatatatatatatatagtatgtttgtacataaattttcccaactctgtttttttttttttaaatttacggtgtagaaggaagagaaggggaggaggaagggggagaggagtgtataggggtggatggggataagcgatcgatcgcccattagccaggcctgaaaaattgtgacatcctggcacaattaggatgaggcatgtatagcccatgagagctgtgtgcgcatgtttagcatcaccttgcaagtttagcacgagtggaaccaatttataaggcatcttcccttcaaccatattacttccgggttaacccttttatacgaagcgagaacgaaaagtggattggtatgtgtaagttggctcgctcgtcggttgagctgggctgcacagttctggagggaggcctatcacaacaatgcattttggcaaatggtttcttcacggtgattacaattttgtttcgaaaataaccccccacccccctctccccggccctaggcaagcaaatatctcagccaaaagttttcggtttttttccaacttttttgaatttggtcaaagtttattcaaatttagtcaaaataaaatttgctaaaatttcaaataattccgtgcaaaaaaaagtatgacaattcctgaaatcttcggaaattttgttctcccacctgtctataatataaatagcttattttctcagaccgtactactggcgtctcggtaaacctccatttaaaatgggggttatttaccagcctcaatttgtcatcgacccgtatcgtattatagtggtcctcatgtgtttttcttgaaaaagaagtgattgttaattgcttcgagcacaattccggatctttatccagcattaattccttccctaaaagtctttccatatgttttgttctaccttagcttcatcttgtagccatcaccgtgcccctctttgatagtagtcttctttaacaattcccggcctaaacttcaacatatgaatgctgttatttttttaatatttttgataactatttcgatgattttttaaataaataagggacaccatccgaacagtttccccaacatgcactacatattcagcattttcttactcgagtgtttgtttcagggctttccccctccttaaatttttgtgatcgatcgatccatactttagtggtcctcgtgtgtattctcgaaaagagaaaaggaggaggttattttttttccttttgcgaaggataaaagaggggattgctatttgcttggagctcaatccagatcttcaagcagactgcagcattataccttcccgaaagtctcttcatatgttttgctccatcacttctattacctccgttatatgttatatattataagttgtttggatttttttttcttgtcaaactctataattttatagaaaaaatacataaatacttttcgtccaaacatattataaaatatatttaatattacatttaatgaaatttagtgttgtagaaattgctaaatttttctataaatttagtcgaatctattgaagtttgactagaaaaaaaatccaaacaacttataatatcaaacggagggagtatttgctaccagtagtcttctttttacaattccggcgtgaaatccacaaaagttagcatcaacgaaacaaaagcgtcttcagcaaatttaaacaggctgtatagtgttctttctttcaaaaaaggaaaaaaagaaaataaaagaaaaggttctgcaagagtaaagcaacaaagttaaaggaaaacgtacaccgaagatctctcaacttgtcatcaagttacaaaatcgttcttgaaccgcaaaaccaaatacagcggataacccaacttacgaaaccaggacaaactaagtcccttggcggttttgactctggttttgcctaatgtggcagctcagcatggtacccacgtgaccccacacgtcagcctcttctttccctcccctctccatgtttcttcctcgctcctcttcgctctcctcccctcttctctgtatctatccgcgtcacaaagccggcgggatggagcggggcggcggcggcgggcggagtggggcgacggcgaggcgtagcagtggcgcacgaagccggcgaggcggtggtgggctggggaaggcaggtggaatggggtgacggcaggtagggcggagcggagtagcggtgagcggagcagccaagcggagtgggacgacggcgcgcgaagccgacggtgggcggaccaggtaggtgaagaggggcgacggtgggcagagcggcagcgctcgaagccgacgacgtggagcgaggcggtggtgggcggagtagataggcctgcaaggcggtggcacgcgaagctggcggcgcggagcggggcagtggtggacaacgacgatgatggcgacgggttcgaggagaaggaggaggacgcgcgccacatcttgctcttccgcgtctcctccatctttgcgccgcccttcgaccttgatggcgtccttgccatgggcggcggctctccacgctatcccctcgccatgggcagaagaagtgcgacccacccccgcgcgcagctactcccccaccacttgcgtgccgctccttcaccggcagaggctcgcgcacagctcctctctcgccgcctacccggtgttgtacctcatgacgtcggacacccatctacccatcaatgacatgctgcgcacaagccacctcttaggcatcgacaccttggggctcttggcgacgacgctgccccggcgcgcctcctcggcgcgggcgtcgcgccactgcctggccatgtactccttgacggcgctgacgccgccagccaccacctccttgggcggcacgcgagcgggttctggtagatacacagaagagaggggatgagagaggagagaggaagaaaggtggagaggggagggaaaaaagaggctgacatgtgggacccgcgtaggtctacgctgagtttacactggttctgtaagttggaggatgcgttgtatctagttttgcgattaaggacgattttgtaactcgatgataagttgagagaccttcgatgtactttttcccaaattgaaacgcgctgcacaaatagacccatgttttatttaggcccaatttataaggcccatcaagcaacgtaacttccagtccaaatccctattatccacggcctctccatctccacctgaaaggctcaaacccaaaaagcccaccaacctctgcgtccccgtcgccggcgaccaccaccatgtgcgccgccgccgccgcagccgccaccgcggggatcatctcaccgcctacacctagtctcctctgggcgaacaccagggccaccttcgtctccttcccgcggcgatcgcctcccacgacctccctcctctcggcctcctccgccccggcccccgccccgccgtcggccaaccccaagtaccacaacgcgaaggtgaacgcgggcgacgaggaggtggacggggaggagctgcttcagcggttcaggcgggaggtggcccgtgcgggagtcatggaggagatcaggtggcggcggaggcacgaggacgcccgggacaagcgcaagcgcaaggcccgctccgccgcccggaggtttcgccggaggtgaggccctcgtcgttccatcggtcgattgcttccgtgatcccgccttacgcccgatcaaagttgatcctattattttctctccccatttcgtcggctgcagattagctgctgccttctactgttgttgaatgttggtgattcatttcatgtgctcactattttaggccctaattaatcgtgcgatttctgccagcgtcatgaaatctccttgatctgttctaatattgggcacctgcatcggaaaactataatcaattaatcatagcctgtttgagctccattttaggcccatttgatatttcagtgactgatttcacttgttacaagaatgcaatgctgcctctttagcggtgaatttttgtcttatattgctataatacatcgagcatatgtgaatattattagcatttcagcactctgatgctactgattgtcatgctcctctgaatgtggtcattggactgtacgaccatcttgcaaattcattgtcattagcatttcagtcctgaatgaaagcaattgagcttatgagatgatccccttttcttagcaagaaagatggtcctgtgtttttgttaggatatccaccagtagtttctttttatgcgatgatcgcattgcttctatcctagccttggacatattgatccaattctcagccatgaattcatcatggcaaacgtgtattcccatgtagagataactaggagctgacaaattgaccatcgattgtacattacagtagcatacttttgacatttagaatgtgtagcatgaggagtcatccatgattatgctttgtactttcctcttgagttcattttgtttgtcacaatgtcacatgccttttctataattggtcctatcatttctactgcaggcatttcaagggtccgtacccatttggtgacgagcaggaaccaaaggaggggatcatggaggatgataagcatgacaattgggagcttcctggaggagagctcccttcttacagatgaaccgataaatgacattgatgttcttttggagctcgcttcttacagatgaacttaaaaatggcactgatgttttctgtctgacgaaggatttcgattcttcaacttcagttcctctttcttcttcagcagtagagtgaacttacccaacacaaccctagttgatctgtgaccaatatttagtgaacttgcatttctaggtgtaaggtatagttgttatgtggcaaaatacctagtctgaaccgattcctctgttgtgtgttaattgccaatttgcttcatgtgcctttgcctttttctctgcttaacttctgatcctgctagtgctgctggtgacttacaaattgcagtgaagtgatgttggtttatactattacatgaagtacagctcttattattttcttggattataacacatagctaatgggccaaattcagtgaccccaaagttggtaggatttggggctcgaaaagtctacattgcgaaattgtgtggacaagtactgcaaataattgagatttgatcatcatcttgttgtactaattgtgaagtgcacgcttgtgatggacagaacgacatggagaaaacgataaagaagaggaaaggagaacgaacaggaagtctcgtggcctatccccatatgcataccatattgccacgcatattccggcattattaggcaaatgattgggacttcgattattcttgttatttctcctgttcttttttcgttgtctttttgggttgagctggcaaatatacagttgctcaatagtttacttgcagaaagctcgaatgctccagcacatcaacagaaagctcagattgcttctggaattaatgtcagcaacgctgcatccgaatgcctaactgtggacccaccactctacctgtatttcttcttcctctctcttttttttccttccttttttgatgtcaattctcatcatcttttttttttgtttgttgcttttgttctgtgattctctgttggtaagaaagaaaggattcttttatcaggtcagtgagaatggatatgtttactgtttcttcagaattactgcgagattaagattaccagatcattaggtaatcctaggaaggtgcctgcagaatggtggaacgatttaaatgtgccccttgcatgagtgcgacccatgacgttcttgatcagttggccttggatgttgagttcataaccgacagcagctgaagaaactcaatatatataatataaataagaagccgttgtatcctttgattgcccaaccatttccagtcaacgttttcagacagctgacaatttttttaaatgatccgaacaagatagtacgaccttttatattgatatagcataaaaaattataaaatcatagcgccagctgataaacgagaaacttttagatgatcaatgcatttgccaagaacttgcattgcatagacggtaacctaatggatcaaatttttcagggagacaagaaccaattgtacaggaacgggcctgtacaatagtacagtacgcggtatggatccagctgccctgcatctaaatctgaagccccatcatcatccaatatgcagtgaggcacaatgcaacagaatttccagagctactacacactggaatgaaatgagccaaccaattcagggtgcaaagtggaggattttgctctgcatgccagagagacaagcaaaggtgtgccagcttattacctgccagaaattcaggcactgttgtccactgcatgaagatttcaaggtccgacttagcaacagcattatcatagcagctcacatgtctccatacattcattgtcatgatagtatacatatgggcattatactattactattatactattatacatttatactgatggggtaccaaactgccaaatcactggccaaatgtgtgtactttattctttcagtctttctcagttctactatgagttatcttcagatagcaacatcaccagaaggcaccaaaccaatccacacttgccagctttaagtattgttgtccatagctttttttcttgattagtacagcaaaactaacattaatttgtgggttagaggataggaaattaaaaaggccatgtctgtttgcttcatttgctctgactaaactatgtgcaagcctatcctgataaatttatggatactagtaaaataaagatctgggaccttcgaggaagacaaggacatcctgtcaaggaactttagataattaacaagaagggagtacaataagttaaagagggaaagagacctaggatttatccagtgagtgcttgtatgtgccagattaagttaacctaaccatgaaagttcagtaatgaaagatggttgagagagtgacctggatgttgatgcagtctcttcagatacgtttccaccagctttagtgaaaatagcctgtatgacataagaagaatacattcccaaagctactacatataaagatgctagagataaagtagtcatgatgtaaatataaagtaaaaaaatcaaaagaaagcaggcagcatagattacccgggtatgatttttccctggaaaagccaaatatgcttccaggaccacatcaaaggaaggtgtaccatccttgtctgcatcacaaacggccagttaaccagctcgtggttactgaactcggttgtagccttcttcacaacgattttgtttgcattgtcagataggtgaacaactgaacaggcactgtgatttcagttttgtgttatccatatggtaacagaaaataaagccaaatatagcaacttgagaaaaaaaaatgaaatcaagaaattgattgtattgattgtctccccccaaccaaacttacaatgaattgtgctacctatctttatctacaaaagaatcatttccttcttagatatgtaacaaaaaatgatgattctaatgaactaagaaaagatcaaaagaccttaaaattcaaaaaatataccaaagagcaaatcgctcttctatctaatttctttttggttcttctttccctgtctgtgtctccatgtcatgtattgtggtgccgtgctgtgcaagaccaaatacagtgtttaccaatctaccatggaagatttccagtgtgtgggtctgtgaaaactttctgaacaaaatctttcaaaccgttatcatatacttcacagaaacgtctcggccaatcctctggttcaaccggtttggtcccaagcccaggagccctgtcccttgatccaacattctcctcgtcctgccaatcagcaacatatgtcgcgacacgtccggagaacttatccttgaacacctcccagacttggtatttgtagtggttgatcagcatcataccctgaccaatgttcacatatttcatcccttccttcagatggaagtggtgcaccacattgatgagggatgggttcaatgcgtctggcctgacaattgacttatggcgctcaggtgcagccagccggcaggtgtagcctgttgtaacacctttctttgggatcttagtccggcctgatggaccaaaactatggcatgcagtcctgagctcaccgatccgtggcttgacagagtaatttcggaggacatcttgtagtgtttggttgccagggaagtgcaggaactcatctatgtcaatgaaccccacccactcacagctctctcgagccctgagtgcacaatgtgcaaatccagcctcctgagatttcatccatggccataaatagcgtgtcacattgtacctggatgaatccatggtgttgaggacctcctcaatgccatcgtcgctgttgttgtcatagatgaaccaccgctgcacaccaatacgtgagtgatagatgatccattcccgcaggaaccgtgcttggttgcgaagcatggtgcagacacacattgagtgtgcctttcgtctccaatgcttgttgtaccgaggaagcggctccggttgcgcgattgaggggagtgtagagcttccccggcccttagtcctgatggagaccaacataggcttgtcatcattgtttacgctgtttttgccaccggtagtcatccggaggtaccggcgaatgcgaactggtgtcacacaccggaatatctcctgagcagcagaaaccactggggaggtgacaacaagctttggcttcgaaaagtctcggccaaagacacactcgtaccgtgatggcacacctagacgacccggacggaggttcatcccctttgcaaacacaacggtggagttgtccttgctgtcaataagtgcagtgtacaccagccgatcccattgcaacggcgccaccggaaccgactgcgccagtgagagggacacagcgaccctggatggtccggcgggacaatggacgaggctgggtccatccggcaaggtagcgacggacaagggctggcgacgcagctgcgacgagttgacaggggagtacaggcactcaaattgccccgaagccggcagcaatgagccatctctgagcatcaggagaacatggtccggcaaggcaaccgcgtgctggatatgaacagaaggcaacacggcgtcgacgctgaccatgccggcttgctgcgcgccgcgctccgacgacacggcgttcagggtggccgacggccacgcggtcttgagcacgggccggaaggatgctgcatcagggggacaacacgaacatgggattagttagcacagcacattccgtccataaattaaagagccaaacggattcggcatgggtgaattcagattgcatcaacagaaacgttcttcatgtgaccaagataagccttttctattcccagaattcacagtatcaattcagtcaaacggcagtagcagcaacactagttgcaatttagtaaactcgcaagccagcgtaacattccggaaatcgcgaaccacgcaagaatggaatgagaaaaaaaaacactacaaattttgttggaacagtgagacccctcagatctgccacgcgatttgcaaccccacaagaaagagagaactttttcttcaccactccccaacagcaaacactaaacgcataccagaaacaaatctaaataaacaaaaatgcaaaagaaactttccctcaaatcattcgcgtgagtccaattgaatcgatccaaaccgcgcctccaaccacaagattgtcatgggagcatgattccactggcctacctaaacccaaccaagatccaattcaactccccccccacgccacggcggcagccaaccaactccgccgccgtccccagaagcgaccaaggcggaggcgagggggaaaaacgagtctcacctccaatgacgtgcgcggcgccgaagagcaccgcgccggcgaagaggaacgcgaagaacgccgcgaacagccgccgctgcgtccccgccggcgcccgctgccccctcgccccgaaactcccacctccccctcctccgccactgcccttactcccaagcctactcagcttcctctccttcgccgccaacgccatgccgcggacgcacgcaccactgtctccagcagctcccctctcgctcagatcgatccacgagcgccggctaaccccacgcgccgcaccattcactgctcctcctcgccggcggcgaccactggagctctccctctctctctctctctctctctctctctcctcggtcgtctctctccgccgcggttgctgccgtaaatggcgaggaggcggaggctccgaatccgaagcggcggtggttgccgtttatacccgcgcgcacgccggtccacacctgtccccacatgtcggtgacccaaatggcaggcgctccacgcggcgcggtgggtgccaatgacaggtgggtcccacggggacaacctgtcagtgagacttgtcgctctgagtttctgtttgtatcttattaaaaaatagaattattacttattttatttgtgacttgctttattatcaaaagtactttaaacgtgacttataattttttatatttgcattattttttctaataagatgagtggtcaaacattacataaaaaaagtcaaagcgaccattaatttaggacgaaggtagtactaggctatgtccaatggggcgcgcgtgtgtgtgacaatgacatgtggggacagggaggtggggccgttgcgtcagttggttggggtgaggtgggatgttggtggaaagtgtttttttttggggcttggaacagcaattattggggtgcacatggggcaaggtatccaattctgcctattgaagattagggaattttatttagggaataatgtagggggtatttctcttaagtaacaggtgttctttccatttccatctttctttcttttcttttcatagaaaatgacagattaatgactaatgaggagaacaatgggaaatgaatacacattgtttcactggaaaaggagggtttcaaagcctttgtgttatattacttgtttaaatattttaaacacatcactaatcctacaaacttggacatagatagatcataaattactggtgatgatttttttttctggaaattattttactttcttattgcatcaactttacctatcattttcattgtcttttttcttaaaaggaaaaacgataatcaatcaaatatttggttggctaatagcgtttgaacgatgaaatcttccacgcgttgaagttggtggtcaccaaaatgtttgcttaggttaggaccatcaaggccctacttggacaaaatgttttggcacatccatattagcatgtgataccctgttcacttttgtctttagaagtcaaaaggaaatagtgggctgtgaacttcgttgaatctgaatcacttggaagaattatacttaccatatctcaaaatagcttttctttgtcttggaaaatatcctcttagacaaatattttgcatatcgatggaatgaaaattgacttgttgcaattcctcagtgatcaacggtgcaattatacccagtaattgcagtcaccttagttgaagctgggatataggtttcagggttgtcatggatcatctaacagtagcttatgtaaccaactttcagcacaaattttaccatactactgtatttcacacttgacagagtagttaacttgatggtttgcagtaatatttgtccttagggttgatcaagaaatccaaagttaaaagaacccttacctcaaagcaaagtcaaatgtggtcctttaaagggtcctcacattaaaccctgcattaacccttgttggaggttggttaagggtaagtattaagtaattacaacttgcattgtattgtattatctttgtatgagtgatgatgcctcaaaaccctgcagaattccaatgtggagcccttgccaaaaggttaataaaaaaaaggcaattgtcctggtaatactttattaactgtactgttgctcctgcaactagtttaccttttgtactcttacaacacacatggggtgtgggacttaccgacttagtaatctactacttctcagctaatctgaactctgaagaagcatataaattttacagatccggataatctgatgctatgccagtactaggtgtttgtcagtgtgttggtgtccgtattaattaaatggcattgaaatctcaaggaagaacctactggttttaatatagatgcagatactagcagcttaggacatgtgagaagtcgaaatgcagcataccttattcatgaaccattaaaagtgtgatttataggaagcagaagtatatcaaatgcaaatgcataccatggtatgtttctggtctggtcagagtttgttagaaagtggaaccactttctgcacttctttttctgaacatgcacagctcatgctagagaacattgcatggagtagaggaagaacttcagattgaaatggtctataaaatggcagctccataaggctgaaacattgcaacagacagcatatggttttagctctgaaggtaagagttgtaggaaactgaactctttcttgtcagtgacagtttcaggagctcagttttctccaacatcttatcttcggcgccttaatctttgtagtgactataaatatgtggagtggtagcttggttaggtatcacaaccataatctttggcagctgaatttgaggtttggatgggaccaaatcttactgcagacttgcagagcaagacaagatttggtttcctccaatatctcatgttcagttgtcagacagtgaatagtggtgcaattagtgagctttaacttatgggtggaacaaccttggaagctgaatgtgagagttggatggggccaaatcctgagcttcagatcttgccatggcacaagatttggtttcctccagtatctcaccttcaattgtccaagatggccagatgcaacataaaatgtgttttgtttatagcattttctgtttagaaatgggtacagagtgggattggaattagagtggaacagatgcagtgtagggaaatatggctgtcctgttatttccaatgctgagcattctgcagtaatcaagttgctaaacagataaattagcagtagaagcaattacatttcataccagtttttttttttaaaaaaaaacctttcatactcttcaatcttgtatttctatgtaaataacttttattcctcttaatacaaagatacgctcctagcgtattctcgaaaaaaaatactccttttccactgaacaagtagcatatgctaattcttgatcatctgcccacacaagtatcacattttgctgaaatgtgcaggcagcagcatacagcagttgccatttgcttaactctaatttttggtagcttagctccatgaaagatgcacataaaacttccttcttttagttaaagactagctcgcagccatcaatttgagacaatttctcaccgcatacaagcataactcttttccaaattttctgaagctaatcagagataaagcatggtgctttttctatttacagtttcagactttcagcaatctcaccgtggagtcgtggactatacacagtcaatctccaaggatgcctcaggctctcttcgcgtgaagaaaataaatggaactaaaggaagggatgcacgaaccttggctgcaggagagttagctggaatggtcgattgaggtcgccggcgacgtggaagatggaatgcacgcgcgccgcctcaccggcaaggctaggagggtccgccagagcggcagagccacgaggtcgatgttaaatatgtgatccgaattaattttaggcttacaatatattcggattagttttctaataggactccatatcttttcctattaggtgtctctcctatatatatactcttgtaaactgtaggggaaggggtgacgttcccattattatctccctacgtttgtaatcaactcctcaatagtgattattgccggtcgatatccgtgattttttcccacaagggttttccacttaaaatttgtgtcttcattgtgcatctattttcttaatagtcaagttgcctccggcctccgcaccatgcgtggtcagatgtcagatcagtagggagacaaagctacagtgtcagtcacatcaagctgatcctcctgaataaatttgatttctgtcatctaccacttccttttttttaatatatgatgccattaactcttgtagttatgttttagttatttttgaccattcgtattactcaaaaaaatatgtaattattatttattttgctctggcttgatttattattaaaggttgtttaagcacgacttatataaaaatatgtttgaatttttttaatatgatgaatggtaaaatgtttgtcagaaattcaatggcattctatattaaaaaacgaggagtattacatcaaaattttcgtttcttcttattctattggttatcgatgtggtgaagggaacctggaattgagatgtggattcagatttcagaagccctttcctttccccagtattcagtgctggtcatgctagctgttgctctgatgttccgaatttctgatgagatgtcatactttacagtaccgactatttctgagtagatgaaaaacagttcagaacaataaaaggtacttactacttgttttaatagagaatcaaatactagcaagtagcaacgtaagacatgtgacagtcaaaatgcagtataccctattcatgactcattaaacttctgatttgtaggtccctttcaaataaaaaaaaaatgatttgtgacaagcacaagtggtcaaatgcaaatgcataccacagtgtttttctggtctggtcagagtttgttagaaattggaattactttaagagcctttctttctgaacatgcacaactcatgctagagaacattggacgagtagatagagcagaaacttcagaagttcattttgaactggcctataaaatgtcagccccatgaggatgaaatactgcagctgatagcatatgtttttgcactgaaggtaagagttgcaggaaactgaactctttctttgtcactttgttagtaacagtttcaggagttcagtttcctccaacatcttatcttcggcgccttaatctgcagtgactgtaaatgtgtggagtggtagcttagctaggcatcacaaaccataatctttgacagttgaatttgaggtttggatgggaccaaatcttactgcagacttgcagattaacgcaagatttggtttcctccaatatctcatgttcagttgtcagacagtgaataatggtgcaattagtgagctgaacgaacaaccttggaagctgaatgtgagagctggatgggaccaaatcttgagcttcagatcctgctattgcaaaagatttggtttcctccagtatatcatcttcacctttcccagatgcaatatgaaatgtgttctgagggttacaccatcacagatacttacagaattttctgtcgagcttcttaaattaattagttaaatcttgaagctagttggcaactagtacaatgccgggttagaattagagtggaatcaattcaatactccgcattcagataaattatcagcagtctgcaggtgcattcaacatttctactctttccattttaaaagaaatagtcgttttcctccgattcttgatcatctgccacacacaaatgtcacattttgctgaaacataggtttctttctgttgagacctgctgactgccgttgccatttgctaatttagttttttttgcagcttaattccatgaaaattgcagataaaaaacttttcttttccattaaaaactgagatcatactcatcgattcaagacaattgctcactgcacaggagcattgctcatttaatttttttttcatacatcctctgaagcaaacacatatactgaactaatcagtgaaaaagaaccagtaaaaaaaactgggtgttttgtgcctgaagcacgaactaaatcaatcaaagtgtggtgtggcaagtttagccaccaaccaaacaacccctaaacaaggcagacaaaaatgcaataattccaaattgaccaccagtcagcaactctgcatcgattgatgcaagcaggaagcattcctcgttacaaatttctgtatacatctagaaaaagcaaacacatgtacacccggggtacatattatcatgataagactcgaagttattcatacataaaaacattgtatttctgcaaaaccatgatcaacaagcaaactctgttcctacttgctactctctcatgtgctgctaaccgtcctcaacatcagggcactgagctccagtctgcaccttgacccctagcaggctagcacatacatctcagaaaagcaaggacataatctgcctcctttcctttgtcccacagcgaagaacaggtgctacgatctcggaacagacacagctctgagccctgttgaagattcgaagtccatcatctaccttgtatatacaagtcagcctgcgaaaatgttcaggagcaagtaacatgaggcatgcaggaatccatgagcattcacatcagtgatctaactagatctggcaaacgagctgctcatacgacgtcagcattcagcaagcaacgctgaggagcgctgctaatgaactgtagcctctggaggaactgctggctcactgctgatagtttttgacgaggcaatctcttctaggcgcttccatgtggcctcacgttttgatctcaacgcggtttcttttgcttcatcttcctcaaacttcttgaggcactcctcaaacagtaccgggtcatgatccatgaatatcttgcgaacattaagactcaagctttgaactgcctggttccagtgttcttttgtatttcgttctattgcaggaaggattatgggcagtatcaccttgctgttctgcttgatcaagacctcaatatggtcgttgttccacagaaacagagctcgctctgccacctgcaaaacaagaaaaaataagaatcaatacgccattaccttctatgacaaacaggtagcatggggtcactagaaaattaaaaagcttaagtttcgtttatcacaaaaacttaaacacaacacaatttgatcatcaagcaaatgatcaagtagctgatggtcattctcaaacgccaactagtaaaatacatataatatcacacatccatggatcaggatctcagtgaaatttcaccaatatcttgtcatcttggatgggtccgaaacaattgcataccaggggaattttttttaatttaaattgtatatacaaacaagcctagcggtagctcttactactatacagggtaagttctgtggttcgagtcctgtcgatgccagcttcatctctttttcacataaaaatttaaatttggtttcagtttttttggcaacattatggcaagaaaaatgatctctccctagacctaatcatctcagcctccaccgattttgtttgtgaaaaccaaccgtctcaaccggtggtacatcctaactttaggatatacatctccacttctcagaagaaagtgaacagcataccataaatccaaaaaaaggatggtattatcagcagacaaaagaaactgcataaacataacacagaagcatgcatggacacgtttcttgaagtatacattgtaaatgatcatttaatatgagatccatgtgttagtgcaaaacagcaattcaaaggataaaaattgtcagctacagttacatggaagggtaatgtgatagaattttagtatggattcacaaattggtatgtactttagtgaggagcccaggattcatatagtaaatactttgggcatttaacagccctatcttgtattggtccaaaattgtgccaacaggctatctggctatcatatagcaaacatggtaataatcaacagcccaactctataaagaataaccataattggtacgacttgtgtgctgaaatacatgtattggctgttggaaagaaatcaaccgtggaatgtggatcgctgaaatggccatgctatctgtaatattggtattccatctgatagataatctaataaatagttttaaaatgataaatgcctatttccatatcaacattgacaagaactgaatgcacaagcatacaacaactagcaaaaacaatattacatgcttatggtttaactgccattcagtaaaattcatttttacctgaaagtgagaactattcagacagcgggcgatctgacagaaaagtgacaccatacatctctgaaattctgctggctgagtggcttccaaaacctcttctaactcgcccaaaaacatcacctccttagcactattcgtgatgggccagtatttaagtaaaccccttataacagtatccgcaagcttgcagtccttctcaacaaactgagtaacacaatatgacagttgttgatgatacatgctaacacattttggtttgtggagtggaatcaatgctcgcacaagaaacaatttgtgctcttccttgagtggcaaagcaaaaccattgattatactccccaaaatctctaatagctcagcaatcccgttatgcttttctgtctcaaatatgaacctgtagaagatattattaatcgccttcctaatgaatggacggtgcaccatgaacttcccatatatcctatgaagtattgtcttcaaatactccctttccctaggatcctccgagtcaaagagatcaagcagcttgataatgaaaccatgatcgacgtatctcttggccagcttagcatcggtctcaggagactggacaaaccttaagaatagttcatacacaatctgcaagtgcggccaagccgggtccatgacaggttcttcctcctccatatcaaatgactcaagcggcttgttctctcttggcgcggggttcggtaccctgaacaagttggtggacaccattttgatgacctcctgcacagcgggctccgggaatttccccgtagctgaggtgacataatccacgagctccagcaatgtttgcctcttgatctccttctccttgacatccttggtcgggtccgtgaagtcgaaaaccacatagcacatgaccaccttccggagaaacaagctgggcttctctggcgccggcgcatcccgtaagctcggaagcgcctcaaacacgggcggcgccaagaaaccattgctgacaccagcaccaccatgatgggcgttcttgacggtgtaattctggccgggatttgtgaccgcggctgtataattgttaggattggcgatcctactagacatggtcaaatccgtggtggttcttgcatcaggcagcgacgagccgactccggccaaatccttctccccggacttgcccggcttctccttcttgggaagccggcccaggatttgcttaatcataacggatcgtccaaacaagcaactcgatcaaaattcacgaatccatcattcctcaatctgatcatcaaattaattaaaacgccgtaagaagcagggaaacgaattcacctcatatatagcacaaaacaaaaaaaaaaccgcaccttgctaggatcaaatcgacgcctccggagccaaatccgcgatcgagacgacccctaaaaccgcgccttttccacgagaaacacaatcagtgacaccaataaaaagaagaaccgtgcggagagtcaaaaagggaaaggggggtaaagaaaaaggcagaaaaatcccgccttttttttcccgaatttccacgcgaattggccccagggggaagggaaaggccgcgaattggatcgattcgtggagaaaactatggggatttcgccgtggaggaggcgtcgccggtcgggttcttcctgcgatgcgagcacagtggggagagaggcagtgggtggggcgaagccaaaatgggagagaaaactaaaaagcagaggaggagatgatggatagagagagagagagagagagagagagagaggaaaatataatctttttgttttttgtttttggacctaatccaaaatggatagcttcgttttggtcctaaatattctggtgcacattttgtgttgcacccagtgaagtgcaatttcagtcttgtgtggactgtaactttcagtggcagcacaaaaacatttttattttttcatggggatgcttttctttttcttttttccgtttttacatgtgttttagtacttatgtatgataatccctccattctaaaatatatagtaatttatgatcggattggacatatcctagtataacgggacatacccttgtccagattcgttgattaagatgcgactaattcgatactagtttttatattttgaaacagaagagtagatttatgaagattgattgttctaccattcatagcgacattctcctagattcaatgaaactagattgccatgtcatcaggggcatgtgatggttgtctcaaaaatcaatttcatgttagttaagatggtctaataactgtttctgtactatttagcagatatctgaacttttttcctattgataaagattacctaagaacataactacccccaagaaaagaaaaacataggattcggtaacataccctttttttttctcacgctaacactttacttacccctatatcaaagatacatacatcatgatttatgaagctgtcgttttgttgatggcacaataatgcaaaaggaaatattcttatttcactttagaatataaaccgtatgcttttagaactgaaactcttcttggtgaactgtctttcctctgagtacgctttacgtgtacccttaagaaagaagggctaaataaaggtccgtgacaaatgagaacttatgagaagaaatttctgatttgaactaattgaatatataagcatgccatataaaacaaaataaactaatgatgcaaccatgaccaaaacgatagacttgtaacaggtccaacatgccactaggaggagaagaccagaggcagtcaaatcaaacgcatatacttttattgggtcaccatttaggacggtcaaatctcacctttttatgtcgaaaatcacatggtcaaatatcaaaccagatgccctgttcttcagcacgagcaagaatgtaagacccatcatacactgaatttttcaaccacaagaacattatttcttatttcaactgaatttccatgcgtgcttaacataatggatgattcaggatgattactggattgatggtgattcctgattactgaataaagacagctagtgaggggaagagaggggggggggggtctaatctgcctctggtgtcactattaggaccatgagtaacaaatggctgaaagaaaggcatgagagaaatgtcacattcagagcagtgtgattaaagcaaaggccagtgttttgctgtgctgtgccttaagcgttgcttatctgtccacctgcttgtgcaagcaacttttacctaatcccctccactttactgtgtgctcttgcagattggtttaaccctagctaattagctaggcaccaaaatagaaccaattagggaacagcagagaaaaagtgagcaggtgtacatgtacattcagacataaagagatgagaagctagattgcattaacacagatagaaaatggtggtagaaaattaccattttgtacagtctctcgtaatcgaagtaaagcaaagcctgatgctgcttgaaaagatttacatcaccagctcctcgagtgaaagaaataagggaagaacacaagatgcagtaaaattcaggatgagctgcagaagaacagatcaactgaatttgcgtgcggaacctgaactgcagcttcgtttcattctccgatcgatcgctgtcgaatgtaggtggatcgcaagtagcacaaggcagcacaacaggcagttcatctctatgttacccagatacagggttacagatacgcgatacgttgatacaaggatacaacacttttcagaaaatatggatatggggatatgtatatgtatgtacatacacacataacacgtatatctatatatctttatttttactattataaaaattaaaaatgtttttggggaaactcttttaatcactcgagtggatgtccacccgtttaatgcatatcatctaaatagttataaaaaaattgtcaagatagatcaatatataatatatcactccacaaacatacatgttaaaattcatcttctacaagttgtaacaaaaataacaaataaaactcaaattagtatacgtatatttgcagttagatttgttatttttgttacaacttgtagaagttgaatttacatatgcatgtttgtggagtaatatattacatattgatctaccttgtcaattttttttgaaattttttcataactatttagttgacatgcaataaacgggtggatgtccacttgggtgattagaatccatctccaatgtttttccggtactttggtacgtcatctgtgtatgagtcagtttttaagttcgtttgattttgaaaatacagatatgtatttgagtcgtgttttaaattcgttcgctttcgaaaatacgaaaggattcgtacaagatatctttttataaaaactcgcatgctaaattgagatgattggactcctaattgcagcacatgattttctagaaatatatatatccaagcgaattcacacagtgaatttcaccttaactaaaccgtataaaaataataagattaaaataaccttcacccgttgcagcgcatgtgaattgagggtggatagggagagagtagctactcccggtagtaacttatactcaatttcaacaatggtgcccgggcaccatggagcaccaaacaaaattgtgagtatatacctagttataataattcgattcatacctatacctatcaacaaaacaactcaaattta

SEQ ID NO: 59085 - DNA, 1779 bp, Oryza sativa
tcgatttagggttgtaatttatccggttttgagagtttgggatgttaaatgtctagtattatggtttagggggtaaatcgtactaccgcaatagttcgaggggtaattcgtactttccaatatggaaatatctaactatttgccaaactattggtcatcattaattacaatcttaatttggttgttctcataattctttggaaacagaaaattaaattccattaatatattactctgtatgtttcaaaatattactggtcattctcacatttaaaattattaatttagatcgtggtcttctatcttcacattttatcaatgccatgtacaactgttaatcaaagttaatattgcttttgagaacgattataatgtagttaataagcatagcagtgtaatttgcacatctcctagtttgatgtgaaattttgctagaatgacaaataatataaaatgagatatatgcaaatttaatatatattttgcagatgagccatattacaggctaaattaggcggcacgtcaacagggcgtgcagatcttctagtatctactaatctaaagctagcacttcttgtgccaacgggacatttaactatttaccactatttggtttgacaattatcaaatacccttcttatatttgcacatgcattggtagtgcataaacttgttagatgggtacaatttagtacataatcttgtaaaatgctcgtttcggtacacgaacttgtctagttttgtgcaaacgagggccaaaatagcttggcaatattaatcttacgaagttgatattgattagggtgtgacatgcatatgtatagtgcgtttgcataagactgcaattatttataaatttgatctctactttatccttcatcaaggaagtgatgatatttcatatctttcccaccctagcttatatcattgctctttttttaatctttttctacaatcacaaaaacaataagattatccatgtagtgttcttttcgccttcctccgcacgcacctgacaagttcatgcactagaacaagcgttttataagttcgtacactagattgctaccacctaacaagttcatgtacggcgatgcaatttactcttttttttttcaatccccttctccaaatcgaaccaactctagaaaggggagaaggagctgtcgtttacatggaatgacagaagtggatatcgatctccgtggtgccatggtgtgctatccacacgtttgatccgttgcatgatagcccttctacacagaactcttggataactattacagactttcccattgataagaattgttcggtatagtgaagcagggtttctagatgctttagtggtcgaaaaaatggattagatatcgcagctctttttctcctagctagaaaaataatttctggtagccaatatccaaccccttccattttaatacatcaatatacactaccggagaattgatatttgtccggatgacaaaaatcacattagccccgattcgaataggaaccgagactaaagaatatgtttagtcccggttcaaaagcccaacagaattttttgatatttagttccagttggtaacatcaaacaggactagagatcattttttatgtcccggttcaaaaattgtcaagcctcccactatctttagtcccggttgtctaaaccaaccaggacgaaaaattaaaaaaacagtcgagccacatggggagggagagagcagcgcgcgtcgtcgtccttatttctttctccccctcatccactaacccttt

SEQ ID NO: 59086 - DNA, 22417 bp, Oryza sativa
gtgcgcgcggtccacggcaaaccgtgcggctgcacgtgggcccgccgccatccatccacccggtgcaccgctcttaagccacgcgcacccgaaaccctagcgcccgcccccgcgtgcgccgtttccaccgtgcaccgcctcaccgacaagcgggcccgctcgggaccccgcgaggtgagcccggtccacccggctccccttcccccccctctctccccgcgcccctctcttgggccgcctccccgtagcccgcgccggcctaataagctcggccgaaccgcgcaaatcttctcgggccgcgccaagccgctcgggaaagtctgattcctatccctccttccttttcttatccaaagggattactaaatccttttccctttttcataaatcaattccttattccaaaaattccatgaatcatttcctttggtcccgcacatcagtgaccatcaataatattcttgagaatattattccataaaccatttctcgtgttctagaaaaatccaataaatcatttccttgtccagaaattccagttaagattccaaaattcatatctctcgatccgttcattcgattgacttcgttccacttccagtatttccgtaaaattgagatctatttaatggcactattatttagtctaaataggatctttcttttggtcttttgtttaggtttttgattgtttgcgtatagttgcggttaccggattttcgtcgatcgcgggttttctcgaagattcgtgaagctccgtgaagaccttgagctaggcaagtcaccctttgaccaattgctcctataattggaaaatcattattattttgtttgcaacttgcattgttagaatcacacacttaacttgcttggcctcggtttgcgcgctaaaccgacggacctacccagtagtcgcactaattcctgtaggctgtactaccctgactccttgtcactccacctttgtggtacctcggtatccgtgctctctgagcgcgtataccaaatatcccacatacaccgttgtttgtcgaaaacttgggaaatgggtttgtaaagccttgaaaacccaacatgtggtgtagatgtgtttaaaaataaaatgaattgtgaaaactcgcgatgcgggggttgtgcctatgtggaactgtcccgtattcacatattaggaccgattcctatgggaaactcatcgagcataatcaaagtgcaaccacaaggtggaatgagacaccatggctaagtaactagtcggttcagggaaacctcgcatgccaatagttgggaacgccggggcggggttggttggagccaaaccaggttcctggtaagcaaggaagagaagcttgctgaattaccgatcgaggtggttggagtttgatttgtgaaaactaaaatggcctatatttatgtgaggatttgatccttctatgtggcatgaggtaaccctgagttggcttggaaaaggctttgtcgcgaacctctaacaccggccagtgtctggagtaagttcgtgtcttgtgggtaaagtgtacccctctgcagaggttaactaactgttcgaatagccgtacccacggtcatgggcggatgtgaggtggttcccgttgcgtagatttgtttgcctgtgctttgtgaaaagttgttgtggtgtgggaatcgtaaccagaatcagcctatgtggtagatggatgacctgagtggtcagaaacgaatctgtgtgattcgggatgtctacgggcatcatagactaggcttcccgagtggaagcggattgctttgctgctgggcagctggactctgggagtccgcaaaaacgaataaggctctgggagccgcttaatcaagtgaaatggctctgggagccgagaagtaatgatctgacccgggaggtcggtacattaccaattgagctgttgaaaagcatctcttaagtcgatttgagacgcaagtctcttttcgacccaaacttaaagagaaataaatcacttagtgatttcaaaatgatttcaaacaaaagatttgcaaaacaaccttgcctctcttccaagcttgcattaaacacctaagttcacgtgacttgctgagtacgaaagtactcacccttgctctatataaatatatatatagttcctccgccctgaagagaagataaagtgaagtgaagaatagggtttcgtcctagttcccagccgtcgcctgtggtgttgggtgttcgttcgttggttccgctgctattgctgttgttggtgtttcctcgtcagcgtcgtcggttgcattctcgggctgttctgagctgcaacctaagttaaggtaaataagtcctctatttatgttaaggatttgcaatgattcaaatttgtcaccgtgggtaccagcgctatgtcctgggactggtactgagatcgcggtttcgtaggaagcggttcgcgccgtttttcctacgacacgctccagtcaggtgccgttctacggcggtaccagattggggtgtgacactgatggcggtagacggcgcggtaggagggtgcgttgtggttggccttatcgggttggttgtgcgctggtagcccgcgaggtccaaggatgtccacctcttatatttgttgtgcttgggcagttgcagcgtcgtaatagaatcggcgattgggagaaggagcggggagcctttgaggaccatcgctccttctcccgacggccactgcacgccgccccgtctgccgttgtgcctggaagggagatagaggagaaaagagaggataggggagagagacgaagagaggatagaggaggaagaagaatggccgggagagggaggagagagaagaggagggagtgagaatgacacgtaggacccacgtcggccacactatttttaattattatttttattgtcgtgggataaagactgagtcaaactagtcacgtaggcgccacgtcagctaaaaacatcgtccaaaccgccataagacctacattacaccggctttgacagttgagggacctgttgtatctgattttccggttgaaggatgaaaatcagattcgttgataaagttaaggaacctcaagtgaacttagtcctgcacaatataaactgattccggacaagcgcaaagaaccaaataagcccacaaatcgtaactaacactgggccatcagacccataacagttttgtatagaaaccgatcgcagagactcacccgatccaattgggcccattggaatttggatagaagccatcggtataggtggcaaaagtctaattagagtcccttaattgactgagtaaaaccagataaaataagaggaataagttcactttgggtccctctatttacgaaatcgtttaaatgaggtccctcggcggtatttagtccagttttgactgaggtggcgctccttttgactaggtctttgtccaaagtgttgttgacgtagcgtttatgtgacaattagattcgaaaaaataataaaacacgtgggacccacctgtcagtttcacacacaaataacaaaaaaaaattgtggacccacacgtcatgctcactacctcttctctctatccccctctctctctctctccctcttttctctctccagccggcgaagcagggagggcggctcttgccgacgccggagtccctgatgagcaggatcttgaagctgcactcgtgcccaccaccgccgctgctccccgcccccggtggcgcggcccacaacgccggccgttggtcgaaaattccccattccaaaaccccaatcgcgtcgaattgagtgaagccatgaacagtgtgggtgcagcgtccaggctaggtggcgagcctctgcagactgcaggccggcgcggcggtgcttgcccgctcctagtgccgcggtgccacctggcctgcacggctgtgcgcctgcgtgcagcagcccagctctaagccgagcaggcagcaacaccaacaagtcagcaagggcaaggcagcaaagcaactagcccgattcagcacaaatggatagaaaggggaaaggaaaggctttggcatcataaaaatgtaacatttgttgagtatttgacaaatgacaagtgaaaacattgcaatttgcaaaagtataatgaacaatttgtcattgattcacatgtctgtaattttctgtaattttgtttgtagatttgaagagctatttcactaggtagtccagtagttgccgagcagtatgctttcattccacagcgcggcggggggagaagtcgcacgacctcgacggcaccgtcgtcggcgggcccaacggcaacgacgtgttcaccgaccaccggggcgcgtacctacagacggaggcctgcacgtacaacacggcggccatggttggcgtcttctctaagctcatggaggtcgaagtcgagcgcgacgcctctgtccgctccgcttacgtcgccggcgacgcgcaggccgacctcaagaccctggtcgatggcctcgtcgccaacggcaacaccaacatcaaggtggacgccggcacgcacccgcagacggccacaggccacgggcggctcctctgctcccaacggtcggcgccccgcggccctccggccaccgccgcgctgcgacttctcccccgtcggccggccgctccgcccacaacgcgccgcttcacccctcgtctccgcccctctctgcctctgcccctctgctctgccgccgctccgccctgccgtcgcccactccggccgccgcccactccgctccgtcgttggagagagagatggatagagaggatagagagaggggagatagagagaagatggtggtgaggatgacgtgtgggcccacatgggcccacccatttttttattatttgcgtgtgaaactgatatgtgggtcccacgtgttttattattttttccgatctaattgccacataagcgtcacgtcaacgacatgttggacgaagacctggtcaaaaggaccttatttaaatggtttcgttaagttggggacccatcgtacctagttttgcgaacaggggatgaaaatcggactaggcgacaaataaatggatccaaagtgaacttattccaaaataagaagactccctcaactgctgatatgatatcggtttgtttttcctccctgtaacttttttttctggtgatttcatctgacatggcaccacgtagcttgacacgtggcagtggatcccataggttcatcatttttcctactcttttctctttctttctgccaaccttttcttactctgtacgcatatattacaattttacaagggggctcagcttaattatatacagtgtccaccttcattttcctacttggactctttatttgtctgaaataaaactccagcaactacatttcatttacaagtctaggagctcaagctaatatcgctgtgcgttgtcccatcctccatccgtatccatgactgaattgagaagggctgttcagatatctcaataacccttgctcctcttggccagttaccgtagccaccatagcctgtgtgtcgggcaaaacatagccagagtttctcgtgtgggcagcaccaatccaggccgtggttgtgaccaacgaaaattgcctgtaaaatgacaaccaatgatatatgttctctaacaaataaaaagtaagtgtcttctgaattttgacctgtgtatctaagttatctgaagggattcaggggataagaaattctgtatacatgtcaagaaatgttcagatgaaacaaaccttcactgaagccctcttgacaagggcatccatcataccccattcagcttcttgtggtgctacttcttccctgttgatagagccaacacagggttttcttatttcggacttagctttcggcgcaaccttggcatatgccgtacttggaatatgccaaaagattatctctggaatcctgtagaataattacacaacattaattttgagttgcagaagcttgaattttgagtatgtgcaaaattgatacaagtttctgaccttccatttggattaaggaactgagattgactatgaaaccactgaacctgagcactggatatcacttctggataggatccaccaccggagtcaaggaaatacatgagcagagctggatcatctcgcttctgtgatagcacctgcaagacgtagttggaaacagcaggccagaggtccttggggccatttgatgaatatgacaatccattacggataacctcacttgtcatcagttcaagtcgcggtgttcctcggaagctgcagtctgcacatcaagttaaaaacatggttttcttgaaaagttcaaatgaatgattacttttgtttgaaagcatacagtggttgccttctttcttttccttttcttttttctgcgctgaagttcagtgactgaactgaaacaaattcagaaatgaactatcttaagtttacctgaatctgacatgctcggtggtgggcaatgcagcggcggaacgcctgcaggagagaaccactcaggaggccactcgaacggcatgtcgtcgtggttcccgaacaccgtcgcccacgggatccccctgcctctggtcggagaaatcgctctgtcccagtacaggctcgcgttggggatccctagattgttcgcggtcacgaggtcgccgaggtacaccacgaagtctgcgaattccgggagatttcagcgaaaagaactcgcaattttacatttcaggcgaggggacgccgcacgcaccgggcttctcggcgtcgaggacggcggccatgacgcggtcggagccggcgtcctgccgtgggccccagtccgtccaggcgttctcgccgtaatgcaggtcggcgaagagcgccaccttgaaccctcctcccgacgcgaactgcagcggccggcggctgctgctgctggccgtggtgtcagggcgccggtgctccgccaccgccagagcaagcgcggcgcagagggcggcgagcagtgcgccggccgccgccaggcgacgccagcaccgcatcccggcgtacgtgctccgacggttcagtcaatcggagtcggacgcgtgacggatctccggcgacggcggtggcagaagcgtgccggagcagatgctggtggctgcaaatgatgggtagagctgcgattaacgtcagtacgtcactgctgcttgtgcattgattgatgggtcactgtccacaaaagagtaaagacgcggcgctttatttcgttgcgttacgctgattgttagcgtaaatataaataaagtggacacaagataatgggacagtcacgttacgccgaatcatgtcattcatccagaagcagagagagagagagagagagagtatatgcggcgaggagctcaggtagcaagcaagaatatgctctccgaagatggattttaataaaagatgagtaagttgtcgtggctagaaaatgcatctcgacttgtttaatactccctccatactcgtaaagagatcgtttagtacaatatttaagtcaaaccttaaaaatataggtcgaatctaatttatacccctcaaccacaaaacaggatatgacgactcctcaaactattaaaactagtgcaatttgactttctcagcggttttgctgacgtgacgctaatgtggcagtgttgacatggtgttcgtctcacgtggcgcttatgtgatattagaattaaaagaatatctgtgagatccatctgtcatttacacacgcaaaaatatattgtggggtacgaattagattcggcctattttaatgggaatcaaagtggactttttctgttacggaaatgctatataccagtataccgttggacgggatacccttcgtccacctttcccatccaaataggaacgaggctgagcacctaagccgtgaggaggaggtggccatcggcgcctaagccgtgagaaggtggccatcggcgactccggcgcaggctgggaataagacccgctcggggagaagaggacgtggccaccggagacgcggccgccggcaacatggtcgttggattgccgcctggtgctccatccgcgtggccggccggtgcgctctccgccggtgccccaactccatcaccggcgacgtggccatcggcgacgtggccatcggcgacgtggtcgccggatttgccgccgggagctccagcaccgttgcctgccaaccaccacgccgccgttaacgcccacccttggctccatctgcgtggccggccggtccgccctccgccggcgccccaactccgttgcgggccctctccggtcggcgccttcgtcgccggccgtcgatcccgctgtgagtccgggccttcatcctatccatctgctactttgggggagaaaagagacaagacgggggtgcaaagaacttgttaatttggtcatggctggctgtggagtgtggtagaatcatcttctacgtggtaagaattgcatgatacatgagttaagtatcaggacctgatacatcgcaagcatcacccaccacgtgataagaatcgcatgatacctcataggtatcatctgatacctcgcaagtatcatctgatatgtggtagaaacacaagtatcacacgatcctactaaagtatcatctgtgaaacccataggatcttgttactagatatgatacctatgtagtgtcatgcggtactgcataggtatcacacataatgatacttttgaggagtatcatgtgatcctcctaggatatcatttgtgcaaactaatgataccaaacatgatacagatgaggatcatgatacctctcaggtatcacatgatcctcccaaagtatcacctatgaaacctggtgaaaccgaacatgatactaaggaggatcatgatacctcccaggtttaacatgatcctactcaagtatcacttgatacctcgcaactattatcttctacgtggtaagaatcgtatgataccttatatgtatcacctgataattagctggtatcaggtgatacctaccaggtatcatgcgattctaccacgtatcaggtatcagacgattcctatcacgtatcaggcgatactcgtgaggtatcatgtgatacctatcaggtatcgtgtgatttctacgacgtatcggggtgatacttgtgaggtatcatattcatatgatacctactagataccaggagctgggtgtcgaggtgtcgaggcatcgtcgccggcggccgcgtcctcccccatccacgctccacactgaacccgaacctcgtcgccggcagccgcatcctcccccgtccacggtccacatcggagctcgtcgccagcgaccgtgtcctccgtcgggagctcgtcaccggcagacgcgtccgtcgtccacgcctcagccggcggccgcgtcctccacgccggaggtcgtccgcgccgtttgcgtccgcgccgccggcgttagccgcatctgtgctactcccacatctcgcttggcgccatggcctgcgctctcgcgtctgagggaggtggacatggagcgatcctgttgggacagtatcccaacgagataccggtatatagcagcctcctttctgttaacttacgagtctggctatgggagcccacaggctatttgtctctaatgctcaaagcgagagagtctcagccttgctacatgcaaaggatacgtgtgtaacaatgtaccaacactgtaacacatcgatgaagaggtttggtcagaaaaaaatggacaccaaaccgagtcctaattgcaatgagattcaggtgcaacgtaaggcagaaaccaagagctgctgcagccgggaacatatacgaagccgcaccccggcgtcgccgtcggcaggcgatactcccgaggatgcccgtcgtagtactcgaaggacacgaacggccgagcgaagtagaggtggttgcgcagcgcgtcacggccgcctcgcgtcgacacgcacaggctgcggccgccgatccccaccaggatggccacctcgccgagatcctccacggggagccacctcccctcctcgcgctcctcgtagcgggacacctcgtaccgccgggacccgcggaggtagccgtgtcgcgcatggtcttcgtcgtccatggcgccgacgctgctcaccatgagcaggtcgccgccgccgagcgactccacgagtgcggcccacgtgcacttctccggcctcggctccgtgacgcgcgtcgcgtgcaggccgctcgagctcgcgtccggcgcccaggcggtcaccgcggcctcgcggctcgccgtgtagaacgcgcccttgtggtagacgacgtcgacgtacttgtgctgcatccatttcgggaaccacagcgccgtccacgacttggcgccgggccggaggaacgacaggccgttcccgccgccgtggatcagcatcacggcgaaggtgccgacacggcggccgggaaccagctccgccttctggaacatggactcgcccatctggtcgaggtccctggccaccttcttgctgccggacgaggtgatgggaggcagcgggaacgccctgcggtgacggcctcgagcagggacaggccgcactcctcgtcgacggtgacgagccagccgtgggaggacccgatgatgcgggtcactggcgcggcgccgccgtcgctggggatgcggacgattcgttcgcgggtgaggcggagaggacagagctcgatgccattgctccactggtctagtctcacgctgtacgggcggctcggttgttcgagtgtgcggaggcgcgtggttttcagggcgcggcgccacggccggcagacggcggagcacacgacgttgtcgaggggtccggcgcggcgggcgatgtcgtcgagcgcttcaggtggcaggtcagagaagcagacgggcgccatggtgtttggaggtgcagatgtgtaacgacaattcagtgtttagccagcgattgtgatgacgtggtgttcggtgtttatcgttcattcatctgtgttaagatggtgattctacgagattatctctacaaccaacggccaaatatacgtatctgtgataagatggtgattctacgagataatctctacaaccaacggccaaatatacgtagacgttattacttcattttcccccaacgaagctgataaaggatcgatccaatattcccgtgctcgatcgtgccttcgtggcatgtacggaagtatcgtgcaatttggaacggaatactacaggcactttctgtatatttatatgaggtgtccatgaattttgagaggcgaatttgcacaaattcgaaacaaacctgacttgtatttgaagtgcaacttttttgaaagaaaaactttagtttatatccagctttgaagggctaacatattggaagcatctctgcaaaccaaatcagctccttgctattttcttttcagtaaaaggcaacgtacccattaacgacgagacacccgactaacttatagaaattgtatttcaacttgcatatatgtggagtgatatactatattttttttaaaaaaaacataaccatttttttaatatacagtaaacgagtggacatcaatcggttaattagaaaccatctatatatgtgcggacttacccataacaagtaatcctgcggtggtagaacaagccaatttttttatacgaatctagactatttaaatttgtgtaaacaataatttattttgagacagagagagtaaagtagacacgttagtcggtgattcaaaaatacacattaaacatagccgggtctaataccaatggaattcaggtgcaacataaggcgcaaaccaagagccgccgtaatgcggcacaatcaggtaagtacaacccggcgtcgccgtcggcaggcgatactcgtcagggtggaagcagtagtatttgcctgattcgtaggacggccatgcgaaaaagaggcggttgcgcaaatcgtcgtggaagcctcgcgtcgacacgcacaagctgcagctgcttcccaccaagatggcagcctcgccgagatcctccacggggagccacgacgacgtcccctcgcgctcgccgtcgtagcgcgacaccgcgtaccgccggcgcggtagccggtaccattggccatgcgcggcaaagccttcttccacgacgaagctgctcaccatgagcaggtcgtcgccgccgaccgactccacgagggcggcccacgtgcactcctgcgtcggctccgagacgcgccccgcgtgcaggccgctggagctcgcgtccggcgcccaggcggccacctcgccgtcgcggctggcagtgtagaacgcaccgcggtggaacacgatgtccgtgtacttgtgctgcatccgtttcggcacgcgcaccgccgtccacgatttggcatcgggccggaggaacgacaggccgaacccgccgccgtggatcagcatcacggcgaacgcgcccagccggcggccgggagccaacgtcgccttgtagaacatggactggtcgagctccttggccaccttcttgctgccggacgaagtgatgggaggcagcgggaacaccctgccggtgaaggcctcgagcagggacaggccgcactccttgtcgacggtgacgagccagccatgggaggacccgatgatgcgggttggtagcttgtcgccgccgtcaaccatggcgatggggacatagatggttgattcactgctgcagccgaggcgaacggccaggcagagactgatggtgccgttcctccacttgtctagtctcacgctgtacgggcggctaggtcgtttgagtaggcggaggcgcgtggttttcagggcgcggcgccatggccggcagacggcggagcagacgacgttgttgagggcgccagcgcggcgggcgatgtcgtcgagagcttcaggtggcagatcggagaagctgacatgcgccattgttggcgatggaaatgtaacaactatacagtgtttatccagcgatagtgaaggagcgatcctcggtgtttatggttcgttcctctgtttaagatgctgattctacgagattatctctataacaaacagccaaatatagacttacttgacttgcccccaacgaaactgattaaattaagatccatcttccattagcccaatcttccagtgttcgtgacatccatccattcagtctgtactgggaaacaaataacgttttgcagattgtatagaaggtgtccatgcattctgagcggcaaatttgcacaaagttgaaactaccagatttgtatttgaaatcaagaaaacaaaatattgatttgtctagtttcgaagatctaacgttttcttgagaaagtacacagaggtaccatattaagtaccttaaggtacaaaaaattctagcctaaaatttagatacctcaaaatattttctaaagtagtgtaaaatttctctttctgcaagtcaaaaccgttgtagacttctgctcttggacagggtcggccctggggcagcgcggaaggtctgggccctagggcagcgcggaaggtgtgactgtattgggcctccaaaatatgtatacaatgatatcactgtatcaggcctgataggtttagagaaaagatagaagaccgatcgacgatcgagtatatcgtgactgtttgattgtattttaaatttattagtgtgaaattcgttaatgacatgagttttaaaatattatcttgtttttttatgatgaatggggatcttcattttttgttttgcaccgggccaccaaaaagtcagggccggccctgctcttggatatagagtgtccctctcaacttttatctctctttaactatattggaaggctgttgctgcaattacacatgtaaatgagaagaaacaacttgtttggcaatttgagggaatagatttaggagtttagacgagagaattaatgatgatattaacatgaaaatttgattaagagtttagataggagaattgacagtgatattaaccgtgtcgattctaagatttgagtcgtgtataaataggttccaccacaagaattataaccagttgagatacgttcgcttcgtaataacatatgtgactataataagtcaaacaagttatgtatgcatcactttagctgaaactgctaacactactgtagaggaacattaagctaaggaaaacggggcctgattgcaacggaattcagttggaagccatatcccgccgacgccgtcggcagcgagtaggcggtagggtggccgagcgaagtagaggtggttgcgcaacgcgtcgcgggagcctcgcgtcgacacgctcaagctgcagctgctccccaccaagatggccgcctccccgaggtcctccacggcgagccacgccccctcgcgctcgtgcaaccgagacaccatgagcaggtcgccgccgccgatcgacaccacgagggagacctacgcgcactcctgcctcggctccgagacgcgtccggcgtccaggcgctcacctcggcgtcgcggctgaccgtgtagaacgcgccctggtggaacacgacgtcgacgaacttttgcttcatccatttcgggacgcgcaccgccgtccagcatttggcgcctggacggaggaacgacatgccgaacccgccgccgtggatcagcatcacggcgaaggtgcccagccggtggccgggaaccagctcggccttctggaacatggactcgcccatctggtcgaggtccttggccaccttcttgctaccggacgaagtgatgggaggcagcgggtacaacctgccggtgacggcctcgagcagggacaggccgccgtcctcgtcgacggtgacgagccagccgtgggaagaaccgacgatgcgggttactggcgcggcgccgtcgtggttggcgatgcggacggttcgttcgccgttgatgcagcggcggatgggatgaagctcgatgctgccgcaccacagctctaggttgacgctatacggccggttcggttgcttcagtagcccgaggcgcgtggttttcagggcgcgccgccatggcctgcagacggcggagcacacgacgttgttgagggcgccggcgcggcgggcgatgtcgtcgagggcttcaggtggcaggtcggagaagcagacgggcggcgccatggttgatagatttggttggcgttgcaaatgtgtacagtttggtttaccggctaattccactgtttaataaggaggtgattctacgagataatctctgccaccagcaaccaaatatggactttaacttgacttgcccccaacgaaaccgataagaggaatttttacagtactttgagaaagtactaaattttacgctacattcttaaggatgataaaattaaccaacatttaaacctcgatttggcccagcgacacaagaacgaaagtgaaaaccacaacactcgccgtcagagttaagaacatcatcagttgggcacttgcatatgaagtcaaatatttagtttctgtccagttttgaatatttaacgtttgaaatctcgatttggcccagcgacccaagaacgtgaaaaccacaacgcgataaaaatccttgaaaaatttctctgggtaactaaaatcccttgaaatttctgaaatttaagtacacggttttcaaatttgtcatcacttcacctgcgagaaacagcggagggcacaaaccaaacaggatggccgccggcggcgcgccgaaacaccgacatcctggacgccacccccgtcttgacatcgcacacgccgctctcgtaccgcgagcatcccttctcctcctcctcgaaatccgccgcgaacgacttgaccacgtagtacacgcagttgggcttcaggcacgggtactcccgcgtcgacacgcactcgccgtggttgatccccaccagcactgcggcgtcgccgacgtcgtcccgggagcgccactcgcccttgtcctcgtccacgtcgaacaccttgaaccgccgcgcccgcagcgcgttgctgtcgtcgaggatggccacggtgctcaccaccagtagccccccgccgccgtccgcctgcttggccaggtacctcgcgccctcgtagaacgccggctggtggaacgtgtcgctgtggaattccaccagccgcttgaactcccacctcatgaccggccccgtcacgagccgtggcttcagggcgcggccgtccggctcccacgcctccacggcgccgtcgccgcgggtgagcgtgtagaacgcgccgttgtgccagatgacgtccgcgtaccgcgtcaatgcctgggtgggcagcgacgtccagcggtcgtcgccggacctcgcgaatgccagcccggagccgccgctgtggcttaccatcacggcggcgtagctctccttccggtggctccccggggcgatggccgccttctggaagaactcatcgcgcatcgactggaccggcaccaatttgggaggcttccactcgatcttgcgatggccttggagatggtggtgataggcgtgattgtccaccgcgaagtattccgggacgccgtcgccgtcgccaccgacggccgtgacgaagtactcgcagtcgaacgacgtgacgggcggcaggggtacctgcgcgccgtcggtgaagggctcgaggagggaggcgcggcacgcctcgtccacgacgacgagccagccgtgggagcagccgatgatgcggtgggggcgcgcgccgccgctgccgaggtacgccgtcttgacgacgtcgccgtggcgggaggagaagtcgacggcgttggcgccggagcagagcgccacaaggtggagggagtggcggctgaggcgagggcccgccgcgctcgccgcgcgccgccacgacttgcagacggcggcaaacacggcgcggtcgtcgccatggacgcgctgggagatgtcctcgaggatcaccggcagaaggtcggaccagtcgacgagtgcggcgatgccgtccgccgccgccaccgccattatcgcgagttcaccgcgcgccgcgtaccttcacttcacatttaagataagatcgcggcgcgagaatcgaggatgaaatttgaggtcgttcgcttcgcagttaaaatcgcggcctcaacgtggatggaatttgaagacgcaacggatggatttttttggtaacggtcacaaagaaggcaagtcatctagggcctatttggttctctaccctaccaattaattggtagtaccaaaatctaggcaaattttggcactaccaatttcttggtagagcaaagttagctaatctatgtttggtttaataccaatataaagccaaaatttagtatgagagtgaagaagattttagaatgtagccaaattgagcgtgggcactaccaattgtttggcttcaatccaaactagcatgtttactattaaagttatcaaaattttggtagggtcacgttttggcttcaatccaaaacgacccctaatcttgtggaatttgatatattctgtacaacgtctcaaagccgttccatacgtgatacaggttgatgctaaaagttgccatgttttggttccgtatatcagaagctgaaaatttggactagcttgtcaaagccatagtaataatctggaagcaggggcggacgtgcccattaggcggcatggggcgacggccggcccagctatggcccgcgccgccccaccccggcccataccacagttttgctttctcgctaccgcatcgttgcgccaacgcttcgtcttcgcacaaggaccgcgactccgcacaccgtctcgcacttgctcgctaccgccgtcccgcactgccacaccggccaccggcgcacgcgacgatgacgcctagctgccgcccggcgccgagcgacggccgatgactggcccgatgccgctcgcagccggcggccagcagctctctcctcctcgtctcctcctcgcctctcgagcctcctcctgctcggcgccaacgcaacgccgtcgctgtcagcccgaccatcgtcgcctcacgtctgctccggccgacccgctccttggcctggccggcactccgcagcacgggcacaacagcaactagcaggctgcaagctagcgcctagccgcctggcgctagcgagtcagcaacctcagtggtaagccggtaggggcagtagtagcagttggaccattttaatcaaatcatcctcttccttggaccattttattgtagtcaagtaacaaagcaaatttgattgttcttcttgcaaatgatctgttgctgtctagattagttaatcatctgtttaggataatggaaatagttggtactcctagttaacactgttctactgcatgttatttactgtaaaaatggaaggcatgcgcagttacttgcaatcttgcatattaattatttacttgtcctactgcatcttttggtgtatgattaattatatatgacgcaaatattatttctttgtcataaaatggttttgttcgcctcgagtatatctttatgcgattacggtataaatatggtatttgttgcatttaggtgtctttataaagacaacattttcactccatcttatttttaatcttgcgtccgccactgtctggaagtaagcccattgatctgaataaaaagaaataaaaacaacataagtataaattaggaatagtacaaatcgcaggcacacgatgaaaaatacacaatactgacacaataacaaacgtatacacccctctatctccaggctcgtgctatacatgttgacctctcctcgcgttcacaaccaattactgtacagatacgcatacagaagtagtcagcacgtagcacggccgcatacatatgtttcgaccaaccgatggtatgttcagacccgacgggaattctctgcattaccgctgatataggatgagccactattatataggatcaaactactggctgccgctcgtaattgctactgtaccaacagcactgcagaggatccgtgtccgtgtcaaatacgggcatggaagctaatggggtagaccctatcggtgctggggtagaagaggccccaattctgctccacgccggcctccttgaggttctcgttgaacatggcgaacacgtacgtctccgtcttcttcccgggatgccgcggcgtgccattccggacgtgcctcaccaggttctggttgaatgtcatggcgttctccaccgacgcgcccacgccgcccgccgtcggccacccggtctcagacaccaccaccctcacgttctctcccccgagcttcgccaccgccgtgtacagcgcgtccaccgtcgcgtcgaactggttctggtacccgtactccccgtcctgcaccaccgcgccgctcgccgtgaacagcgcgaagctgatgtccatgccccccgggttgtatgagtagatgaagtatgggtacaggttggccagcagcggcgcgtgcgtccgttccaggaatgggatcacgtagctcatgaacggcttcgcctcgtcggtgaactcgccggcggacggcgggatgtggacgccgatggtggcctgggagatcgacgtcgtcaccttgatgtgtcccagcccggccgccgcgagcgcggcgtggacgttctccatggccgggacgaggagctgcgtgtcggcgccggcgacctcgttgcccacgacgacgaaccggaacaggaccgtcgggtaggcctggatgttctcgcggatccaggcggccgcggcggcggtcccgccgtgcgccagggcggggaggtcgtagttgggcgcgccgacgacgacgcggatgcccgtgccgccgagcgccgcgagcgcggcgctgtccggcgcgtagaggcgcacgacggtgaagccgttctcgcggagcatctcggtgaccttgctcgccggcggcaggttgtcgccgctcatgccccagcatactccaaccgctgccgttcctgtctcagattccatttcaacctttgtcaaattaaagcttaagcttctgatttgattttttttgcagtatacgtaggttaatcgctaccgcattttatagtaacccgaactttaatttgtaggcacgcaagcaagaaattaacgtaacgtaggtacgtatgtagcttgcaaagacgcaatgacaaacaaaatcgagaaggcaatcatatatacaccgtacattagcatgcgtggaaggatccctcttgaactttattgctggaattgccgttgtgttgccaacaattaaaatggcactccctccagtcgtcagggatgatcaaacttttaaaaattatagcagtcaatttatattagagtaagtttattaaaacctaacaaatctatatatttgataatgtttttcaagtcaaatcaatttgtactgtttttttaactaagtatttgagaaattgttgacggttgaaattttaatatttgagttcatgtttcgtagaagatgagatgagatggttgaggagcacagacagtgagatcagaccggaaggaccggcaaggagtcaatccaaacctcgttcgacaaattgacttcagcgacatctcggaagaataatttagactcatggaaactgacgtttaactgaaaacgaagatgtagtagtacaactgcactagcacagattcctaatttccgtcgttttttttcccaatcgtaagtgctctctgatggtactcgcaactaacttatgttcgttaaaaacatgcacctaatcgagttagttgacggcaattctgccaaagtgctttacatacattcagagtttcagactcagatacttagtccgtcgagcaccagttaaataaacaaatcaggtggtggagcgtgcaatttgccgaaatttgttagctaccaaagcagagcatgcagttcttgactaattaaagtttcatgcatactagtagcattattatttgtccatatcttacatgtacagacgaactaactaacctctgttctttagaaaggaaaagaaaaaaaaacaataaccaaacaatctggttcacaaaatcacaacctagcaaatttgcccatgcaaacaaagtagctgtcaggtagaaagcgaaggaccacgtacgggaaatggaattgaaaacgtctgttccaacgtctgcagcacgactgttggacagtccaattcgttcgcatgcatgcaggcatgcaaccgtgtccatttcgatagctaacaggattacaggactgcaccagcctgcccgtgatcacggccggcctcgccggtcgcgcttgtttgttaatcaagtgcagaaaagccaaacgatgcaaagaaacttccttttcggcttatggactaatggattgtcaccggcagtcatggtacactttctaagcctctaaacgatgtactccaaaaattttcttcaccagcctttgttagaaacaatttttaaatcaacttttaaattttctaatatttaattactctcaaataactgttacgaactcagtttgtgctatcatccatcaaagggatcgggctgagttctttctccaattttcttaactcatctcccttatttttcacgcgcacgttttttaaattgctaaacggtacgttttttataaaaattttctatatgaaagttgctttaaaaaatcatattaatcgatttttcaaaaaaatgctaatatttaattaatcatgtactaaactgctccattttacgtacgtggaacgaacacagcctagtccatagattttgggcaaatgagttactgacaagctggtacgtgcgtactttcacctctcctgaaggaatcgtaatctagcgtgcagtagtgctggtaaactatcacacatcatgcatcttaatgacgcccctaaaaccaattaattttctaacagaatctagctttgtggtaccatactagtttcttaatacagtagtatgcgtaatcgtgcacgaatttcacaggaacggtgagaattttcccgtgtttcatcaaaccaaacgtttgcattgtatatttccatgcatagcgttcatgctgaagaaagagatgcgtccttgaatctacgctcgattgcttacatgttttgttttcttaccgtgttaccgtttcactaaatgagtatctcgcgtaacgcttgtcatgtagtactaatgtgcaagatagtaactccactacttgaaatcaacaaactcactcgtacgttcggcaatggcttgcacaccaatttcaactttttcacggcacaactcttcacataggacaataaacttttcgcattgcaagctaatacaaaaaacacaagaactaaacagaagcagagtatgctagaagaaaagcaggggaacaaaatcagtgagagagttctgtacctgctaggatggaggcaaagactgcaagtagcaacgccatgtcgagcatggaagcagctgaagacgccattctcaagctcgactcaacctgtgacatctgacctgttgttgcttcttgcagagcctaacggccacgagcagaagcgctactactcccggcttatat

SEQ ID NO: 59087 - DNA, 9560 bp, Oryza sativa
  unsure (1)..(9560): unsure at all n locations
gtcaggttcgtcttcctcgcgccgccgccgccggccgaaaccctagcgcaagccgccgccgttcctttccaaattcggccgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaaggcttgactcctgcagcgggcgactccattccacaagcatccttgactgcagcgacgaaaccaacctcttcgagacatcttcaactgagaaggacttcaactctggtgtgggggaaaagagagcaagactgagtactacccactgtactcagcaagtcataccagaagagaaggtatgatgcaagatatatccaagggaggctaaaggtttttttgcataaagccggcatttcaagcagtagttgaaagccgtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgacctcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaaatgccatgggtgcgactagcaagaccatgcacccacagcccaccatgacgtgtattttaattaaccaacaccattacggtggcactaaatcaaagctataccaataatcaagtctatgctttaatgtgatccccctttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggtgaaatctacgcgacaaacaaagaacacaagcaaaacatgctataagactactgaaacagataacaaagccatttttaatggattctacacatttttatgaatttactgagacttgaatggatttaatcggagctcggatgaattagttatgatttttagaagattctttgtgtttttactattaaagaaaagccttaatcaatttattgcgcaatattgccccagggctgacgtcagcaaggggtggggcggcgccgacatgcgggccccactagtcagcggcactaagagagggagagggggcggctggcaggtgggcccactgggcagcgtcacaagggggaggggaagcggcgaggcgcccggtcggtccggctcggcttcaagccggccggccggttatggcgagggcggcggtggcaagcggccaccgacggcggcggccggcgatgcaggcgacggcgattcacggcgaagcgcatgcggggagcggcggcgcgcgcgagaggaagagaaggggagggagttctcaccggggttcggccggcgcgggaggatacgacggcaaacggcgacggtgagcgaccggagggcgacggcgacgggcggacgggctccgggacaccctaagagaggaagtgagagaggttagatggagagaaggtgtccacggcgagggagagccatggccgacggcggcggctatggtggtactcaccggcgcgcggggagaagcgggccccgacggcgggattggatggggatgcggcggccggggtagctttggcggcggcgaagctagcaacggtggcggattggcttggcagcggctccagcggcggcgagcggcggccggaggagtggaaaaggcggcggcggcaggtatagcggcgcggaagcgatagagggcacgggagggagcggtggaaagaggaaaaggtggaggggagtggagggatggtttatatgggctcgggaggggcggacgaggcccggaaaggtggccgatttggccggcgacgtgtgggaagtggaggaggagagagagagtgggggaaatttcaaatcccccgccgtttgcgggcgcgcgagctggcgggaggtgcgggaaaggtgggcggcgacgtgggcgtgcggtacgggcggagtgggcgcgggaaacggggaaaccggcggcggcggtgccgtcggctagaggaggaagaaggggccgacaggtgggccccacctgtcgatgacccggagagaggagggagggagtgggccggcccaactgaaaggagggcgagcgcgcgggaggcgaacggactgggccgacggcccaagaagagagaaaaaaggaggaaaaagaaaaagaagaaaggattttccagggatttatatattgcacatgcttatttttaatgggttaaaattgtttccaatgctctgaaaattccactaaaaatcctgttagcatattttgacatgtagaatccaagaaaaattccacatgtcgattccaattattatttgcatttattaatttgagaaattagctctaggttaaaataaacaatttcttcggacgatttattttatgaatttagagcaagggaggggtacttcagggcgtgacagccgcgtctttccttctccggtgaaatctttagaggggaaatgatccttgagatctcctcttccttttctcttttggaagcatcgcctaattcggtttggaaactcgtggattcgagttcgattcggatcggtctctttcctccgaaccccgacctttccttctcatcgccggcagccgtgggccttcgccgccgccttccaacccctatataaggatccccgagctgtcctctttctgccgccaccctcgccttcgtctctcgccgtcggaagcgctctagcgccgtgtaacctcgagccaccgtcgtcgccgccgctccagccgtgcgccgccgttgctccagtcgtcgccgtcgctcgaggaggtcgccatcgtggtcgccaagtcgccgccgtcctcgtccgtcccttcgccgccgccgaagaccgccggagcaccgtcgccgtcgtcgacccgatctccgccgccgcttcttcctcgtcgccggcgctgtccgttgttcctccgccgcttctttggtcatcggtgagttcgccgcgtcgccctctacccgttggtgccctccgttcgcgtcgccgcgccgtcgttcgccggcgagcatgcgcgcccgagccacctgagccgccgccggtgctgacgtcatcgctaccgtcatcgctgacgtcatcgggatcgtccgccgtgagccggccgtggaccggatgttctcgcccgtccgttttggatagggttgatctcggccgtccgttcccgtgaaccgccgctgtgcacccggtccaccgcaaaccctagccactgacgcaataatcctccttttcctttttgaaaataattcattattgcgtcataattcaattaaaatccatataaaggttttaatccgatttaatctttaaaaattcataactaattcatcttagctcggtttaatgtggttcaagttgcaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcaaaggttcgtgagtgcgccggaagtattcaagaagattaattgaagaccgattattgcaaggcaagtcacactgatcctaaacacaatcctttgaacatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatattggttcaactagatattagatataattgcttagccatgcttagaaacattagcacactattgggataatttatgactcattatttaatgatgatttaatgatagttcacaatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatctaggaatggtgcactgtggtgagttgtgttgtgcaaagggtattatcacagcctctattcgggtactttctagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacatctctcacaataattatggatgttatacctggtaataatttgcttagctcctggtttggagttaaatctgtacagccgggtatggttgttcaggatggttgggcctgtgcagcatgggtgtgctgttcagtgttgattanaatttctgattaattacttcactgttttacttctcttaaatgttttgctaaatgctgcttttgcaaatgagcctatattatgccctcctttggtatccttgtgcacttgcatatttgctgtgtggcttgttgagtatgtcatatgctcattcttgcaataatcaatcaacctcagttgaagacaagttgcgaaggagaagatgtttggcttataccccagttgagctgcctgtgggagtggagccggagcttcggtagattttattttccactgcagtttttttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacattatgtcgtgggcttagcctaaggggatgtgtgccctaggcaaccctaggatgtccctaatcatatttattcagtagctgtcatagtttagagtcgagttttgtttagattgatctgtcaagaacagttttgccgctaaatcagtttgtgaaaccccaaattcgagtgcttaatcattcatatgctattgtgttgcaatctatcttgtttttacttgtgttcttcaatttgtatacaggaattagccttctcggcgaggtcaaccgggttttggcacggctgataaccagaggagacgttgtgctgcgattgcggggctcaagagcgtgttcgttcagaagccggatcgagttgtgtcacaacaccactaaatcgactgtttatcaatacctatcagaagatcgggacctaacatcctcatcagttggtatcaaagcgccagattgatcattaggtaatttatctacccataaccagacaattgccacacaaaaatattgcatccattacctagccaatttgagttgttgcgttgttctattagtttttgtgttgttgaattttagattgcatcgtcgtgttgagtgctggtttagttttagatttaatttttcgttttgagtattgcatctgttcctcacttaggtttagggttcatcactcaaatctgtgtgagttttacgttttgggtccagcttttttatctcgtcggttgttgccgagaccttaaaaaatgggatctaatcatcatcgggtttccgttttttagtttggagaagtattcatcgagtggttttgaagtttctcgatttctagggttgcggtgtgcccgtgcttctgtgtgctgtgagaatgaaaagaagaaaagtatgagattggttgtttactgtggattggttttgttggagataatatagatcgattttagttggtttccaaatttttagggagatctgtttatcttcaacgcccacccatctctctctcccacttgaccaagcccgtccccaccgtccacctcatcgagaaccgggtaccgacctctccacctacgtgtaccaggtattgagtacgtagttttccttatatcatatatttatggtatcggatttgagaggtattccatttttgaggtgatccaattttagttttgcactttgcatttgagtccatgtaatatttatatttatatttgagtccttggttgaggttaatgatcggttcctgttgaaaaaaatgaaaaggcagaaatgtgcagagaaaaagaaataaaaagccgaacctacaataaaaagaaaaaacggcataaaggtagttaaaaaaagccgcacaaaaaaaggaacataaagaaatttgtttaaaaaataaatcatcctttcagtatgttttgagagtgtagagttgtgcattgattcatatctagtccttagtgttgttgggtgtttgcttgagctagaattgagtgtaagctaggccaacacattgactagtacattgaactattattcatatttgcattttctgattagcataattgcgttcctttgctactatatattgggcctcccaagctccacatatatacttttggtcagcaccgctttgatccttgcaatcgccacatcacgtcattagaggtgtcaagaaccagccaccggttgtctgtccttagcattgctggtaagacacttgtaagagcttggtaagacgctgccatttactagcctccactacaatccgtgttctgtagttaatagggataatactattctgttgttctctgttttctactaacgatggcaggttacatctcttgtggacatgagataaagttggatgggagacaaaccatagttgctacatcaccttccacagatgcacatgatgtaagtactttggtacaacaagtgctaagttctcagatgaagaaagcggggcaaaggtagtgccacaatttatttgaaacaaggtttgtggttaagaaaaagaagatatcgtgttataatcgatagtgggagttacaataaccttgtgagttcagatttagttgagaatcttgagttgcatgcacaaccgcatccttatccatattacatcaaatgggtcaactcttgtgataagttcaagttaaatagaactgtgagaataaaattcttgattggaagttaccatgatactacaaattttgatcttgtgcctttgcaagcttgttctttgatgtttggtcaaccatggatatatgatagtattgttttgcataatgatattgctaatacatacacatttaggcataatggttaaaaaaataaaattgttaacaatgagtaattttgaaattttcatagataatcttgaaaggttgaagaatagaatcaataatattgcgatgccttcaactaactctgagttattaaaaaatgaatgtattgttgtgcctcttgctttggatactaatattttgcaggtgtctgagaaccacaaatgtaactaggaagagaagaaacacagagagaaaaagacctatccatagctccatgcatgcttgaggaatgtttaattgaccaatcgcctataatttctgaagataggaaaaaaggtaatgataatggtgctacaactactcaaggtatgcataattatgatgtgccaactgttgacggtcgttacagacaaatttcgaccgccaatagcactaaaataatggagaactaacaattcttagaatgaatgtttgttttcaaatgatatagttccacttgtactcggagaataacatgttgtagggatttatcaaataaaataaagagaaagtgaagaaaccttactcctaagcaagcaaatggataagatgggcccacaagtcaggtgtaacagtcggaaactaactttaactgccacaaccgcctaaaggacccacttgccagccactgtactgaaggagaggtcggtcggagccgaccctgaaccaggggcaagccggctcggtctccccttccacgtggacgtccagaattgcttctcaatgacggttatgagggtaaaatggacatttcgcatgggagaaaccgtcatactagccctattaaaggaggagctcacttcacttctcaacacagtcaagcaagctcaattcctctacattagtattagtagtatagtgctaagtggagtagtgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaatacacaaagttgaaatggttttataaaaagaaaaatcccaaaaagtcttctttccccccccttcccttcttgggccggctcggcccagctccctccccctctctcctctccccagcggcccatcggctctctccccgcgcgcgcgccgctgacgggcgggcccgcccgccaccctcgctgacgggtgggtcccacctgtcatctcccacctcgcgccgagcccgccgcccgcccgtgccctagcgccgccgccgccgccgaatacgtcgcattccgtcgtccccgagcgcaataaagaaggggaaatcactccccgtgattacctcgctgtttcccccctcttttccatatctttcttcctaggatgcggacggattcaatcccgtaatcatcgccggcgcatcaatggcggccga

SEQ ID NO: 59088 - DNA, 25829 bp, Oryza sativa
actgaagctaaaatagagtgaagtttagaagcagcttcactttctcccaccccccatgcaccccttcccttgtaagtgtgcggagccttgtgcaagcccagcttgcacagacaatggcctgggctccaccagctgcacgcatcaattcaccagtgcctaattaccttagtaatcacttttcttagtcaccggcaaggcagtacaatgcaactagtacaatcgcaaactcgctcaacacaaacttttaaaacaaatgttcatattgaagttatctatgatcaaattatataggcttgtatatacctcatttgttgttagacttgcccaggctcatgaaaatttttgaatccgccactgcttttaacctgcatgtagagaaattagtaaagtgatatgttggatttctttctcttttgcttttttgaaatgtttcatatcgaaagtggaatacagattgcagagtataatatattgggtcaaaataagaaacttactagctgtacattgttaatctaagttgctaagtgcctacattgaatataaactatacttatacttactagtttcttgccaccacacaatgggggaactccactatttcaatgtcataatctccatcttctccatgtaaaaccagtccaaaataagccatttatacaaagacttgacaaagataagcaaaaaataagcattacaatatattacatacacaagaaggtgcagtattgtcattttttgaggttcttatccaacttgatgcataaaccaaagcatgaaccatgtctcgcttcaaaaaactcctgtaataatcaagaattcttcatccaatgctaaaagtggactctgatgatacaatactagctggaatagtcaagaaccttcttgccttggacacaataggaaaccatgagagtgagaaggggtcaaaaggggatcaagagctaggcttttgatgttctagggccttataagaatatgggttgtgacttgctgagctgtgggctactctagctcgtaaaacacacattccagttcgagctggcacgttacccgtaacgagctaaaataccagctccatttgcagatctaggggtggtcccaggaccacccaaaaaaatcctagcccaatacatatatacacatgtgaaaagagaaaaaacaacctagaatacctggatatggcagtcaagtggcatatccatatcagatacgtgaacagatatggatacgtttccatatgtgccgatacgtacgggatacgtatccaacaatttcgtaatttccaaataaataaaacaaaccctgatacgtcgctgatacgttttacgcccacctccgaatccctttccaagcgcagggctgccgccgccagacacaacacccgcacccatcgtgcatcatgccctgcctggccgccggggccaagaccgtcttccttgtgctctcgctcgaggcacagcatccccacacgattacaggcttgtagcgccgccgccaccaatgccgatgaacagcgcgctgctaccaccaacgccgatgaatgtagctccactgcagtgattcatttagcagtcatccgatggatctgaaatctaagtttcagagctagtgcatccatgcatccaatgctcctatgttgagttgtgatccaaatttgtttgcacataataaaggccagcttctgctggagcgaagcggaggccgtttgaagccggaggcttgggccggagtgaaaaatatcttcactattcgttatccttttaaggtttcaccttcatatatatacctcctgtaagccaccatttagcgtcgtaacttcaccccgatataatgaagatattttgctggctggcgcccgcagttttttttctcctgctttgggagggttttccacgttaaatctagtgtcttctgtgattgatctgttgttttttatcgtttatttgcctatcgtttcctaacatcctaccctcgaaaaactagtgcagctgctagataataatgaaaagaagcctcggtggattgtggcagtctggcagacaagagcgggtataggagaaagcacattgatttttctgtgaataatcagcaggtagcagtccgcaagtttattaatttttctgtgaatgcattggttttcacaatatgttaagagagtttattagttttaattttttattacatatatagacgtatccccgtatatatgtttcttgaaaaatgccgtatccccgtatcgcgtatccgtatatatcctcgtatccggtaacataaaaaacaactcccagtcactggtagagaaaccatctttggtcggtcgacccaaatccacaatagtcccggttccattaaaaaccgggactaaaaatgatttttcatttttagtcccggtttatgagagaaagatctttagtcccagttgttgttaccaaccgggactaaaaatcatcttgagtcccggttcataactctaaccgggactaaagttcatctttagtcctagttgattccatgtcaggacgtgtcagggccctaaaatctttagtctcggttagtaacaccaaccgggactaaaaatctatttttagttctgattgatgttactaaccgggaataaaaatcaaagcatactatataatccctagtaccgatcctcttttcccgtccatacaacaaactccttactctatctcttttttccttctaacttcttatctctttccttatctctaactcctagccttcttctctttccttttttccttccattcacagctagcgaagaagagggcgcgcgggcgggccagcggccggcgcagcggcgcggcggcagccggccggcgcggatgggaggcggccgtggccggccagcttttttttttttttacaatttatgatttatcctgtgatgtattcgatttgtgtgtgatccgaatctgtgatgtatttttttagaacttgtgatgtaatttttttaagagtttgtgatgtatttggagatgatatatttgagaatttggggatgttttgtgatatgtgatgatttggatttgggatttcttgataggggatggtgtgaaatcaatattcaatactaaaaacaatgaaaaagagagaaaaaaaagaaaaaatatctttagtcccggattcgtagtcctggttggaaaaccgggactaaggggggttacaaacgggactaaaaaacacttctccaccagtgcttattactatattatgatgcacctttgatcaatttatacttgtaactcttgttatatctatgagatatatatatatatatatacacacacacatacatacatatatacatatatatatacatacatatatatatatatatacatatatacatatatacatatatatacatatatatatatatatacatatatatatatatatatatatatatacatatatatatatatatatatatatatatatatatatatatatatatatatatatcacctatatagaaatcttgcatatgccattggccagctttgctcattagaaaaatgaaattagccaaggaagcaaacgagccataagcttcaggtccatcctatgtcagagtcgtgcatgcaggcagatatgctagctggaatgtactaggttgcttaggtggattcgatcgaaggaagggattttttttcccattatatagataagatgcgcaccgtcaccacatgcacacacatcatactcacacactcatgactatgttcttttttaacatacggtaaaagagacggagacaaacaacaacaatttacttaaacttctgcaggctactatttctgcaaataatttgttatatatttatcgataaattttttaaaaaaatttgacatatgtaattgttatgtagtgtagttacattgtaacttgtatgtaattacaatgtaacttttacatcattttaaattgttagattcgtttcaagattcgtgcaagcgaaaaaattacagtgcatgcacatgtgagaggattcactcctatgatgtccattttatggaaatagcatgtttcgaagggatttttaaaagttacatacaagttatattgtagttacatgaaagttatgatggaaattacaccacgattgtattaaaattatatttattaaatcgttggaagaaaatttatcgataaatatatatgtgatcccttctgccaaatactagtaggcatgtatatgccgacaaatttaaacatcaaatgattcaagagccaaattaacccacacaatatatataagaaagaacaatagaatcttaatcatgcaatttggttgaagctgtcctatactattatccttttctataaaacagattagtagtactatgctctgcaggagtactactcgattaaagcataactttgcttgctaaacacacaccaccgatgggaaacaacagagcatcaagggtgaaacactgcatatgcaatgtgcacgttcacagtgcactactcttaaatcgatcaaatgtacggcgttaatgattttaaacctgcaaattgggcgcaaattgctgatcatgttgtaatataattagctttttctttcgagggaacgtaatatgattaactgacgcctatataaaccaagcatggcctttgctgcttcttccctcatcgacacagcagtaagaaactcccaatattaaggaggagtttgcttagattcattcaacaatggcaggtggaacaccaaccctaatccttggcgcccgtcgtcgtctgcgccgcccttgtgaggctgcacccccccttccgaccgggaagccgcggtggccctcgtcgtccgcttggccaaatgccgcggctgcttcaagaagaacatcaaggcgcaagatgctttcaagggtatatatatcatgcatgatgatgataatatgttcatcgataattaattgcgatccatatatcaccgtcgttgattaattgtttggtgatgttcaagtctccaggtggcgatcaagtgcaagaacagcgacggcgagtacgaaagcaaggccgtcggcgacctcgacggcgacggcgccttcagcgtgcccctcgccgccgacgacctccacggcgccgccggctgcttcgcgcagctgcacagcgcggcgagcagcgcgccgtgccccgggcaggagccgtccaagatcgtgccgctgccatcaacgacggacaacggcggcaataaggctaacaccttcgtcgccgtcgccggcaagaggatgcactactcgtcgtcggcggagtgcacctcggcgttcctgtgccccttcttcgactatttctacaacagaccccaaggccccaagccgacgccggcgaacggtggtggcgcggcaaacggtggcggagctgcggcgccggctcccagccctccggccggcatatcacagctgaatttttaattcatccattccatcaatatccacacttgcttttttgtttgatttcatggcttggttaatccttttggttcttgcatgattaatttccaggtcagcttgttggtgcagaataataaaagttgtgagatgtgagaggagagtgtgactgtgtgagatcgatcgatcgatgtgtgtgagaataaaattaagttcgtgcagaagtgcttgtgtagtacctccatttattggcatatctaatacactagtaataatatgtccgtgctaacgcaacggtgataattttgattgaaacgcaacggtgataattgataatgtaaaaggcaaaaggtaatatttaagattcacgaataaaataacgatagagagatttgtattgttctcatgaatgttattacactgttaataacttcccaaaattggccatgaatagagttctgcaatattttcatcactgtgagtgaaacttttcaaaacacaaacaatagctcatggtatctaactttctataccacatatacaaatattacctgcacgttctacaggtgctattttttcaaaacatgcatcgcctggaaacattcagcaacttctgctcctcactggtcaccttcctccttatagagcacctcaagaagccacataaacttctctatcgaacgcatatcaggagaagcaccatattgaagacagtgtattcgcctaccacgaggcacacgcttataaagatatattcatcacttagcattagtaatttaactcccaaaatatttggaaaaacatcccggtttctactaaggcaaaaatatgtagcaaagcaaatatataggcattaagcatttaatagcaaatgataataaattatttattttaactgaaagcgctaggcttttacatggctgcaattttgttcgtgtaaatgagttgaaaaaggtaaaatggacatgaatactatgttaaatctgcagataaacttttcggatcatggaaatgcatttgtcaaatttcatatgttcagatcaaatttcattataccctgcgaatacacaggacgcataaatcatcaatattgcacagcaccaagagctaggcaccacggaaagcagtccaaaaaaaccataggatgcatgcaacatttcaggaaaattaagaatgatatgatgtggttcaggagaaggagaaggagaataattctcactcatattcttgtaaactatttaattctgatatataagaaaaaatactgaaggaacataaagagaataaaatccagtatcaacaaacacttttgaaagtgcagtgtgacagtagaattcttctgtttgaccttttttcagtgaatagtttcagcatatttggttcaattttaaatgaacaacaatagtcaggaaacctattcatctagatcatagcattttataaacctgctgcgatctctctagaatctcccatccaagaaactctaagcaattaaacgttcctcttccctgccactcaccagcgattctcagcctagcttctcctgcggttgtagaagacaatccaacgcataatcacacacgaaaggaacaaacagcacctaagaattccagatatacagaacaggttgcatgtaataatgtcgagcacgcaacaaattctccacaaattggatcaagaaagagagcagggaaaataatggaaaggaccggacctacgcactcggcggggggagcagatccatctcccaccgcctgacgtcctccgccatcgagaggatccaaacttgcacggttggaggggctgcgtagcaagaccgaggacggcatttgggcacgagaaagacgatctgtcctaccaaaaaaggagtatttggttgagattagctttgttagaaatgaaaagacaaataagataagcaagatgatcttgattttagctgctagaattaaggccatgtaataacaaatagaagaatttcgaaaaattaaatgatttttccattcaatctaacagtgttttgactttgtgattccttcatatggaagggcagccaatttgtaacaaaggcagaaactgggactatcatatcgtaaaaaatttctaaactagtgcataatctcggaagtgaagcctaacctattttccttaacagctaaacacatttgaaacaaaggcagaagctgagacacctgaacagaacaatttgttaagctatttctaaatctagcaaatcaaatcaaaactttggagctgcattagtttgactacaaataagcgtgcagatcgatgcgtgagaccctggggtgcagtggcgatcgaacctgaaatctacttctctttttttttctgcaatgtcccctgtgccggtatgaagtatgaacatgtgtgccgacgttcacctatacagctccagcaatcatgtgccatcatttttattgatggaagagtagaaaaaaatctaataccatgggagattgatttattgcaaggagcagggtaatctggagatggcaaatcacaatagaaaataattcaacttaccagccgtgaccagatgaatttccagccactataggagcatctccaaacctccaattctgatattttggctatgattataggtctcgagcaagcaaactgatgttgcaatgattttagcttcatggaaaaaaaattggggacagatcagcagcatgctaaatatgccatcaataaaaaagttacttaacaggatttacaaaatcatcagagagccatgatctgactctatccctcctaaggttgtgctcctgcagaacaaaaaagaggcaataagcaagtttcaccaacaaaatgcgtgaaacgaataataactcattacacagatttcagttggcaactaaacattgaagtttccgggatataatttaggggaaaacttactgctagcatatgggaatttacctgttcaatatgccagttagcgagccatagcttctggtccattcctgctcaactctatgatcttgctgcatgcaccaaaacaaagcaaaaatcgagtcaaaccaagagcacatagcatcaaaagccccagccactcaaagcctcaacagaagggatgaactgatgcaaggaatcaagttcagggacgtactccctctcctcaagagcaatctcatgaggagatcgggattaacagagagagatgggatctttccttgaccagctgcgcgattccctccttgcccgcatccaccgcacacaccggtccggcagggtccatgggtgtacctcctcattacagccccgaccttggatatcgatctcatgccattcatagccatcctcccggtgcagcggcgccggccgcctccgcctccaccgctggcagtgccaggatggcgacctggtggggagcaaagacggtggcctccatggtggctcgtctcaatggaggaggtgcggtggcatccgtaacccgtagtgctgggggcggggtagggtttggggatttggagcggcggcgcggcggcgataggcgaggggcaggggcatgccggcggtggggtagtgtttggtgattgggtacggcggcgattggcgaggggcaagaatcgcggcggcgatgggtgaggggaacgggcgagaatagcggtgcgcgagagagaagggggcgcgtgagaacaggagttagcgagagagagagaaggcgcgtccgcgcgtgggcgtgaccgcgtgggggaggagcgcggaggggagggggtctcatctggcacgttcgatcacagttagatgaatatgagccattggatttgatgaatgagtaatgtaggtgtaagagtgagttggtgaattatagggtagattatgcattgtatgcatataagctattcctccttcactgtgcaacattattaaacataatataatttaagtattttacgaaagggaaaatagcttcttttatctactataaaaaaatacccgtgtgttgcaatgggtgaagttatgttaatcttattattgttataggtttaactaaggtaaaattcattgtgcgattttgctcgattttcttttttataaaatcatgacccgcagttaggagtctgattttctcaagtttcatgcaagtttttttaaagagatttcttatacaactccttttgtattctcaaaagcgaataaacttaaaaaccgactaaaacacgaatgacgtatcaaagtaccggcaaaaacatcttcaatttttataatagtagagaagtgcgtcaggccacgtcgtacccctcccacttgctgtaccatcggcctaggcacgatccaatatgactcgtgctgtgccggaccagcctgaatgcatgaaggcccaccgtgctcaaccttggaaaaaaattatattttgcgttcctcatctatttgggccattggctagattaagtctattttgcgccgcagctatttgtgccatatataccttatatagccggaataagtttattttggctcgctcatctatttaactccttgattgttggaccggaccatgccaaactggcccatcgtgccgaggaagaggcccacgcaagggcccgacactgccagtcggaccgtgccatgtttaggctgggccaaaaccccatactatgggccgagccattggaccccgggcctttcggccaactataagtgctactgctacgtcttgtcctgcccgcgtgctgaaacatggatgggccatgcatgtaggtctcctgggcctgtgggcaagatgcaccagcatcttgtgcgctacacgcatgcatgcttgcaatccatcacatcaacctgaacccaaatccactgtacgtgcatacgctgatatatatgcatggataattggatatgcacttgtctacatatattagcctattgcaaataaaaacttaaaataacttactactggctttttttatctttgggtatatattccacgtgtgatcaatcgtttataatacggaattggaacgagatatactccctccgtactcgtaaaggaagtcgttttggacaatatttaagtcaaacattaggaatataaatcatgaataacccttaagttgttgagtttgaagatgtaaaaattatatgaatagatttatcttgaaaaatactttcataaaagtatacatatatcacttttcaataaatattttataaaaataaaaagttaaagttatgttttggagaccgtatcgctgtccaaaacgacttcctttacgagtactgagtagtatatatctataaaactattactccctccattccattttaagttacatagactttgaacaaacctaaaatgataaaacaacaaaaaggattaaaatgcatagagtacattaaaaaggtttaagtccatttaaccccgccaagattgtattagtctaaaatataccccttaactttaatatcgggtattacagactcctcaacttttgaaaccgtttaatttattcccttgtccaaaactaaagagtaaatttcagaaaactccatattgtatgattaaagttgtggaaaccatatgtattaattatgatgtgtggcacaccacaagatttatggtctccatgtttcataaaaccccatctttatttaaatcttaataaatttcagcatatctaaataaaattttgaaagtacagtaaagcttctatcaatctagtcaataacttaataattaaattttcatttgcactctacgttttttaattttaagtaaattcatgctcaaaatgcataagggtggagttttgtgaaactttgaaaacaacaatacttgaggttagatgccgcgtgtcataatacatatggtttctacaactttgaccatacaacacgaagttttctaaaagagtaaattgcatccatggtgcatcaacttggcaggtgggtgcaatttagtgcaataacttgagttgagaaatgaacgttctagtgcaataatttggtaggtaggtgcaatttagtataagaactttataagtgatcgtataaatgcaacaacttgcaaggtaggtacgattttgatacagtaaattaaaaagttatgctacaacttgattatttggagcattttttttataaattcaatttttaagtactaattttgacaatatactagcgcatatttcacagatttgataagtgtatttatatttttatcataataactaataactgaaagccaattaaactatatgtagaaattattatatttcggttgatatttgataagatgaagaaaacaaaaaaaatcttaaaggtaattggatgtaaattgtactactatgtgcttataaggcaatatccatatgattactatgtaatggcatattgacatcgtgaaaaaaactcaccttgtatatgcttagccaagttgatgtacaaaaatactaaattgttaagttcttatactagaacgcacccacttgtcaagttgttgcacttggacgttcaattttcaagttcttgcattatatcgcatccacatgccaagttgttgtaccgtgggagcaatttactctttctaaaatttactcaaaagcgaatggttttggtctttgtgattttgggacttcactccgataacatatggagttaaatataagtattaacaactaattcaaaataagagcttaaactaattaagaaggggcaattgcaaagaaagatggtagtaattcacttatactctaacacggggaacgagccatgctagcaaggaatgatgggaggcagcgtgcagggaaggtagtgaattagtagcaacattttattcatatgttaaaaaaacacaaagtatttttctggttattcatgaaagatagattgaaaaataggaatatgttaggaaggatgaattttgaagatactctccaacatctatttttgaccaaccttctgctcaagaatactaatttatactgatccctccatttcatactataagtcattttaacttttttctaatcatttttttatgtttgactaagtttatagaaaaaaattagcaacatctacaatatcgaattagttttactataaatgtaacattaaatatattttgataatacgtttgttttgtgtttaaaatattatacttttctataaatttgatcaaaccaaaaaagtttgactagaagaaaaaaacaaaataacttataatatgaaacggagaatgtaattaataacttccctagctaccatatcggttttctagatttttgaagtttttgcaccttgggatggatgccacatggtatcttttgcaacagtgctccttgattgagtgggtgaaactagcagcacatggttcaacggtcatttgttctgtatacttgacgtgcatgctgacatcgtgtccggtgtggttaattgccgctggccggttgtagcgtgcatgcaagttgaagccatatttttactgatctctctgaagatacatatgtttccccttttacatggagattatcatcacaatggcttggagtatttgaatcacaagcaatcatacgattttcagaaatataagtcctattcaagtttgtaaatccagacaaaaatcaaattttgtcttggttatctagagaacaaaatagagttaccacggatctactactacttttatatatatatatatatatatatatatatatatatatatagagtttaagatgtttccttcgtccgttaataaaaaaatgataaaaaagtccgattgtaattaaaaaatcccagggcaaaaaaatgcggcaaaaaaaaaaagctgaccgattcctattcctactaaaaaggcggaaaaaaaaagtgcggcaaaaaacgattgtaaaaaggaaaactatgtttcgctattttttttttgcggttttttcgtcgggccaaaccctagcgccgccgccatgtcgatttgcatctttatgtgtttcctcatccaattgattgcaaaaatcgattctccactactctcgtcattttccccttgaatttccctttcagttcattatttttttccccaagttttgtggattgcttcgattttggtaaaaaaacgaaaaaggggatcaagtggatcaaaatctctaataattttggagatcgagaaagattcgaccgcatttgacagagaggatcaactccgccatcatacggacacggtactatgcgagctcgaccagattaccggatttgatgggaggtttggctccgtcatggtacgggcacgagattgttcgagctaggcctacagctccacttgtgggctgaggcgaagagagataggccgagcagatagaggtagcggactgctctaggactagagctgaaaagaaggaaggaatgaacgtccggtccaaaaacaaagaagcatccggtccaaaacaaagggagtataatgtataggataaaaaaagtttttacccgtagcaacgcacgggcattttttctagtaaaggaaaaagtacgaattaaccccccccccccgaactatcacggtcgtccgaattacccccctgaactcgaaaaccatacattttacaccctcaactactaaaaccggacaaataaccccccgagcactgttttggacggttttaactggaatcagcatatgtggccgccaacgtggcatctggtcagcaaaataaaacattaaaaaaatctagtcccacatgtcatctctttcctcacaccaatccctccccaatcccattccccctgcttcccttctctctctcttgctttgcgtctacggctggagaaggaggagatggtggccggtggcggaggcggatcgatgcacggagcatgaggctcccgccgctcggcgacgtcggtgcgccggcgagcctccgcagaagcatgaggcggagatgagggacgagcacgacagccgcctttggttatgggggacgagcacgacatgccgcgcacgacacccgccgtgccctccccgaggaggactcgtcgcccaccgccgttgacacggagctcgagaggggtacctcaccgtcgtctccagggaaggggggagcagcagcgcagcgcggggacgggcggtgggcggcggcgtgtaggggcggctggcgcggggacaggcggtgggggcggtcagcgcgggaacaggggtgtgtgaccttctcgtttttgaagcgcgtgcggctgttgcggtcggcgcgcgagggccagcgacagttggcagcgcgggccatcagcgggcgagggctggtggggtgcagcgtcgcgggcggtcggcacgcgaggactggcgacaagtggcgtcgaggtggtgaggactactgttgacgccgacgtaaacgatacaattgcctggaccggtgaaacattggacttatcccttcgccggagatcgaagacgatgcagccccgcgtcgggtgccaagttccgccggaacgtaaaaacaaaagtagaagtaaaaaaggtggcgatgcgccgaattgtattgatcgtgaggacagattacatagaccccaggtgtacatatttatatccatgggttgatataagtccttgtcggacaagaaagaaactttcctaaagataaaaggaaaagataaagtccttataggacactaaacacactttcctaaagataaaaggaaactaacaaactattcctaattaatagataacttaccatgccgtattctctttaaactcggtctcttctggataagcttcctttagtagatcaatttccttaaccgaatatagcaagaatccgacaactgacgacttgacaactctcatcggctaatctcaggacttcgaagccgatgctgactctacgccgatgactactccgggcttaccaaatttcactgttaacaactacgtggcggagctggagcgcgcgttggaggtggtcgagacggagtccgcgagggcgcgtgtggagctggagatcgaccgtgcagggaggaaggtcgccggggaggagatggacgacgacgacactgacagcgcctccgccgccgtctcgcgccccgccgtgcccgtggtggcggaggcgacgaccgtgctgttgctcccggtggtgcacgaaggcgacggcgacgaggcgctcgcccacgcaccgaggcggaccaagacggacgtggacgtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccgccgccgctcacccagccgcgcccgcagccacctccgctcgctcagccgcgcccgccgccaccgctcgccccgccgctgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatatcctatcttactataaagttatcccccactaacttcttaagcttaacatgcaaagatgccacatcatcatccactaacaagatgccacatcatcatccactaattaacaagataccacatcatcattcactaacaatcatcacatttaaacatcatgcaaacatgctatatctttatagtttttataatttaagagcttttcaaatacaaacatgttaaattataatctaacataattatgtgaattcacatcatgtttcaatgtatatctttattatgttttatgatatcctatatacttatatagttcatcctcacttagttagtgcttaaatgattaatctatggttcaaattatctttctctttttttcctctaattaagtcatatcacatcaattgtttttagcctttagatgattaatctacggtacaaactatctccctacttttcttcttccataaagtcataccaccttactttttacgtttgaatcaccattctacatactatttaaatttaaattatcgtaaaccacattaatttacttaatctgatgttatctagttatcttacacgttattttttttattgttatcatactaaatttccgcagtaatgcgcagagtttcatctagttattgaaatattcatgaagtaacagaaaaaggaacacctgtaactgtcgatctattattaactcaataaaacaatataaaagccaccatattcactctcatgacctagaatttcccatattaataaaaaagaaaaaaatagagtccaagtgtatagattaaaaatatctgtaattcggaataataataaaaggataaaagaagtacatgtagaaatgcaattttgaaaagaaaacttaaattcgtatttaaaaattaaattaagacaagagtcaacgtagaaataccttttaggctgaaaaatatgaaattcggattaaaaatttaaaataaatattgaaataaaattatatgtataaatataattcaatctaaaagtcggaataaaaattaaaactacaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaaggaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttaaacctgcaaattcggcgcaaattgctaatcatgatgtaatataattagctgatctcagctcactcccagctagtagcctttatcgatctatataaaccacatgcatagcctgctttttcttcactcatccacacacagctctagcctcttgctacatagagtttgcgaggatttatcagcaatggcagctgtagcacgagcactactcttcgccgccatcgtctgcactgccctcgtgatggctgtcaccgccgctgcggacggcgaggcggcggcgatcgtcgtcgggttggccaagtgcggcgactgctccagcaagaacatgaaggggcaggatgctttcaagggtatatatatcatgatgatgatgataatatgttcatcgctaattaattgcgtactcagctcgatcgatcgatatatcaccgtcgttgattaattgtttggtgatgttcaggtctccaggtggcgatcaagtgcaggaacggcgacggcgagtacgagagctaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaatataagttgtgagatgtgagaggagtgtgactgtgtgagatcgatcgatcgtgtaggatcgaatcacaagaactaagccaaccagagggggtgaatggttggtatacccaaaaaccgaaaacttttagcggaaataaaagttaccctcgaaatcgatggagatcggtctgaccgaagtagattagccggtctgaccgaagcgtagcccccggtctgaccggtgttgatctaccggtctaaccgccgtgatcgcctgccgcctactgtcgccgccgtcggtctgaccgccgtgctcccgccggtctgaccgccgcaatgccgctggtctgaccaccggtgagttgtcggttagaccgccgaaacccggtgaaacacaaatcgaagaactcttaaagtgaatgacgactttattaattctctctatgtttacaaagtgcaccaacaacactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcgtaccaaatttggactccttccaatttcgactccgcatcccatacgcacacaataactccatcgtatgccatatggaatctccatcaaccacgtgcatcaactctagccttagtatcccgcatgatctctgaccacaacggacgtcgtcttatccccaagccaactcccggtccatcaccgtaaatactctcccgagacatcgagtcacctacacatggaatagacaaagaaaccatattccgagaccaagctatctccaacttgactcattagcagtaaacaatagtattacatacgtataatatccatctagaagtcataatcatgaaataaactcggatatccaaataaacaacccgaaaccgaaaccgacacagtgtcggccggtcagaccgcgggctggccggtccgaccgcttgatcaccgctggtctgaccggcaacacctgcccggtctgaccggtccacataaaatgataacctgtagattcacctgtgaaatccaatcatctccaaaccacttcgtgaataaattccaaataacaaaaccaataatctctaatgctcaattgttcatcacagaataattatcaaaaacacctttgattttacagatcgatgtatgtgttggagacttggagtcagtgcataagcattggctttcaggtgataaataatttcagagtgcttatgtgtgtcgtgtctgtatttattcgcacatgtaatgcgacatgtgttctacataatgtaatttaaatatttataagattgttcatgttgacgtagaatcgcaatgccacaccttgagcacgttatgtgtaactcgcggcagcactcggagacgcgccatcatagggagtgggtagatgccgcccaacgaccacccgcgaaggaccccatcaggatgaacgtgcgtcggtttgttctaggctcagcaggccaactaggacgtcctctaataccgtagagacgagagatgacaagtaatcgaggatttgaggatttagaatttggataggtagcaagaaggagagagatgtagaatatagagggtttggataaataaattgattttgatgcatgattgattgcttgttgtttcaatcatccttggcccccttatatttataaaaggggtggacttgcttcctggggtttttccatatgcatttaggcatataaatcaactaagacttgaaaatttcggtctaaaacaagaaaacacgagaaatatctaaattggacttggactatgtgattaagatctaaccgcctggataccaatggtctaatctcagtgcattgtctgctttgaccggccacataatgacggttagaccagccttcgcgggaaagctctggcattttttaaatttggctcaaacttgctataactcgaccctactaccaaatttgattatcaacacatgccccccctgtctttttggcaaacttatgagccaaaaaaatactatgcatgagatcatctaagggcgatatccaccaataccgaccatgaattcctctaaggcttaaatgtttaatggtgatgtaagaaagctacgagaggcctctcttgttcagattgtattttgtttttctttggcctccactcttgcctcaccactttcttgtgtggattcttttgtgactgattcttttctctcaaccggctatgagatgagtgtggttgattatttaaaatgggtcaatgtggaaactggcaatgcccataatggataataatatggtatataaaaaggcatcatccacataccattaaaaatctataatacatttataccaagcgtaataccatggaaaaggagaagtaagttgccggtggtgcatactcgcttggtagatgaacttgatctccttggtcgcttgccatattttgatatctccagattgtcgtcttgcctcctaagtatttgtcgaggaatgatcctctctagcaggtggtcgtgagacccccccctttgtgagttcggccgggggaaatggcacgatgatcaagggcctacttccgcttgcggtctaatcgctagatcgctctcgtggctgtgtgggagatcaaggattatacaggttcgggccgttattgagtgtaataccctactcttgtgtatgggattatggtgaatttttacatgaggttttgagctctaagggaaacctagctgttcttcctccgagctcaagttctctgagagtcgtcccctttctcggtgggcgaggtcctccttttatagtccaaggggataccacatgcactgtttgcacctacccctccatcggagggggggcacatggccctaatcataccgctatcctttgcttcaactggaagcaacatggtcgcctggctccaggtggggcccagcgccgcccccgcctgacacgggggacatccctgtcattccctattattgtatgaagacttcggcggctcaccacgcgcgtggggcgcccctggaagcgtgccgatgggacagggcatacctgcccccactccgcctgacacagggcggaacgtgggggcactgcccccgtcccgtcgcctgtgaccggtcacaggccggtcaagctcgattgatatggtgttgacggtccttaaatcataatatcggaccgtcaatacctgcatataatgaaataaaacatggtatccaacttagtggtaggtattattactaatcatttccactagtattggtgaaatatgtgtatgcaagtaatttgaggagaaaacacatccgtcatgtgacaaaatgcacctccgcgcattcaggacgcgtttacacggattagaggcccaataagtcaataaaaaccatttagaattgggccaaaacatagcccaggttgttgggggcccaataagcaacctcccggctgaaggagaggccgggaggagagtttttgggtttggccgaacccaccagttcggacaaaccaatcctggcgcttcccatcatctgctttcacctggacggctcggatttctcccctaaggcagttgcagggtgttttggtcatttcccatacccctaaccgtcatttggagcctatataagaggtcacattctcatttccaagacacacaattttgagctgaattataagaggctctattgtatcttttgtacattataataaggtagagagtgaggggaagctctggaggagtgcccggaagtttggcgctcatccgacttctatctcgacgagtgtagcttcctaggaggaattcggggggagtaccggagctgtcggtacactctgctctgggttcggagaacctcttctataaagtaagcattcgtgttcctttcttatattatttaattactttgtctaagtaagatagattttcatctttgcgggttctttatctagtattcatactaagtgctctagtactaggactctggataaagaaggaagttcatgtacaagtattagagtagtaattaataacttagacgtggtgtctaggttagagattacctttgtttgttgtgtatcccacggatttgtcagaggtaggcgacaagtggtaacagccctgaatcccgtcctaataattctccacgttcggatacatcatagagctatagccggaaccacgctggcagaccagcaggggtcggtgcccgaagcaacaaataggaaattaccttcaacttagcttagataattaaaacacatagaaagtcctctctagcttgcctagcctatctatagttgttgtcattggatcgtcttagccttaggtaaattacacacgttccctgagttcgatatctttttggggtcacccgaaggtgaagtgctacaacagtattccgtgcgcttgcggatttatctgtggacgtaagaaataccaacacatgggtcaatcgagcggcgccgcacatccctccacgccgcattaaatgctgcttggggcggttggtgcaccgcgcattgaaggcgcggagcagtgtctttcgccccgcccgctctccccgccacgaggtggtcaggcgagggcctcggggtagcacgccccgaaagcccgaggagtgcgacgtggcaccccgaggtccctctggccacctcagcgctacccgaggggcggggggaggcgaggccacgtagccacgcgactagatgggaaggatacttccctctactgtgcgtacccccgggcccatttcaccgacagtattgaagtcttcaatgtggtcttctccttgccatcgggaatctccttctcttgcaattcaacggtctgtataggaaaaggtagctcatccacctgcatctttgtaaaagtcaatcgtcattcgtcaattgccgattgaacttgtctatggaatacattgcaatcatttgtggcatgagaattggagttgtgacacttataatatgctcgccgctctattcttcaagtgaaggtatggcgtggccatgtgacaatttaattttcttcttttactagtaattattcaaaaatcctattgcatttggccacatcaaacgtgaactttatttcctcttgctgattcttacgactaaccagcttaagagcggagcaaacggatggtttagagttggagttcaaaacccatttgtgtatgtatacatcaactgtctctttgttcaaagattcttgttgatcaactatattaacatgggcacaatcagacttaactttttgcgagattttggcctctttaactcggctctcttgagttaaagccttttgaagtaattggcttacatctaagaaagtatgaccatctagcttttcttttaaatattcaagtaaaccagaataagccaaatctaccaagaccttatcagaaagtgttaaactataacatcagtttcttatatatataaatcttctaatgtattcaaaagtaggctcgttatacttttgtttaaccgaggttaagtacgacaagtttaattcggtctcaccactaattaaagaagtaatcatgatatttttgttctaactcagaccaatcatgaatacagttggtgcaagtgaaataaacccaaaaaattgcgcgcatcaccaaataaagacaatgggaaaaagcctaagtttcaaaatactactagcactagcttcttcgcattgaataataaactggtcgatatcctctaaagtagaccggccatgttctccagtgaacttacacaatgaggcaatcaaaacccttg

SEQ ID NO: 59089 - DNA, 1621 bp, Oryza sativa
ccggtggcggtgcgcccttgggttccagcgacgagctgaagtaccatgaacgcagctgatgcagctcgacggatgtggacgtcggggcggagaagccgacggcgacctgctccggcaacacgcttttgaggtcaaccttgtagctaaggttgtaatccggccggtgacgggggccactaagcccatagccgaggtgcagcctcatggccaggatgctggagacgttgtcgtactcgacgacggcggtcatgttcccgacgagggtgaagctgggcaaggtcaaggtcgtcttggacacgacggagttgacgtcgacgccgaggtggtcgtaggtggcgtcggggtcgtgcacgatggtgtcgttgaaggtgtcgaactccacggcgacgaaccggtcgtcgccggcggccacctggtcgcggtctggttggtgaggccgaggttgtaggggtaggagccggggagcctcgacgggaagccggcgaggaagaaggccatgccggcgcccttgttgtcgatgccgccgtcctgtttgggcgggttgatgacgaaggagaagccggtggtgaagctggcaacctcgccggtggcggcgtcccagagagggaccggaagggcgtacgacaccctgccacggctgtcttcgatgctgccgtgcctgttggcgctgatgtcgacccacccgccgccgtcgccgctgaaggagaagtcggcgctgaaggcggcgtcgccttccagcctgatgttcgtctgctcgtccgggccgaagttggtgtggttgaaggtcaaggccaaggcgactggagccggcgagtagagatcgtcgcagaagacggagaagaagaagatgaggccgacaatattgtacctcgtggtggtcgtcgacgatgtgatctgcaaaacgccggccatcgatggccgccgtgttgtgttccctccccgttgattgatcgagtcaatgcgtacactgtttgcagtggcagtagtgtggagacatgatgatgaattttagaagaaaggtaagggtggcccatcaggaaagcacatggatacttccttttccttcttcgttccacacgtgcgacagcctgtgaataactaacaactggacgaacgagtatgcgaaactgtataagggaacatggttaacgattcggttgcgcaggagaaaaaaaaaagaaaaaggagaaaagaattccatgtcatcgtccatgtggcgtgtcacataggcaagaccacggtcaaacgcggctttgaaccgagatgatacagtaaaccaagtttagagatctcgatgtgcacttagcaagttcgtaaacctgagtgaaacctcctaactagtttaagaactgctggtgtattttattttttttatggtgcgcccaaacttctcaaaattgtgactgaaaattaaccattgcctccatgaacattggtttgattaattttctagacttcgaggaatataatgagcctatgctgatgttgattttaagcacgtgcactggtttcgttctaacgacacaaagttataaaaatcctttgaataattgatagtataaattattgttgtcctctacctttaaaaaattatactaccgtataaagttaggcaccgata

SEQ ID NO: 59090 - DNA, 13628 bp, Oryza sativa
ggtgttggcgacggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagtggcactttcttcatcatcaggacaggtataggttccatagtcttgaccatgaggtttgtgaggatgatactggaaagctgatgaatccaactcttcttcaaaacgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgttggggtcatgggaaatctggcgatactcgggagcaacttcatagcctacctcaaaagccatcaacctcagctccctgacgaatcctaacacctcgatcaaatttctcggtgaatggggcggcatctaaagaaacatagaagagaagaattaaagcattctttaagttagctgcaccatctagacttaactgatttttgaccaaaaaggtagaaaataatagaaaagacacatacaaagctattttataaatatatttttagaatttaactttttggacagggacaaataaattttttttgacaaataacaaaaataaaactaaaatacttatgatctattataagcacggtacagtgtcaccataagaaagatgagtagtactagtgctatcatgattgtatcgataccataataaatgtacagtgccgactaatcaataagatttggtgaagtgaaaaaaaaacattttgagaagaataactttttgcttttaaaagaaaagaaattgaattaaataaattttgtgcataaccttgcatgtgctgccaacttaattaatttataagagaatagagaagagcagttctatttttttcaaaatattttgaaggctacttaaggtttaccatttggcttatcctaaggtcaaggtggctctaataccaacttgtcacgcccggaatttctatccaaaattccaaacgcttacatgtgtgttaaaccctcgtccaggaattaaccgaggcacacaatgacaaattaataatagagtactatttaatattcgcaaataaaaagattacagaggtagatagttcctctcaaaaaaaaacattctacgcagcggaaaaataaaactataacaaactacggaacagctatggctactccactccacaggcatcttaaccaagaacaagcctaatcctccagatcatcactttcactgagatactcctcttctgatgaatgaatattgcaagaatgagcatatgacatactcaacaagtcacacagcaaatatgcatgtgcacaggataacaaaggatggcataatatagctcatttgcagaaaacagcatttaataaatatttaagagaatagtaaaacagttgaataattaatcaatattaaataacaccatacaacacacccatgttgcataggcccaaccacatttgaacaaccaaccccagttgaacaaattaaatctccaaaccaggaattacccattccaaaccaggaatcaaattaattatcacattattaacattgatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagtcgtgacaatacccctcgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctagcttgtggttggcacgataaatgtttcacaacagtagctcgcgaaccggtccttaaatgtcatgagcacaaccatcaaaaccatatgctcacaacccaccttaaccaggttttaattaccaattaattaacatcacacgattaaccatcgtgaaccaccattgaatataaccatcattaataataataataataatataatataatttatatttaacccctttagttagctaatgtttctaagcatggctaagcaaacttacatatagcatttagctgaaccaatccaatatataaggttcacgctaatcaaattataacccataggaaaataaagtcatcttcggccattatttaattgggaaaggttcaccacccgatgtcattcaaaaacaatgcatagttgaaataaaataatagctttaaacgggttcaacatgctcaaagggttgtttgggatctatgtgacttgccttgggcttccgcaaacgcttcggaaccttcctcaaaggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaatcgggaaaaagataaactgatgacatcagcatgacgtcatcaatggccggccggctcggatggcgacctcgccggagctagggcggtcggccggggatttggaggacatgtacacgtagaggatgacgagacgaacccaacggtactcaccctcgagcctaacgacgaacgacgacggccggcgacgagaaggacggcggcggcggctcggtcgggcggcggtgaaggggctccggtggccggcgacaaagaagaatgggcggccgggcttcctcacctccgggcacacctaacggcggcgacggcaagcggcggcgacggcggagacggcgcggcggcgtggccgaagacggccggcggcggcggcgagctaggcgcgcgcggcggcggcgctacggagcacgggagaggacgggagttggggcaaacgaaagagggcgacgagctgatcctatatatagccttggattgaagagatcggactcctcccgtgagaaatcgactcgggaaatcaaaaactcggttttggagataaactcgaaaacgagtttgattcggataaaatacccaacgatttgctccgattcttggggggaaaggtagaggagaacgagaggatcaaaaccccccaaaaaaacgaaagaaacggggtcggattagagcggatttgagaggagaagggggctcggtcgggctcggcatggcagccggccggaggttgaagatgaccccgacaggtggggtccacctgtcggcggctggggaggggagggcggctcggcggctgctgggccggcttgggccggcttgcccgcgggagagaggagagatgttgggccaaaaacggcccaacggtttaaaggaggggttttagaacttttcaataaaaataatttgtgaactattgtttcatttgttaaaaatacttcccttgctcaaataattcccagaaaattctagaaaatagaggagcaagtatagtatttaataaaattttatctagctcatttttatgttgaaaattttcctataaaattagggtttagcttgtaggcttttaatttaatttctaaaaatgatttaaacaatgcattttaaatttaggcgatttttagggcgtgacagtatacagacggaagacgtgacatagtttccaacccatcctagccatagacaaaagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagactggtccttatatggccgaggtgctactatcaaaaccatgcaccccgagcccagcctaaaaccattttggggattttgaatagagggggaggtgtgaatccaattccacaataatccaacaattccatagtgtccaggtgatatgaatattcccaaagtctagagttgtaaaaccacctaatgttacctagttaaatagcgaagcatctacctaaaatcatactagtggtaccatgagtagagtgtccactagttggggttttgtttaatctagggtgaacaaggtaataataacaataacaataataaggtcataacaaaggtaaataggcatggctagataaaacagtgataacgcgggaattttaaataaagcgataatgcaataatttaaagcaacataattttataaactgggattcaatatgttcaaagatcatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcaaaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaatggatttattgcgtcagccgaggggaggggcgcgcggaccgggtccacgggagtggggcccacgcggcagcctcaaggtccacggtggaccgggcgcacccgggctcacaccggccggcgccgtgggtcccacgcgtcaaccgcacccgagggcgccggcggctgacagccaggccccacgcgacacccgctcggtgcgcccgaagacggccacgccggcgcagcggcgggagacggcgcgcccgcgcccctatggtcgccggcggcggccataggcacggcggagcagcggccgagagaggggaagggaagggggaaacgaatcggcggtccacggctcaccccgggtcgacggcgacgacgggaacggcgaccggagcggaggaaggcggcggcgcggctcgggtggacggggtcggcggtgctccggcggtcggcgagcgaaacggaggggtggacgaggtcggcgaggatgcggcgaagccgaaggaggcggcgccgaggcgggaaatggtccggagcgacgacggcggcggaccggagttcggcggcgacggcggagagagagagcgacggcgcgagctcgattccggcggggagagagggcggcgggtggcggaaacggtggagggaggcacggggaaggtttatatagggttgggagggggagagagctgccggacgagggggaaacgggcgcagaagatccggcctccattgatggcgccggcgaggttaggggagaggtttccaaacgaatccgagggagagagggagggaaaaatggggggaaagagggagggaatcacggggaatatttcccccctcttgattgcacgcggggcggacgggggcggcgggattcacggcggcggcggcggcgctagggcgcgggcggggcggcgggagcggcgggaggaaggggatgacgggtgggccccacccgtcagcgagggtggcaggcgggcccgcccgtcagcggcgcgcgcgcggggagaggccggatgggccgcggggagaggagagggagggggagggagctgggccggatcggcccaagagggagcgggggagggaaagggaactttttagggtttttcttttttgtaaaaccatttcaactttgtttatttcttaataattattatttgtgctctgaaaatttcactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgcgacacaatgtacccaagttagtgttttcattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttggcaaataataatgtatagttctagaatcgtgtttacaaaatagctttgagcaactaagtgtcttttaatgctgtttactgcaaccctaaccctttatgttataactcccttgtactcccttgcatctattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccactgtttcccgtttgtctttgtgtgtgctgggcctccgctgcccatgtaataatttaactatttacgcttccgcttgttaaactctgaattgtatcaactcttggtgtaccttgcctcctgggacaaggaataatacacgcacgtaaggaacgcccgttgggttaattccggtcgtgacaaaatggtactgtttacacgaatgattcctgttataaaaagggggtccacactccgggcgctcgtctccttcctcttcctcggcccgaggccgaaacgatcatgtttcgcgccgtcggccatcgtcacagcgccctcccctgcagtggtagtgcatcctctccgttctccttcctcgctccatctcctccccttagactcgggtagtagcatgagtagaccccccgtagctagctggcgccgccccaagccttgtcgccgctcgctatgtgcacgccgacgtcgccgcccgagctcggtagcgcctctcgtcgccggcctcgctcggcgtagctccgcccaatccgacgctagaaacggactccggtggccgcgtagatgctctggtccggaggaatcgaactcccgtcgcgccgtcaccgtttcccccttttctcgccgccggatgccgccgccgcaatccgccgccatcgagcatcccccggcgaatccgagccgttggctcgtctcccctcatcccgtgcaacctcccggtgcactcgcccttgcttgcatcgctgtagatcgccccgccgctcgccgccgccatccgccgtccgttccggccgacgtcgtcgtcttcctcacgccggcccacgtggctgccacgaaggcgccacgtcggcgccacctcggccgcgaccgggtcaagctgaccccggtccgccgctcccctctgccctgctcacgcgcgcggtccaccgtgagccgtcaggctgcgcgtaggcccgccgcatccgcacccacagcgagccgtgcgcgtgcaccgcgtccctcccgcaaaccctagcgcgcgccgcgtgctcgctccgtacggtgaactgtgtcaccgacaagcgggtcccactcgggaccacgcgaggtgagcccggtccaccggctccctctctcctccccacccacgcgccctactgggccgagtcctcttgggccggccggcccattagctcggccgagccgcgcttcttctctcgggccgcgccctagccgcccgagggaagtctactcctcctccctctttcttttcttttcaaaagggtttaaataaatcctttttcctttagataaaaaatccaataatcttagaaattcaatatcttctcaatcgtacatccgattgactccgttcaacttccaaaattcctcaaatctcgagatctatctaatggcacgcttagaggtcaataatagggctttgttttctctgtttgttgagttgtcccgtttcgcatgtagtttcggagcccgaagacccgcagtgcgaggatttcgaggatcgagctcaagatctcgagcaaggcaagtcacctttgatcatcttgccctataatttaaatctaagtatttcttttccgcaaatattgcatgaatagtttaacacaagtaattcggccgcggcttgtgagatagcctgccggccccaatcctaattgctgcaattaccctccttgaattattgaacacttaaaacctcctttgtcaactgttgtgcttcgatgcacgggccttcgggcacgggcatcggaacacctcccctcaaatttaaaatatccaacgatgggtaaaacttggggttttacaaaagacttggaaaacccgacacctgggttggtgcttgcgaactaaatgaatttccaaaaccgcagaccgggggacgtactgggagtacggtttctagttcttgcacttaaggaccgtttcccttggaatttcatccgaacataagacaagtgcgaccacatgggtgaaatgggacgcccctggctgagtaattagctaatcgggggagccatgatgccaagagacatgtggattcaacggggtggtgccgaggagaacccccgggcttcctgacacagtatggtctgggacctaacctgatatcagtctgggacccctctcgttggcatatggtgaacctgtgtcggctttcgaaatgccttgtcatgaaagcctcaaggtctccagacgtggccgtcttgcacaggctgggtgatccgggttagtaatgtcgtgtgggtaaagtgtaccccctctacagaggttattaaactgttcgaacagccgtgcccacggtcatgggcggatgttaggtgattcctagcgtagttttgtttgactactgctttgtgaaattgttgttgtggaatgggttcgatgtttggaaaatccgcggctgatgggatcagccaggcccaggtggccgtttgaaagctgttggccgggtgtcaaccttgaatcaattcaaagactgatacattgcacatactccgaccggacgagacgcactgtctcatccgtgtcgtttgagaagcactcacttagttgtttcaaaaaggagtttaaataaaatcaattgcaaaaacaacagccttccctttgaagcctgcattaaacacttaattcccatggcttgctgagtactcttgtactcacccttgctctatataaatattcccccccccagttgctgaagaagatgaagtggatcccgctggcgaggagttcttccaggagcaagtcggctacgatgagttttagggtttcggtccagttcccaagtcgcgcctgtgatgattggtccaagtcttggcttccgctttcccttttgtaatgcagttgtgagctcgggatctgtccgcagcccaacatgactgtagtcctactctgtaataaagagacctctgttgctgtgatattctgtcttcctgtgataccagcactgtttcctgggactggtatcgattaacaggttaatttggagcgtcacgggctagttccgttcggggctagttcggggcgtgataatatgttagggtgtgacagttagttatggaactgctgtgagaaagtgagctacccatggaatcataagcacgataaatcttgaattgcttggtgatttaatttattagactattatccttttagaccttttgtttgtagctaattggaggtatgtatgaattacacacttctaaaaatacgatttctccagaaactttctatgttagtattgattagataacctttttataagctacttgtaattttatatctttaatatttaactaatccatgtatatattaatttatcggctaaccagctagctgtttcgaaccggtaggtgacaacaggtatcctgccctttcatcgtttttttgcatcggtaggtaacagctggttttatgtattactcgactttgtataaataggagagcatgcatgtttcatcaatcagttatcttgtagctagctacctgatcgaactcgggaaaattatttaagatggcagcacagggtgttacctccgtgctagcggtcgtattggtcatcggagccttcgtgtccatccctacaggtatatatatgcaaaatttgatcaatcatcagtttaattacattaattgaacactagaaaagtatgaagaaatttgatcggtctcttgatttgcatttctcgcacgtatgcacggtgcatgaatataattgatcaacacgtacgtacactagtgcaatccatcggcgtgtgctacggcgtgaaagggaacaacctcccgccgcggagcgaggtggtgcagctgtacaagtccaagggcatcaacgggatgcgcatctactaccccgacaaggaggcgctcaacgccctgcgcaactccggcatcgccctcatcctcgacgtcggcggcttcgacacggtgtcctatctcgccgccagctcctccaacgcggccgcgtgggtccgtgacaacgtcaggccctactacccggccgtcaacatcaggtacatcgccgtcggcaacgaggtggaaggcggcgccacgaatagcatcctcccggccatccgcaacgtcaactccgccctggcctcgtcgggcctcggcgccatcaaggcgtccaccgcggtgaagttcgacgtcatctccaactcctacccaccctccgccggcgtcttcagggacgcctacatgaaggacatcgcgcgctacctggcgagcaccggcgcgccgctgctcgctaacgtgtacccgtacttcgcctacagggggaacccgcgcgacatcagcctcaactacgccacgttccggccgggcaccacggtgagggaccccaacaacgggctcacctacaccaacctgttcgacgccatggtcgacgccgtgtacgccgcgctggagaaggccggcgcggggaacgtgaaggtggtggtgtcggagagcgggtggccgtcggcgggagggttcggggcgagcgtggacaacgcgagggcgtacaaccaggggctgatcgaccacgtcgggcgtggcacgcccaagaggccggggccactggaggcgtacatattcgccatgttcaacgagaaccagaagaacggggatcccaccgagaaaaactttgggctctcctaccctaacaagtcgcccgtgtatcccatccgcttctagtacgtttaattaagctaaaaaagctagctgcacacatagcagtgttctttttaattcccgaataagacacacagggcagtggtaactactcgtctactccaatgaagtactgcgcgacagtactatatatacgtgtgcatgcacacttttcaatgtatactactttaaaaaggctaccaataatgtcctaagttgatattctctttttcgggttgataatacttgtcgtttattttggataagggcacagtctttaaaaattaactttgacaattatgttctgttataatatgtataaaagtgttaacaaatatatgattttattaaattacttttcaagactaatctatccatgtagttacaatatttgaaagataaatattttaaaaagattcataatcaaagattctaaagattgatcttacccttatctaaaacgataaatattatcagcccggaacgagtatataatatataataatgaataaagtgaaggaaatgtctttcctcgttactacctactaggatgtgcattcgatctccacagtcacatgaacttggggtgtacgtgttcggccttcggcgcgaacgattgggaggggccaaccggccgaggacccgacaaacgattggtctggtagcccaaggcggcctagacccgagcaaaaatgtgcaacacgccgcttatgtgcatgggccatttggcgacattacgcaaagaaagaagttcaattagactcccccaactatagttcgaatctgattcttaccgttcaaccataaaaccattataatagctcctccaagtactttaaaaccgcgcagaataactccctcagcagtattgatcagtattgatggtggttttcgctggcgtgactgagtctccgacacgtggcattgaaaacaaaaataaaaaggaaaaaatatattaaacccacatgtaagtgaggtaccattacccctattacccttctttttttatctctactggcgctccttctcaagatgagcggcgggccgagcttgggacgactgttggaagaaagcgattgcggggaggcggcaggaagaaggcgcctaggacggtggaatcgagacggtggggagagagaacttggctttggtaggggaagaagaggaccatgcacaccggtgacggagctccactacattgcatgtgacctcaatcacgctggccagatatgcggtgcagtcgagcttgccgagagggatcttgttggatctgtatccccgacagtccagccaaaactgagcttctccacatcacgacacatcatgctgcttcttctcccctcaccgacggtcaccatgtcatgctgctcctcacctatcggcccatggcccaaggtagtagcagtgggaagccgaaggagcaccaggacagggaccacatcgttgaaagcgccattcccttgtggaagtcactctggcgcagagttgcaagaaaaggcagaggtcaatgatggaggtggcaaggtcatgctcgatggggttcgtcggacgctgcctctcttcctctgcgtctgtctctgtctcttcactaagaaccaaggagctcagaggcagaggtcagtgacggagatggtgaggtcgagctcgatgaggttcatcgactgttgcctctcttcctccgttgcgtaagtctgtctcttcgctaggagctagggagctcggagcacttgagctcaccgatggctcagagaggtcaagctggccatcagtcgatacctcctcgtcgatgcatagaggaggagggagagggcaactagctagctaggggaggaagggggaaaaggaaggagagtgggaggaggaagaagggagggagagaagaagatagcatgtgggatccacgttgtatttgacacatgggtccatagattcttttgaaaaattttttgaaatggttagtgacatgtgagttccattcagtttatttttatttatatttttgttgattgtgattccatgtaagcactacgtaggatgaagaccatgtcaatgtgccgagtaggtgccacatcaatgaaagccaccgttcaatactgtcgaggaagttgttttccactgttttatatttggatgagctgttataccagttttacggttaagggtattgtcagggttatggataccacatacctaatagtagttgactaaatctcggcaggatacaccacataccatgtcttatacgga

SEQ ID NO: 59091 - DNA, 49252 bp, Oryza sativa
  unsure (1)..(49252): unsure at all n locations
ccgcttatcggatntaagttcagaggcgcaagcacatcatcaatcactgctctggctaggaacagtcccagctcatctgaggcatccaatatatcaagtgcggtatcttctgcagattcaagaagcattatgaaacccttgacaatgtcttctgttgagaacaattccatgcttaatgaggatagaagaattgaagccatctctttctccctgtttttgcggtccatagcaattgttataagcttcttaataaagacggggttgtactctggagaaccaagctctttgaggctgcgaataatctcaggtacatcatcagagagaaagtactcatgaatcatagaaacagcctctttcttgtacctcctcagcttctcatgttcatcatcttggacatccccattggcacctacatgtacaaacgaagagtcgagccatccttcagaaactgcttttgataccaatgtctggaattgagattttgcagatggtatatcaagagataggtcatcaagactatctacaacacgagaaaatcccttcatcatctgactagagcttatcagcaattcctcagatgcttccttcagaagcttgacaataagagcttctgcagttggactctccattccaagagtgagagctcgcttgacaacctcatggtgaaaaaatggcactgccaattctctgatgcacctacacgcctcagctgtgtcaccattcttaatatattccttaagaagatcagtaatcctcaactttacagcgtctactgtggtgcgagttgaaccaccccatcgccgttcaagcaactctgcatggtggggtgctgaaagatagctcttttctgcaatctgtacaacttgcatcccctttgaagactcggagagactcgctttttccctgctgagaaaagcaggtggcagaatgtcatcaacaacagctcgtgcaatgaaaagagcaagaacatcaaccgcgtcaagtatgtcaacagccaagtcatcaacagcctctagcagcatcacaaagcctagtctgatttgggtagaactgatcacatcaccataaagagatgataaaagcactgacgccatctctttctccttgtcatgcctatccattgccatggaaacaagcttcttgacaaagtaacggtggaaatcatcataacccaactctttcagatcagaagcagccaatttaacatcaccagtgctgaaatattcctcaataattggggcaacagatttcttgtagtcctctactggggttgaaacaggggcttcaactagttcatatggttcctgattaccagaaaaagaacatgaatgtccatacgtctggctggactctaaccacatatatttagacaatactggatacaagctagatgtttaccagtttctccaaaatagcaggtgtcaaacaattcatcggtacataaatgtgcaagtggctagagttcatcgatacataaaagtgcaagtggctagagtacatggtcaagaccattaaatattacctcatcactgtcatagtttgggtcattgcggtcaaggcatgcatctgtgtctgtatctataagttttccccaggtacctttgccaccagcaccatctgaaatagaagctcagcaagtcagatatgagagagagagagagagagagagagagagactaatctttggctcagcagaagtagagatatagatgtaatgagaacaatattggagagtgcaataactttcctggtgaaattgtgtgtagaatcccaaatacactaactcattggaaatttagaactagcagagaatggacactagagagtattgtagtgtcctaaaaatcataaaaccaaactactgataagggggatgaactgaacataagaaatatttttatgtactcctgcattcagcgaacacccaccagcaaaaggtaggttagttaagcataaatactataatgacaacctttgaccgtcctaatcaatggacagttcagatgccttccctaattaatcagcataaaactcatttataatcattgccttgagccatcacactggagaaattaacatgtaacattatgcagtctccttttgccaaaaactacaatatacagaagtatacaagatttgatgttactaagcgattcagtttatgcatatgtatagatggggactaaatgccgtcaactagaattgtcaactgaaattataagaataattcttaataaacatagtccagacagagaaggcaatccccaccctatatgatatgagagtcccacagatagctcaaaatggcacacaattttgtaaacaacaccaggcaaccattacttgataaactagaaactcctccataataattaaaactgcattaagctagcaaaaagatacaagcagaatgaggggggaaaatcaagtgtgttgacgtgataagagatgtatagtggcagatggacgtcctgtcgcacatacatgacaaatcagagatatgaactgactgaaagttgttatcaagatcaaatgtgtacaatcgatgcctttatgatatggcacctccaatcctactagcgatgcggaaagaacatactagcgacaaaaagaatctcacgagtaacagaataactaatccaaccaactaatcagaaattactagatgcccaaatcatataattgtcgtgacccaactaaatcctcctcctataggtagctgagagaaacaccaatcaacacgcacacggaatcccatatttgcatgcaggagtaaccatcaacacaccaaatatctgattactaaccaaaaactcaaaatgcaatacttccctacttaaaccatgacattccacaaattccctaagcaaacattcaagcacattcatgtttcccctaatcgatttaatcaattctatatatgaatatatataatagacaaataccacaatatatacctactaaatataactaaacccaataccatgaaacactaactcacactacaactgcactgacatatttctcaaataaacattggcaactatatcaacctaatgggtaaagtcacattccaatcatcctaaacaagacgccacaacactcaatatatggataaataataatcagcaggtagcaatgataattattaacaatagcagcagtggtcacatcctatatcctaatcaagcatgccaaatctctagaaccaccacaacaacagtaaggaaggcaataaaccgagcataaatagatcaagccggagccacctcacctttcttcaccttaatggtcttcccggaatgcgaccgccgcacgtgcctcaccccacccccacccccaccgccgccgccgcccctggccgcagccgccgcggcggcggcgcgctgctgctcgtactgctgcaggagcgcggaggtggagcccccggtcggcgagcgcggggaggcgagcgacagcgtctcggcgttctgcaccgcgatccgcagcttctcccgctggtcctgcgtcaggaacccctcgttcctcggcgacgccatccccacctcaactcctaatcccaccaccaccacctgcacccaaaaaattacaccacgcatcagcaccggccgccgccgaaatggggactcgaatccgccgccgcctccgcggcggaggttgccgtacctagggtttcggccgcggatcgagcctgagccgccgccgccgccaacccgtgcgcgagatttgtgcaggcgaggcgagtggtaaatttttttttctacgctccttttttttccctttttttttctctccgagcgagtgagtgagatgagagagaaaggatagggagggtggcattttatacggaggcggattgggattcggggggacacgtcgcccgcccgcgcccgacacgccgtggggctcacgtctcgtgggccccgcatgtcatgggggtgcgcgtgtcctgtgggcttatcctttttctcggcccgctggttttttggtttgggccggctggccggccgctcatccctatcctctttccacgtggcactgccagcctcacctcgtgtctcaccacacgtttcactgacatgtggggaacatgatacggcggacccacatgtcagtgagtgatgggggtgtttttgaggaggtggatcgggccgtgggagttagggttttggccgtgggggaggaaaggggattaggatcttctgcggcggtggttaatggtgggtgcgtgtgtgtttttctgtgggcggtggttatgaatgattgggtggagtggataaggggatgagattcatgagaatgacgcgtcgggaatagtcaagcaagattcagtgtgcacctgacctgatctgacgatgagatcaaccacctgatacacacgtgattgttgatccatgatctcattagtggtaccgtctattcaaggtacagacaactgtatgtgcacctaaaaattttatcatctttattgggagagaaattcccagttgtttgtttcttcagctgggaatttttatttacagtgatgattgactctatctgaggtgttgtaggcttgcccattaggacacccacaatggttatctataggctttttacaagagatctatgtcagcatattttcctacttggaagagattaaatgaagagaggagcaaagctatcttactaacctagagatagtttatagagaaaaacgagacaatgtattagagagctatagatacccatgtagacatactattgaggtggtttactattaatttagtctattgctgacatgtacatgttttatagatagcaccttattttaccattgcgggtgctcttagtatgctctactagtggtgtctcttgagcttatccacaaatgaagtgctagttaagcaaaggtttgattgatagcgccagcttttaatggaggaggtaacggcggcagggcagatgccgactggttcttgttctgcaactgcaagcccaatcaactacaccatacttgggctgtctcacctgtcgtatctgggccgtgttataggccggcctgattaatggcccagtagtcagctcagaactttgttcaacttagatcactgtaaatttgtacaggcaactctgtgcacctaaaaactgacgagatcagatcaacttcagtgaaaaaaaagggtactaattctaattaatctttgttatctgatactctaatcaaattaaccacaagtataacccagatcaaagtgacagaaccaaaatcgcattgtcctggaatcatcaggtagtactccactttttaattcactgttaaacagcagacaaaatcactttgaattcatttcaaaattcagaaccaaaacaaaacactcgctaaacaagaccaagcaaaaatcaaaatcaaatacgcgacattgcgagagcatagaagcaatcgcagcttattgttacactacattataaaacaaaaatatcaattcgtcataaagcctcagtacttgtagtccttgacgtggaggttctcggagacgccctcgccggcggcggcgtcgccggcgtacgcgccgagcgtcgcctgggagttggccctgcagcgggcgagcagcgccgcctgcgccttgccgacgttctccgccttgccggcccacgccttgagcgtgctctgctgcagcgcgcggccgaaggagaaggtcagcgaccatggcttcttgcccctgctcgccacctggttcatggcgttcaggttcctcgtcgcctcctcctcgctctgcccgccggacaggaacacgatggccggcaccgccggcggcacggtgcggaggagcgcgcggacggtgtgctcggcgaccacctccggcggcgccctggcggcgtcggagcccggcgtcaccatgttgggcttgaggagggtgccctcgaggaggacgtggtggtcgctcagcgccttgtagcacgcggcgaggacgcgctccgtcacctcggcgcaagcctcgatgccgtgctcgccgtcgacgaggatctccggctcgacgatggggaccagcccgttctcctggcagatgatggcgtaccgcgcgaggccctgcgcgttggcgtcgacggcgagctgcgacggcctggacgacgccctgccgatgctgagcacggcgcgccacttggcgaaccgcgcgccggcggcgtagtaccgcctgcagcgctcgccgaggccgtcgtgcccctgtgtcgtcgtctcgcggtcggtgccggcgagctcgacggtgcccttgtcgaccttgatcccggccagaacgccggcggcggcgagcacgtcgacgaacggcgtcccgtcgcgggtgctctggtagagcgtctcctcgaacaggatgacgccgctgaggcagtccagcgcgccgggcgccgtgaacaggagctcccggagcgcgcggcggttctcctcgacattctccacgccgatgctcgccagccgcttcccgatcgtgcccgtcgactcgtcggcggcgaggatgcccttccccggcgtcccaatgtacgccgcgttcctgatcaactcatctgaaaaaaaacaaaaaaaaaacccataaatcattgatcaagaagcagaaacgcatggcttactcatcgaatcaagaaatgcatgtgttgcacaagtgttttttttggataatggaatataaatccatctccgccttcgctgaaacgagctacaaccaattattacaccaaatcgctcaaaacgagtgcaactcaaagagaacttaaaaaaaaacttttccaaacataaagcgaacacaaaatcataaacgaagcttactgtacccttgtacttgccgcagtaggccgacatgattgacagatgagagaaacgaaagcttcttggaggagaggtgatcagaaggaagaggaagaagaagaagatgcagagatggcgggaatgggatggagaaaattcttgtggcgttgtggcctatttaaacagctcggagctctgaagctggaggtgtcggaatgttgggtggtcagaggaagcagacatggttttggctttctctgcacattgtttttcgtttttttctcttgagaattattggcgccatggggccatggagaaaactgtgttgcttttgtccttgcagtattttattagcgttggaaattagtctttctccaactaatcggaaggagaaactaatgaatatgcgtggaattctagattgattggttgttatttttcctccctttgagctcatcgatcatgacttctcccagttgaattctccgtccaaagaaataggctctcttgtttctaagcttccaagttccaacttgttctcttctcctgacaggaaagttgaccctcgtgagatcttcttcttcagaaacatgttgcgtaaataccttatggaaatattttgatttgctgaaaccaagcaattcagggtatcccaaatttctgtgctttttatgtgatgcagaccaaacaacttttctaatttctatgccggaattgctagaattatagcgtcacatttttcgcttaatttcagtcattttatccctatgtgattgtctctctcctatttgttcctatatgtaaggatgctttttatatcttctatctatttaagataataaattacttttaatcctaactggataaaacccatgttttgtatgataatatatagtagaaataacatgtaaaatagctagacaatataattttgtaatactttatataattttcatctttgaccgactattgaaaaaaaatgttcgaacaattaagatgatgtggtttataattcaaattatacatagattaatcattccaaagcaaaattaaggtgagaagaaaaggaaggaagatatatagattaatcatccgaagacaaaactaaaatgatatgacttcataaaataagaaaaaagagagataatttgtagcgtagatcaaccatccaagagctaaaaataataaatgtgatgtaacttaatgatagaaaagagaaataacattaacaacacttagtgggaatgaactttataaatatataggattctcttgtacattgtttattagaaaaattacagtgtaatgtatataggattctcttggcaagtcgagaaaatccaagcccaaatttgacttagaaatagaaaagaaaaagatcaaggagggcctccaaaagaatctcttgaatatcaaagcaaatggggatagcatgtgagtgccttccttttttttagctagctatagttgttttgaggtctcacatgtaaatatgagaaaacataaaggaggatacaatttgtatgattacatgcatggatcatgctctgatctgatacatagctgcaaagagaccatttgtgtgcaggcacaagtgactgatcccatgcatctgcagcacaacaccagcagattcgtggcatttgaattgaccaaataatgttaaagtcatacacacggaattcagatagtgttcattacaaagtcggaattaaggtacaagcaggaatttagttagaaaaataaaagggtacacaaggatggattatgcctactgctccgatcaggagcagtgagcatttgggcgtacatataaatgcaaaaggtaaatatttagtagggatttaaaccgacttaatccccctttttacctgtgctgtagcagcgtttttgattgttctgtttgggataactccctgtttttggagctttctgagactgcggattgcttgtgtaatgatttctctcttcttcttaagatgaaacaggcagaaactcctgcattttgccttgaaaaggaaaaaaaggaattaggtaatggaatggaagtatggcatgatggtacttataaaagcgcagatttatcagaaattcagaattcaagtaaaagctcggtgtgtaccgatcgatgaagccagctagcttgctaactataactgcatctgttgctcgatagagacgagtgttttgaagatgccgacgagaacgccgatgacggagaacacggtgacgatgatcctgtagttgttgtagaggaacttgtgtatgggaatccacatccacctttttcgctggtaggcctcaagatgtgccagcaagcatacgtgttgcggggggaggctaatgagcccggcaaggttcttcagaaaactgagcgtgcacttgtcactgaatttgccatgcaatatacccttcagccgcagctcgtgtacttcttccttccggttcattagcatcgcgaggagggatatgtacgagctgaccgtttgcacgtcattcttaccagtaaatgccaagtaagactcgagcgccaccatgttgaggagccagcatgcattgaggtcgtccatgaccagcggtggcatggagagcttgccgaataggaggcctttgcttattttcatgtccgcgaaccatgacgcctcggtggcgacaacatcgatgccgatttctgcaagctcgatggcgctgctagattgtcgcagtgcagtagtgaccccttcagggcgcttgaggacccagctgctttcaccaagcttgctcaatcctgattggtagtatcggaggaggccaaggagatgtggtttgcagctaatttcattcaagtcgaaaggattaatgttatcatccaacctgacattgaaacttgcccctgcattagagatgaagttatccacgggcacgggtacgggcatgaaggtcatcagggcctcgagcacaacccacgggatctggttctccagcataaacatgtccctcaagatgctaggttgcttggagccgaaccaagtttgtaacaatgggtcaacggctacatcgcacatatgagccataaattgcagcaagaaacaaccatcgcgtatcatcatagctgcaaactcggcttttcgaacgcctactaccgcatcgccctcgtagcagcttcgggcaccgcttgcgatggggaggatcttccagtatacttcatctgccgagtgccctgtgttcttgcagaaatcgcagacggcactccacttgatcttctccgcctcctgaaggtggcgtgcaccatggtggtaggggccaattgccacaacactcgggacgaagtagcggtagtaatccatttttagattttgaagaatcgcaggatacctgcagatatggaagatgaattacacctttggcttctacatgcagggcttgtgcacatcaaccatagttcttgtgattaatctttgtttatcctatattaattggatgtcctcctagaaacctatagcccatacaagaacacaaaatgtcaagcagtggagataggtaaggataacaacccagttcagctcgggttgttaactttaacgagttaaaatcctagctaagtgtaagctgtgagtgtctgcgtttgtattgtgcttctaaaaaaaatcctagctagcgcagctcgctcgttaagctcgttatgctcattaattaacgagctatatatatatatctcatttgtattacatgtacaattttaaatttaccattttatcatatattaacgtaataataaacaataattagcaaagaaatcactaaatacaaatatatagtttgactataactaaaagactaattaagtagtagttaacaagagtaattaagtatataaagatacgatgatattttatactagtgagctaaatgagcagctcacgagctggcttgttaagcttacactgaagtctctgttaatctaattttagcatcttaatttagttctatcggctatctctcgttttagggtttctgtcagtatcagctaaatcgtcttgctagattagattaccttagacaactaccaccctgaaaatcagtcaacagcttgattgtctagatattatgtttcttttcacatttaatgctgcatcaatacattcgatctactaagtcgtgcttagaaccatagtccctagcctgcttttgattgccaataaaggttttatcggggtttcagccgatgagttatctggatgttgcaacggcttataaggattacatacaagttagattggccgatcacaacaaagattttactgtttatctaatcttgtgaatttcatggcatcggatcttcagccgatgtatgctttaacctttggatcagtgcttatttgatcaactcattgttagccgattggtttctactggattatattgttatttcattatattaccatcaactgattgtcagattctacatcaaccatatagccgatagctcaaaatattatcgctatcggctggtatcggcatcggttagaattactctatcggcttattaatttgctatttgtatctcttgtcagttgtaggatcaaactgtctggcacgcacgtatctcatcaacctttggacctacacttgagctaagcagatctcccaggccgttgttttcgtcgacttagtccgtgccaacacagttccggtactatcggccgagcgcggatttctcgtcaacaggtacattcttttatatggccctttcgtataaatctgttgattcttataatgcacattttaatttttaaaagtatctgaggtcttgtttgaatcttctgaagatgaagattaaaagcgggcacgcaaaacaagaaagctattagcgtgtgattaattaagttttaattattacaaacttgaaaaatggatatatttgatattttgaagcaactttcatatagaaagttttcgtacaaaacgcgtcgttttgtagtttgaaaagcgtgctaacagaaaccgaggtaaaatctttatcttcatgagaaaagaatagtacctaagattctttaaagcgttgatttcttgtaatatatattcttgacagccataaaaccaatattttttataaaatacttaaaacatgaatttatcggtatagttttgtaccctaattaaatttcattaattaaatgaaatttaattttactaactatatatttatcaaaaatctacaaagtttgaatttttaaaattaaaatataaaatcaatgtgggtggtggtcttggtggagtaataagtatattagttatatatcaatgtagttatcaagaaggaaagtactatttttgtcataaagcatgtatgcatatgcatgtacctcaagacaacaagcacatagtaaattttgtaagagaaagaacataggagtatattatatatttaacatacaatcacttaaattatagagtaagtacaacgatggttggagtggtcgtagaactagcaaggaagttaaatcaagggttaaattaatttttaagccgtagtgttatagtaatttgtttatggccccgaaaaaaaaatctagggatgtaatttatgttacctaaaagctttagttcgtattgtgaagaactaaagtgaacacaccaaaccaggaagactaaggttgtgttcggcatcccttcttcccaacatctctcatttgttttctacacgcacgtttttaaaactgctaaactgtgtttttttttaaaagtttatatatgaaagttgcttaaaaaatcaaattaatctatttttttaaaaaatagctaatacttaattaatcacgcgccaatggatcgctccgttttctgtgcgctctagtcatgttgggaaccaggtatgccgaacacagcctaggacatgtattatgtataaaaaaccgatggtcacacacacacactctctctctagtagcatgcatgtgtttttgcaatgtatgctgttgactactaccactactactgctactaaactagtactaatgttgaaatgtactagtagtacatatagcatgaatgtactccgtgtgttgtttatacaagaaagggaaaaaaaagttaattaaacattaatagctagctcgacatttatggtggatgcatgaagaaatcattagcaatagtatttgcatggtagtagtacctatgaatcatgattttattgatgcagaggtgaacctctgcgccgagagcagtttcagttgattcaacatgcctgccggagcaagcggcaacagaaagggtaaccggagtcacggtcaccgctacctcggcagcgcttggcttagcagccattggtcgaacttgcccggagctagcagcttaacagagttccgatcagttgctaattcgctacggggtagatgcatggcacgcttcttgctcggttctatatatagtactttcggcaggcggcagctcagctcaaaagtcaaaacaaacgagtagttgatggtaacaacaacaaaaaaaatatatattgctgatgaaaaaaaaggggataattcactttatattctagcataaattaaagtaattgaaagattctgtgcccaaaaaaaggaaaaaaataatagaaaagatcaatgatagcttgagttttagttgacatatatagctccagctcaggattgaagtttggaaccctttgacttcacacggtgtactgaaacggtgattttgggtgatttgtagccttattatactcacgtggagcttattatagtccaagttatataagatcataagattttgttacgtgacatataaccccgtgcactatggttttaaagttttacaaaaccactccaataatcaatttggcatgctcctatattaaaatttttgtaaaaactttacttacatgaatgtaagatttatctgatggataaaatacccataaatttgagatgtgattgtagaactcaaaagtatggtagatcaaagttaaaatgattaatagtgtgttttgttaaacttatgtgtcacatgctaaaactcatgctgttttattcaactcaaatcataatatttagggttaagtgaaatttactataacaagaattgaaaaagagaaccccaccatagattttaaagcctcacaaattaaaagaaaattttttccaccgtaaattcttaggtcatacttcatccatttcataatataaaggcacaactattttttagatgtttcataatataaggcatgtatgcatgcatgcacttaactagtatcttatctccactaaataattatgttttaaatccttcaccttcaccttcaagatctccaattctattgagtgcatgaattataatgcatattggttccttattccactaaacctgtgtatgttttactagttctgtactgtacttgctgtatatttttactcatttttatatttaatttggcttttaggtacttaatgatatggatttgtatgggataggagtagcacttttggactacacattttattgcacactattgaaatttagttttagtttatgctttagattagcattagttttgcttagaacttgtagaggtcatttgttattattttcatgtgtttttttaactaggatggtttggaatgtatgggttatatcgttattgatttatcttataactgtctgtcatctaaactaggagataataattattattttttagtgtttgagttaagggttattgtgtcttacattttgaaaggaaaaggagtattggtcatcatttatagcctctcatattgagataaattttccttgtttggtggtttggagttgaggaaaggactgaaattcacctacctcactacttatggatccacgtggcagtgggatggctggtgatagattcattgctcaccatcaacattagagttttttttaaagaagtttagaaaagagtagctctacctatagctctagtacgatcgatcagccttgcccaattgcgcctcattaaaatgacttaacggcaatcaatttgcacattactagtagtacactaccagggaaggtttagaaagcaaatgataataatagtactacaacatgtgcagctgaagttgagcatgaagtggatccctatgttaccctgatatggggatacggatacacgatacgggaatacgaggacacgtcattttcttaaaaacaccgatacggggatacgtctatatatatttaaaaaaataaaaaatacaaaggaaaaacataacacataaataactataagcctgcaaatagagttatacaaattacatgacatcattagagataattagaataaaacttgttccggatataagttcaactcaatagaagttcaagagctgcttgcattcatagccagcgatgtggttgaaagagctacatcctagacaggtcccatgcaccagatcttttaatagtactatcccaggagatcaagctcatcatgtagcttgcccctcgtaaataatatgctcccatgcctggtcacaagtgatcctgatgaatctgtagccgcgctagcagtacatactagtgctagataagtggttaagattccaattctaaaattcaccggatctaaatgacaaggaaaaacacataacaaaacaaccaggaaaagaggaaagaaccaaatagccggtgatgatggactgtacgcgttgggcttggtagccggcggagaagctacgcctggtgacggagatgccgcgactaccgacggcggaggccctgcgcccaggggaccaggggtggcgacgcgatgcacggctggcggtggaggccctactcctcaggtggcgagcggcggcggaacccggtggccaacccgtggaggccctgtgcagtgtgcccctggtagcgatgcaagcggcgctgcaggaggattggatctgcgcttctatgctgcgagcgtgggttcgttagttcagaagtatggggaacgtatcggagaagtatccaagtaattttctttattttatatcgtggtaattagggatacgtatcggagcgtatctgatacgtatccgtatccgatgaagtatccgatacagatacgtggcttgtgagccgtatctggtaggtggatcctgctggagtgacctgcctccaagcgccagacatacagatatgtttggagagtctctatctgttgtagtttttcttttttcagaatttttaactcctcaaaacagtctatatttggagaaactataactattcgaaacaatcaggcatgtcaagggtatacgacatggtgacccgctattccctttcctcttcatcctggcaatagatccactccagtgtatgctagacaagaccactaaaacatgaatcttaagcaagttgtgaggtagggcagtgcatttccgcacatccatgtgtgctgacgacgcggcggtcttcataaacacgatcaaggaggatgtatgcgcgttcgctgagttgctcaaccgctttggacaatcgactagattatgcacaaacctgcaaaagctagtcccacgtagtcctgatcaggtgtgacaatttggacttagatgacgtcctatagggcacgccagctaccacaaccaacttcccaatgaagtacctaggacttcctctgacagctaggcggctacaaagaagagacctccaaccgctttatgataaatcgatgaactgcatagcagggtggcgggggaaacataatggactggcgggactatctaccttggtaaagtcgatcctcacatcacaacctgacttcctcctgacgggcctgaaagcttccaaagaataagtcgagatccttgacaagcagagaaggaagttcctctgggccggcagagaagctttgacaggagggaaatataaaatcaactagacatgctggagggctgggcatcctaaaccttgaaaaagtttgcaagagcattacatctcagatggttctggcatgagtggaggtcaccagaaaaagcatgggtgggatcaggaacaccataagacgacaccgataaattcctcttcgcagcggcgatgaccttaacaattggagaggagccaaaataaggttttctgggattggcttggtaccaggggcgacgcctaaaggatataacaccgctggtctacgcgactactaagaaaaagagcgcaagtctacaacaagcgtcgcaatccgaccaatggttggttgacctcaacctactgacaagctcaggttggacgacggagctaattagccaactcgtcaatgtctggggtgttgtccacaacctataattgacggaacacgaagaggacaagatcacatggaaactaactagccacggcgaatacacgacggcttcggcctacaatgcataactacttggcaaaggagccaagagacggcccaccacctcctggtgggatgtatatacgtgaggagaatttgggcggcaatagcagactgggcgacatgcaaactactaaagccaacgcaaatggcaataaacatcaacgctcctcgagtggtgggaggctactacaacaccagtgaagcaccaaaaaaggccctacggacgctaatgctgctagtcgcctgggtgatttggaacgaaaggaaccgcaaggtcttctagcaaaaagagctcccgacgaccggtataataatcaaaatgaaggaagaggccagaatgggccttggagggagtgaaacacctcgcagctggcttactccctccggtttgagattaattgatgttatgggttactccctcaggtttgagtttaatttacgttttagctttctccactactctctcccttctatttctccagaatacctctcatgcatgcatgcaaacagaaaaaagtaactgctgattggagtattaatgaggggtataacaggaaatatggatctaattaatactgtcattggtatttgccatgatgtccaaaacatcagttaatctcaaaccggagggagtacgttgtaacaatctcgggccaaagaccttgagcctgtacttttttctttcttgtgccttgtgcctgtacagttttactcctttattcaatgaaattggcggctcgccaattcattaagaaaaaaaaagaaatcataagatggaaaacttaacttttccagattcttataaattggccatatctctaatcttctccaaatacaaccatagtctcgcttgttcataaatttgtttgctgttcagtgtagtggactttggagttcggagtaccgtagacactcccacaccagatacttcctttggttttagatatatattacgccgcagacttctaggcataatttgaacaacgcatcgtcttgctcaatagtacatgaatctgcttttgaatatcacatgaataaactaagctgcaagtgttgcaaatataaagttcaaaaaccaattctaaattaccattcttctagaacttgtaggtattaaaatgatacgatatgcaagtgtgctaaatatgaagttcacaaaatgcactcggaatgacagcatatcaatttgctccccggcccctagcgcgatatattctgttttgaacagcgcctaaccaaattccaaatattaattcccaattgaccagcgtataaactgaagtaaatgcctcgcatgctactccatgcggagtctgttggagtaccatgcgttgagaacttgagatgcatacgaattaaatccgttgaggtgcatgctgattggatggagggggtattaggccatccccaatccatgacactaacatagtttctataaactccacatcatcaaaaaactagtactagacactactctttcaatgcaaacatcactattccatacttaaattaaatgctacttatctcacatgatgtcttggatattgtgtagaaaccatgtctcatgcaagacatggtttccttctctttccttatttattcacttgccatattatttttcattctaggtggcagcttatttaatactatagacaccatcctaatcattaggttgggaatgaccttaacaacaaatgttgtgcaccaatcaattcattgagagattaaatcagttcaggtgcatgtgcacgccgagtcgatttggtttccttggtcttagcgtagagacgttagagcaactttaataatatactccatcagtttcatgttgcaagactttttttttctagtaaaactcttttaagtttgacaaggtttcttgaaaaatataatatttctaatacaaaataaacatattatcgaactatattcaatgatatatttaatgagactaatttagtgtcgtagatattactaaattgttctataaaagtcaaacttaaaaaagttttacttagaaaaaaaaataaaaacgacttatcatatgaaacaaagaaagtagctaactattgattattagtttatattaaagctaacatgtataataggttaaataaaatattagttttattttctcctctatctctttctctcatcatgaattgaatgtaaatattttggagcaagtttcactactggaaaaactatctttgatcagtcgaccaaattccacaatagtcccagttgcaataaaaactgggagtaaagataatctttagtcttggttcaaaaggttagagctactttttgatctttagtctctattggtgttaccaaccgagattaaagattattttcagtcccggttcaaaaaagataggcggtgtcagacccctttattatttttagtcctggttagtaacaccaaccgggaaaaaagatcggcatgggcggagaggacgaggcgtgcgcgtgagatcgaggaggaggtgcatggtaattaataagttctatctcctcctccctttatctcttcctcctctccaccccatctcctcatcttccttcttctctcctcattcaccccatctcttcctcttcctcatctcctcctcccctctcctccccattctcaggcggcctcgcggaggggacgatttggcggcgactgggcggcggcctcgcacggcggcggaggcggcctggcggcggcggcggcggtggcctcgtgtggagggccacgcccggctgtggccggtgcgacgacaggcggtggaggccggcgctgcggcgtgcattttttcttttctttcttttttccttaatgaatgattcgatctgtgttgaatgtgtgattcgatctgtgttgttgttgtgtgatatgtgttgaatatgtgattcgatctgtgttgttgtgaatgaactatgttgctgtgagtgatttgggatgactatattgctgtgaatgatttgagataatgggcgtgagatacacaaaatagaaaaaaaagaaaaaaactttagtcccggttatttgaaccgggactaaagatagcgatatttagtctcatattcttactcccgattggaaaatagagactatatggggttaccaaccggaactaaagatcgatctttattcccggttatttgaaccgggactaaagggggttaccaaccgggagtaaaaagcatttccccactattttttaatactatagttagctcttacatgagagctaatacttctcatttttctttatctctttctttcacataagtttagtatactccatcgatccgtttcatgttttaagtcttttttttctaatcaaacttttttaagtttgacaagttttcttgaaaaatataacagcatttctaatacaaaacaaacatattatcgaactatatatattcaatgttatatttaatgagactaatttagtgtcgtagatattgctaaattattctataaatttagtcaaagatgtttgatttaaaaaaatcaaaacggcttataatatatatcaaatggagggagcacccatatttgcagtggcttgtatccaattatccgtatattcatagtcaaatttgttatttttgttataatttgtagaagtcgaatttaaacttgcatgtttgtgagatgatatattacatattaacctataatgcatgtcaatttttttgaaaatttttcataaactatttagatgacatgcaagaaacgggtggacattcacccgagtgtttaaaacagtttcccccatacttaggcattttgtcatttactttcactgttccatacagtaccgtcgagaaaacatctcttcaggtgacaacccttttagatgggtatttcttgacctgcctctacccgagcacctgcaaaaatcaggtgtataagaaaacggcacgtaaaaaaaaactttacacgaccgaatatctagagcttccttcaaaaaagaatgtttttataggctatttcttaaggcagccacatgtgaaaataatttttgcatgcgctgttggaatattggaaaagaaaattcagttactatgcaacaatgcacccccatacacaaaaattagtagatttcttatccgcacacatacatatcatcacattacaaatttacaaccacattcacgtttactaaacattaacatacatagttttaataaaatcatacacattatccacatcaacattcacacttagatacaatatatatattgacatacaaagagttttaaaccatacaaattcaatctccacgactggctcgcatgagatatatagtataatttctatctttgctcgtagtaataaggttttcaccttacggcagcgcattaaacatactatcaatgattaattttacaagtaatattgagatgatataggataaggcaggataaagtcatattgatatatatgtttttttaagcaactttcgcatagaaactttttttaaaaaaacacattgttgagcaatttgaaacactagtaaagaacattccatctatgacagcctctaacatgcctgaaattagtgggctgtcacgaatgagtcatctgtgacgggccaaaatatcgtccgattgagatatgaccgcacagacatgttagacgggcataaaactcagacccgtcacggatgacacctatcagtgacgggccataatttagacccaattgagataacattacatatcttaattgagccccaagttggcgcccatcacagaattcaaatctatctattatattattaaaacagccttgaaaggaggcaccacgttcgctgtgagggctagaaattctcacattaatcggagaaaaagaaaaggagagtccaaatagaaatacagtttaaaaacagctgaaattcgaaattaaaaaaaaaagcaatatggaaagaagagtccgtataagaacctaatacgagattaatcaaaatatagaataaaaataaaataaaatctgaaattagaaaagaaaaggagagtacaagtaggaatacaatttaaaataactgaaattcggaattaaaaataaggaatattgagagaagagtccatataagaacccaatacaagattaattaatattcgaaataaaaataaaatctgaaattagcaaaaagaaaagaagagttcaagtaggaatacaatttaaaattaactaaaattcggaattaaaaataagcaatattgagagaagagtccatataagaacccaatacaagattaattaaaattcagaataaaaaataaaataatatccaaaattagaaaattaaaagagagttcaagtaggaatacaattttgaaacacatgaaattcaaaaataaaaaatattaaaatattaaaataaaaaaggtttttaaaaaataaattctgaaattataaaaagaaaaaagattttaattaggaatacaatttataaataactaaaattggtgataaaaaataaagactattgaaagaaaagaccatctaaaacatatgacgagataaattaagtaacaagcctataaagaagtagagtggtagcggttgatagtacatataaaaattgttaataaaacaccaaatagaatcttaatgacgattaaaaggagggacaacaggcatgccgtgaagcaaacgagcaaggtgattgccgggacttctagaaagtaaaaaaataaaccccatttataatcatatttgatttttaaaatctcaataataataaaaaggagaagccgccgatggttggcgggacctctagaaaataaaaaaaataaattccaacgatagttatattcgatttttagaatcacaatgacaataaagagtgggcggcatatgggccgtagaggagtataccggcatcgtttgacgggacttctaaaagttacaaaaaatgaaacccaaaaagaaaataaactctaaaaactacaaggtccaattaaggtccagaacttctaaaaagtaaaaaaaaacctaatgataatcatattcaattttaaaatctcaatgacaataaagaatggagacaacgggcgagccataaaggagtacaatggcaaagccgctaacggtttggtgggacttttagaaagtaaaaaatgaacctgaatgataattatgttcgatttttaaaatcccaacgataataaaagagaaaagacagtggacgggccgtagagaagtataatggcagcctttgacaggacttctagaaattataaaaatgaaactcagcgagacaataacctctaaaaactaagattcaatttttaaaggtttcaaagagaatgaataaaaatagtggtacatcgagcaagcaaataaagaagtatatgatagaagtaaggggtagcagctgttgtgacttttaaaaattatataattagaaatacgtggatgataatgtttggtttttcaaagtcttaagacaatgagatagatatttaataaattttaagtaaaatcataccgaaaaatattattttgttgctagccgcgcaattgcgtgggccacccagctagttatattattaaaacagctttgaaaggaggcaccacgttcgctgtggggctagaaattcccacattaatcggagaaaaagaaaaaaaagaaaaggagagtccaagtagaaatacgatttaaaaatagctgaaattcggaattaaaaataagcaatattgaaagaagttccatataagaacccaatacaagattaatcaaaattcgaaataaaaataaaataaaatccaaaattagaaaaggaaaggagagtctaagtaggaatacaatttaaaaatagctgaaattcgaaattaaaaataagaaatattaaaagaagagtccatataagaacccaatacgagattaattaaactcaaaataaaaataaaaataaatccgaaattagaaaaaagaaaataaaagaagagttcaagtaggaatacaatttaaaattagctgaaattcggaattaaaaataagcaatattgaaagaagaatccatataagaacccaatacaagattaattaaaattttgaaaaaaaataaaataatatccaaaattagaaaaactaaaagagagttcaagtagaaatacaattttgaaacaactgaaattgaaaataaaaaaaataaaaacattaaaagaacacaatacgttattaactaatttttttaaaaataaattatgaaatttgaaaaggaaaaataagatttcaattaggaatacaatttataaataattaaaatttgtgctaaaaataaagactattgaaagaaaataccatctaaaacacatgatgagataaaattaagtaacaggcctataaaggagtaaagtggtggcggttgatacgatatataaaaattgttaataaaaaaccaaatagaatactaatgacgattaaaaggagggacgtcaggcatgccgtaaagcaaacaagtaaggcggttgccgggacttctagaaagtaaaaaaaaaccccattgataatcatattcgatttttaaaatctcagtgacaataaaaaggagaaacagcgggcggagtgtacaagagtataattgcagagtcgccgacggttgatgggacttctagaaaataaaaaaatgaataccaacgatagttatgttcaatttttagaatcacagtgacaataagagtaggcagcagacaggctgtagaggggcatagtggcatcgtttgatgggacttctaaaaattataaaaaataaaactacaagtccaatttttaaaggttcagaacttttaaaaagtaaaaaaaacaatgataatcatgttcgattttaaaatctcaatgagaataaagaagggaggcagtgagcgagccgtagaggagtacaatggcaaagctgctgatggtttggcgggacttttagaaagtaaaaatgaacccaaatgataattatctttgatttttaaaatctcaatgacaataaagagaagagacagtggacaggccgtagagtagtataatgttaatgttcgacgggacatctagaaattataaaaacgaaacccaacgtgacaataaactctaaaaactataaaatccaatttttaaggttctaataagaatgaatagaaatagtaataaatcgagtaagcaaataaagaaggagatgacataagggatagtaactggtgtgacttttaaaaactatataattagaaacacgaggatgataaggtttggtctttcaaagtcttaagacaatgagatagctatttaataaattttaagtaaaatcatactaaaagaatatatgattttgtttgggtgctagctgcgcaattgcgcggaccaaccagctagttttgtacataatataaatatttttgaagtactaatcacatctatcacctcattcaatgagtaacggtataattatttttttctcaaccttaatttcaatttaaaactacaccatactttcacctcattcaatgagtaacggtataattatttttttctcaaccttaatttcaatttaaaactacaccatacttgctttgtttgttaacgtaaggagcagatgatgtggaagagataagcgagtgcacacttgaatgcaattgaccttcggttctatggatctctgtccatctccacgacacgtacacaattacacaaacggtcaccgcgactgcacgaagacattgccagaaatcatagagaatgaaatttagaacgtacgagggctttcggcttctgccatcatcagaaaagtttcttcgctgattgatcgccagaaatcgcatgcagtatagtgtgaagttaaagcagcatatatacaccaccaaacaaacaaagcaacgaatgattctagaacaaacggctgtgcagaggggcggaggcggtttcccgctgcgatgcttggcgaaaaaagtgtcacacgcgaggtgcctgaaagaaccaaatacccccctagctataagatggcttgaagtgcttccttacaaaaagattagttttgtcgatcaagctgaagcaaagcaacatgcttgagccatcagtcttagtatcagctgctgacagatagctcgagagtgtaccttatacgtacatctcactcgatcccagagagttccatgcatgcttgatagctataaatacctgccgcgacagcctagaaactgaaactacatatctactccattaattagcttattaccgtcaatcttgaataatttgagagcaacatttagctgccccaatggccggcgaagtggtggcaatacatgtcgacgtcggccatggcgtcccagatgaagcacaagcaagtaccaagatacagaaactggatggcagccacatcacccccattgcgcagggcaagatccacaggttccctcgaggcctgattgggatcggcggctcaaacgagcagcggtacatcgtgccgaccttcgtggccattggcccctaccaccatggcaagcctcacctgcacaagatggaggaggtcaagctcgcggcgatgaaccgcttcatcgcaaccgcgaacggcgcctctgccggtgatgtctccggcaagctcctctccgtcgtcggcgacgtgcgcggctgctacgccgacgacgagaagttgaagtgcttcagcgacgatgacttcgcggccatgatgctcgtcgacggctgcttcctcctgcagttcatgatggagaaaaggaagccgctgttcgagggccgcgcgctgtcgtcggagtacagcatcctcaaggacatgatgctgctcgagaaccaggtcccatggctggtgctcgacaccctcatggagttcctgcccatggagatggaggtggagcaaaatgtccgctgttttgtggccgacgtgggagacatgttcctccgcaataataaggaacacgaagtctcgttgacaacctcctgtttcagcgtattgttcgaggtcagtccacataaaagcagcttcctcaaggactacaagccggcgaacctcctcgacctcctccggtccagccaaatatttcgcatgccaacggaagagctctcggtacggctggtcggctcgtcgctgctgtccagcagcgccgtcgagctggcccagatcggcgtcaacctgacggcaagcacggcggagtggttcggggatatgagcgtcaaggagggccctgtctacggcgagctttccctgtcgccgatctttctcaacgacgtgagcgccggctggctcgtgaacatggcggccctggaggcgagcggcggcgccaccaccgcggatcagtcgtcctcgtcctcgtccgtgatgtgctcgttcctgtcggtggtggcgatgctgatggacagggaagaagacgtgcatcagctgcgggcgaagcaggtgctgtacagcacgctgagcaacgcgcagacgctggacttcttcaagcggatcagccagcacctcggcttcggccaccgctacttctacatcttgcaacagatcaacaagttcaagcaaggcaggccggtgaggtccgccgtccacaagttcctgtacaagcacataagggccatcagcatcatcttgtccatcgccagcgtgctcgttggcatcttcaaagcactcagggagctatagtaattaagctttcttagttaagcgttgttactttctccaacaaacaaaaaatatataatttgatttaatcgtttggacacttatacaaagccgtttttgagtaaattgtccacgaatattcttttagtactactatttatgttaataaatctttaattggttttgcttaaagaacatccgacatttttttggggtgactttcgattttcatacgcggtgctccttacctgctgagctattagcaatttcggtaagttacaagcaaattagtatatattagttgctaatcaatggagtgccgggtccacgcttccctcaccggaagggtctttggcaagaagatcctctatttcccatactcttcattctagtcatggatgtgctcaatgcgatgctccgcaaaacctccgactcaggcgggttccttttgctcaacgatcgtgccttgcgacaccgcgcgcctccctctatgcggatgatttggttctcttcctctccccggttcgacaggatcttaagttcatctagggcatcctctttgtctttggtgcagcgtccaggctatgcaccaactttgtcaaatgctcgattactctgatccgttgttcggttgaggacttggagttggttcagtcatgctttccctacgcgatttctgactttccttgtacctacctcagcattctgctgttcgtttgcatgttgccgaagacggccctgcaaccacttgtggataaaggggctatttggttgatgccctgagaagaacttgccctagtgaagacaagcctgaggctagcttgaaccttgtttggttgctatcctgagatcaactaccccttgcctagcctgattccttctgacttgcggttagcctgagccaggcgacccattttggtcgcctgaactccaggccgcaacagccaccgataattagcgctgctaatccgtcctgctgccctgcgcagccgagtagccgacaccccagatgccgcaccaaccccttgcccaatcctccgttcaactgttgctgctcgaagcttcgatgtcaactagatgcaagcgatacttgtgatcatcgtgcaattggatggactgctagtgtatatagatgagagattactgttgtaaaatgaatatgtattatatttttacgctttgttcacataataaacgtcattcaatggttgtgttttgagctcaggcacgcttgacctcaggcctgcaaccaaacagagtaatcttaggcttgcctgatcaagccgaacgcatcaagatttcagggatatttcaggcagcacttttcttcaggcatgtagctgagggcaccaaccaaacaagcccaaagtatcccattgtcttccaccctggaagggacgactcaccactctggctggccactctatgttggtttagtatgttctctcctctattccagtccatgtgtctatgacgatcggtcttccagtctaggtcattaaggccattgacaagaagcgtcgcaccttcttatggaagggttcagactcggctcataggagtagtgccaggtgtcctggacgaatgtctgtcatcccaaagctttcggagggttggaaattcctgaccttaggatggcacggtttgccctgcgtgtttgttggctttggcttcaacgctcatgacatccttactgcgatgtcctgaaggccctagtcgagcagaccgtctctaacatgttcgaggcatccacctacttcgtatagggcgatagtgagtcgatgctcttctggtctgaccaatggatcggcgtctgctcggtggcctccttggctccagatctcctcttcgttgtgcctgatcagcgcctccgaggttcgtgcccggttgcttctggcttggcaaacaattcctgggtttctgatatccgcggtgccctcactatcctggtcatctcccagtttcttcttgtttgggatgtggtgcttcacattcagctctcgccgggtgtcgggaatcgtcttatttggcgttggatgagtgaccagcgctactcgacacgttcggcataccaggcgtttttctatggccagcacacttttgcctgtgttgttcttcactggcacgcgaatgatcctgctaaatgcaagttcttcctctagtttgcattttagcagcactgctagatggccgatttcctccagaagcgtggtattgatagccactcggcctgtcccttttgcacttaggagctttgagttggcgaaccacattctccttgactgcatgtttgctcgataggtatggctctgtgtgctgtcgccttctgatcgggctgccctctctcctcctcgtggcagctggcttcaggactggtggccttcttctagggtatgtttacctgagcatctctgtgccggcttcgactccatggtcctcctagtatcttggcaactttggaaggaacagaactccaggattttcgactctatgctctcttttctgtctcaatggttctagagtccatcctcactaagggccatctatggtcgttagctagcgttgcttgttttggggttttcttggagggtagtatggctctgccccattcccgctgattggagttgtgtttagccgtcatagtagtctcttccttttttcctttgttttttttcttgttttgtcttttctcccttcccttggcataagctggtcagactgattgtgttgtgtaaacaaacactcttttcttctaatatattgatgtgcactacttttatgcatgcgcaaaaaaacatattagttgcattataactatagtacaattatggcccgcgcaataccatggctagcaccattacaaaaattatctaatttgtttacacctgattatcatcttattgtcttaggatttcaaattttattttttattctgaattttaattaatcttatattgcgttttatatggatttttctttcgacgttccttatttttattctgaaattcagttactttaaaattgtatttctgcttgaacttttttctctgtctccaattaatggtatttatagcctcaacaggaaatgtgatgtctccttttaagattgtttaataatatgatagatcattttagatttatagatacaccaatttttaatagtgatcaaattggtatcttgctaacttaatttcatggatgacaagtggttagtatttactatggagggaaatatgtattatttttagcctataatctcgcgaggtgtgcacgcatacagggcatccgatctacacatccatgtatggggcatcctgatctgcacaggagcagtgttgttatcatctaggaggctcgaacctgtatagggatatgtagcattgttcctaagcagctccaagcacgccaaagcatcttaattagagccccagacgtatatgagggctcgaccgggaatagtgtcggagccctccacttcttgtacgctagctgctatataccattataccaccgtcgtcatcacataaggatgctggcgacgggcaccggccggccacaacgtctgcagagtagtggccgccatcatcaattaatactacacttctccgcctcatctccgtataggttttcctgcactaataattctcgctctgcttgacatgagacttcttgtaacgtgtaagagacctcaggcatgcgtaggcaaaagtgcagggcatatgtgatagaaaatcagacagaatgaaggaacgtataatagctttagcctttagccatcatcacaaaagtttcttaggctctatttgttcataggactaatctctattttaagtcccttttagaccttaagaattcaaacatggatgactaaaaaggaatacaagtacatattagaactagaatccattagtccctcttgaaagtacttatagggtctctcttttctctccctaaaatggcagcctctctcttctctctcctttgatccacgtgcctttagtctatcttagtccctagatccaaataataggggactaaagtttttaatctagggactaaatgatccaaacatggccttagttgatcgatctccagatatcgcattcagtagtttgaaattaaagcacaatatatgcaccaaacagaaaaaaaaaaaagcaacgaattgaatgactacagaactaaagtttgcaatgctgcatgttgcttcgccaaaaaaaaagtgtcacatggtgcctaaaaagaaccagataccccctagaagatgacttgaagtgcttgcttacataaagattagtagtatcgtggatcaagctcaggcaaagcaacatgcttgagccattaatctaagtatctgactgacagctcgactgtaccttatacgtacatttcactgcacttgcatgcgtgctccctataaatacctgccgcgcgcgacagcccggccggaaactgaaactttgttatcctcaaacttgatttcttagtgagcaatatatagttagctagccaccgccatggctgacggtgaagcagtggcaatatatatcgacgtcccaggtgaagcacacaagccactttgaaggatatgaaagagaggatgaccaagaatacacggttgctggagggcagccagccacggcgccgccattgcgcagggaaagatccaccggttccctcgaggcctgcgagggatcggcggctccgacgagcggtacatcgcgccgaccgtcgtggccattggcccctaccgccacggcgagccgcctcacctgcaggacatggagaaggccaagctcgcggcggcgaaccacttcttcgcggcctctgtggaagatgtctacggcaagctcctctccgtcgtgggcaaggcgcgtgactgctacgacgacgacgacaaggtcaggcacttcagcgacggcgagttcgccgtcacgacggctgcttcctcctgcactacttgagccggggcagcgcggtcgcgtccgaccacaccatcctcaaggacgtgatgctgctcgagaaccagatcccatggctggtgctcgacaccctcatggagatggagttcctcaatgtggacgtgcgcaatttcgtcgccggattgggagacaaattcttccccaagaacggagacaaagctggcaggtggtggtccgtcgtctgggcgacaggccagcgtggaaacatcacgaagcttaaaagagacatcaatggcgggcagagttatgaaagctaccggccagctcatctcctcgttctcctccggttcagccagatatggcggatgcccgaacgagagatcaactacgtggcggccaacacatcgttgctgtccagcagcgccgtcgagctggcccagatcggcgtcaacctgacggccagcacggcggtgtggttcgcggacatgagatgatgagatgagactagtcagggagaagcgcatcttcggcgagttcctgctgtcgccggtgttcctgaacgacgtgaccgcctgctggctggtgaacatggcggcgctggaggcgacgagcagcggagcagcggcgtcgtacgtctacggcgactttgtggtgagctcgtacctgtcggcgctggcgatgctgatggacagggaggaggacgtgcagcagctgcgggggcatcgcgtggtgctcagcaccttcagcaacacgcagacgctggacttgttcaagcgcatcggccagcatctcagcttgggcagccgctacttcgtcgtcttggagcagatcgaggcgtaccggcggaaccggccggcaaggaccatggtctacaagttcctctacaagcacatcaaggccatcagcgtcatcttgtccatcgtcagcgtgttcgtcggcatcttcaaggcacttaggggacgctagccaatgccaaccaggcgagtttttttttttgaaaaataaataaaggaataataatctagcctctctacacccagattggtagtagatattaattggtagtactggatatatagacaagaacaattaacatatcctgcagtcgaattatattaactactttgattagtattttggctttaatactccctccgtttgttaagagcaaagataatagtagagctcacttcctactattagcccatatatataatagattagggagaggattctagtccctcgaggggtcctcgtatacctttttctttcaaattcgatgtaaatagttgtgaaaaattctgaaacaaataataatgtaaagtataatgatacctactagttcaccaaaatttaagttcaaattcgatctatacacatcgagaaacaaaaaaggcaaatttagatataacagtatgctactattcatacgctgaatttgtcttttttatatctcgacgtgtgagttgagtttggacttaagattttgtggagttgtatatatgtgttgtataaatgttgtcaaatttttctagaatttttcataactgcttagatagtttttaagcaaacgagggaacatcccctcgagggattagaatagtttcccaatagattagctataagattggctacaaatttcttctcctctctctatctctcacttatatatttaatatatttgtcttggagcttgcgataaactagctcttgcatgagagccaataccgttgatttttaattacctctcttctccatgtaagtttatattaggcttatagctcaggtgctcactattatacttgctctaatacttgaaattttgactttgcactgttttatttgacaatttctatttcattcaatgtcctagatgtattgtttatgacaatatttttgaaacgatggtcaaagtggcagctagttgactttcaaggataggaagtgatttatattgatggaggacaagattttgaataataagtttagacttctcagccttttgaaggtttatctgttaataatcagtttatgataatcatcggcgctggcgatgctgatgatctgatggacagcgaggaggatgtgcagcagctgcgagtgcgtcgcgtggtgctcagcaccttcagcaacttgcagaaagacgctgttcttcctcaagagcatcagccatcacctccgcttcggcagccactacctcttcgtacgtcttggagcggatcgaggagtaaccggcgccggaatcgcccggtgatagccgcctttcataagtttgtctacaacaactacaggtatttgggcgccctatcgtccctcgccaacatcgccaccagcccaccaccattatcaaactttaaaaaaaactaggaagatagtccgtgcattgcgcgggcatgtattttagattgcgttcgaaaaacttatatagatcgaatttcaactcaatgacattgccatgtttcataagtactatttctccataattttacttcatcggtattgcttagataatttttccaaactatttgttagcttttaaaatatataatatttaattcattcgtacaaacaattatctatgatccatataaacatctctcatatttcaaaagtatctatttagtttgtttggaaaaaaacatatctaacgaattaaacgtaaattaaaagtaaaatattttgtcttgtttaattgaatgtttattggctttttttaacaaatcctaaagcactattattgttattgttagtaaacagttttgaggctgcgttcggtaggacatcttcccaactcctcctcctcgttttccacgcgcacgcttttcaaactgttaaacggtgagttttttgcaaaagtttctatacgaaagttgctttaaaaaatcatattaatccattttttaaaaaaatagctaaaacttaattaatcacgcgctaaacgctgcttcattttgtgtgccgggaagtgaaggttcccaaccctcactcccgaacatagccttagttggtttatattcatgcaagttgttacatatttacatataagttaacaaagacatatcgtagattatcgcttccttgtaatacgtttgacctatagtatcttttttaaaagaaaatatagttaacatgagtttgaaaaattaaatttaatagtaataaatataatttttcaactaacaatatctatactgctaccatagcgtggcttaatagcctgacaaactcataatactatggtataggatagatgcaaggccattaacatgtaagtatttaaaaaatattataaaaatagaacatgtaatgggctgtctaattttagtgaaaggtacgaacttatttgattttctccaaatagttcaatttagtccctattggtattttatattttaaattttattttataccagttaaaactatagaggatatgaacctttaaattgttgatttaattatgaatagagcaatagttagattagaaatcagatgaacagctaaaaaaattgcatgttttaatattattgattatttctcactataaaaaggaggggtaaaggagagagtggagaactcaagctgagacaggaggggaggaggggacatgggtagtgttgtgttgtgcacatgtgaggggagggcgaagtgggggggccttttttttctaatgatttaagtgaaaatcgatgatccgcttttttttgtcaaaatttttaatatcctttgcgtctaaattttaaggcgtaacacatggcagcttaagattttctctaatattatatctattggttaaaataatggatccacctattaagtgaaaactgatggtcaaatgtcttttcttacaatttctaaggtcttacttttaattaagatgtagcacgtaagttacgtaccactgtaaatgcgctacagaggatgaacaatgattgaggtgatgtaatacttattgtcattttttttataatgctctattttttttttctatttggttacctgcaaaggataggtgtgtatgcttaaatggtatattttcatttttacgaagtgaaatatgagtaatatgcatcttgaattatttatttaattataaacaaaataacagttcaaataaactaaaaaacagatatgacataagaatcataattatttagctttgtaattattgatcattttttattattttggccagtgtatatttttcgcgtcaacatatggacgccggcacctgggagtctagccacttgaggcagccgcggtcctggcgcagcaggctgctcgatgacggcgccatcggcgagagcttgtggagcaagccgacgtcgaacaccgggacgtcgaggcctcgccgcagtgccgcgagttcgtcgtgctcgagcgaatcgaaggtgttgaggattagccctgacgacgtcctcgccaccgcgacggcctgggatactagctaagcatgagcaccgcgtttagtgctctgggacgagaaagaggacgataccgtcgcgggcgttgggagaacgggataccggtatctagctttctcgattcacaaggcctatcaagcaacacaacttccaatccaaatccctaagatccacagggcctcgtacccccggcgtgcgcgaggcgagattaactcgcgcgcgagatcagcagtacgggtagcgtttctcgcttttcttttatgttttcttcttgcttttatttttttttagaaaaataactgcccgcacatcttcttccttttatttaggacacggaaaattaggattggtacggaaatttaactacaacaaacttttaaattcaggatttaaaactttcaacttatgtttgaaaacttgtaagccaagatttgaaactttcaactcaatattttttaaaattttcatctcagattttaaaattctcaagtgaagacctaaaaacttttaattcagatttgaaaactttcaactcggatttgaaaactttctgttcagtcttgaaaagtttcagttcggatttgaaagttttcaaatcaaaatttgaaacttttcaactaaaatctaaaaaaattcaagtcaatatttgaaaacttttaacttaaatttgtaaacttttgtctcaaaattcaaaatattcaatttaaatttgaatttcgtctcaaaattcaaaacactcaacttaaattttaaaaaaaaattaactcaaattcaaaactctcaagtgaaattggtgaaagattcaatttattatattattaaaacatccatgaaagaaggcaccacgtttgctgtgggggctagaaattcccacattaatcggagaaaaagaaaagaagagtgcaagtagaagtacaattaaaaatagctgaaattcggaatcaaaagtaagcaatattgaaagaggagtacatataggaacccaatacgtgattaattaaaattcagaataaaaataaaataaatttcgaaattataaaaagaaaaaacaggagttcgagtatgaatacaatttaaaaataactgaaattcggaattaaaaataaggaatattgaaagcagagtccatacaataatccaatacgagattaattaaaattcgaaataaaaaaaattaaaaaatcaaaattagaaaaaagaaaaggaaataagagttcaagtagaaatacaatttaaaattaatttaaattctgaattaaatataagcagtattgaaaataaaagtacatataagaacccaatagtagaataattaaaattcaaaataaataataaataaaatccgaaattaggatgattgaaaagagagttaaagtaggaatacaatttagaaataactgtaattcggaattaaaaataaggaatattgagagaaaagtccatataagaacccaatacgagattaattaatattcggaataaaataaaaaataaaattcaaaattagcaaaaataaaaaagaaaagttcaagtaggaataaaatttaaaattaactaaaatttggaattaaaaataaacaatattgaaagaagaattcatataaaaacccattacgagatttattaaaattcagaataaaaaataaaataatatcaaaaattattagataggaatacaattttgaaattcaaaaataaaaaaatatttaaagaacattataaggtattaattaaaatttgggggaaaaaatctgaaattagaaaagaaaaaagatttcagttaggaatacaatttataaataactaaaattggtgataaaaactattgaaagaaacacatgacgagataaattaagtaataggcctataaaggagtagagtggtggcggttgatacgacatataaaaattgttaataaaacaccaaatataatcctaatgacgattaaaaggagggacgacacacaggccatgaagcaaacggacaaggtggttgccgggacttctagaaagtaaaaaaaaacctcattgataatcatattcgatttttaaaatctcaatgataataaaaaggaaaagcagcgggcgggcgtataggagtaagttgtagagccgccgacggttggcgggacttctagaaaataaaaaatgaattccaacgatagttatgttcgatttttagaatcccgataacaacaaagagtaggcgacggatgagccgtagaggagtatagtggcatcgtttgacaggacttctaaaaattataaaaaatgaaacccaacaagacaataaactctaaaaactacaaggtccaatttttaaaggttcgaaacttctaaaaagtaaaaaaaacaatgataatcatgttcgattttaaaatattaatgacgataaagaagggaggtagcgggtgagccataaaggagtacatagcaaagctgctgatggtttggcgggacttgatgcaaacccgctagggtttgtggcctgatctttcgatgagaggtaagggataactcgattagatgaagtcgacgttcacggcccgactacaactatccaaagacgctgcgccttagcaaccgatacaccgtctccaatggtcgccacgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacagaaaatagtcgggagtaaaatgataattgcgcccgctccagaacagatatggacatgtggctggatccattcgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcatcctccccttcttgcatttgagtcgtcctcgactcaagctcatcttcttctcccaaatacggcttcaaatctgcaacgttaaatgtgggactaaccctgaaatctgcaggcaaatcaatcttatatgcattctcattaatctttgctaacactttaaatggtccatcagctctaggcatcaatttagactttctcaaatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttgggaatgacaagtagtagaaaacaaaagtttagtccccaatttagcccacaaagttctccaaaaatggctaagaaagtttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcaacgagcaacgaacctgccaacatctcttcgcatctgtggccaaaagaaatgactagcaaggatgtcatgtgtcggtgacatgggaccgggagtatcatgactagaggcttgggcaggagcaatcacccatgaggcctgaccccctcgggggggtcgggcccgagggtgatgtggccgcccccctcttagtctccccgaggggtcggaccgctcccgtttcggccccgagggttgaggcgccccaaccccttgggggttttgtgccgcgtgtatgggttaggtgagcgcagcggggctcacctaaccgcatttattgcggtttggacgagcgcgtcatgccgcatgtaacgcagtgcagcacgctcgtttatccggtctgtgaccagtcacagaccgaacagatcgtgggttaggtggcaacaggcggtctgacgcacgcctcgccccatcccgtcaggatgagagcctctaagcactcgtccctagccggtgccggcgtgttagctcctggagatggcacgttggtcccggtcagatgtatgccaggcttcatcctaaccattacaagcaaaatattgtatgaagaagggcgaacatgcagattgctaaactgacacgtggtggacaagaatgaccgatttgtgaccggtctgacactggtcatgtcgtcagcagacagccatgttcccacgtcgcgcctgcttccggcggaagtggaggtaggtatgggccatcccatcagaaggtcattcggacggcaaccatacaaagctccgtccatttatgaagagaaggcaagtcaagtttgagaaaagggaggataagtccccacacaaaagagagagatggtgcatgtggtatccccttggtataaaaggaggaccttgcccacttagaagggggattgatgggagattcagcaggagagaggctgggatgcgacccctagcgaagaggatcagccccaccggaaggtgcagcggcccgtctactttgttagtgaggccctccgggacgccaagacccgataccttgaggaaactgcgccattatttccaggcgcatcgggtcacggtggttacgtcttaccccctcggccaaatcttgcataatcgagagggtacaggacgggtggtgaaatgggcaattgaactttctgagttcgatttgcactttgaaccacgccacgctatcaagagccaggccctcgccgactttgtggcagagtggaccccagctcccgagcccgtctccattcccgaggccagctcgggcccctcgcagccgccgcacaccgcctactgggtaatgcagttcgacggctccctgtctcttcagggcgccggtgcgggggtcacgttgacctcgccaagcggagacgtcctcagatacctggtacgccttgactttcgggcgaccaataatatggcagagtacgagggactccttgcgggactcagggtggcagctggactggggatccgccgcctcttggtgttaggcgactcccagctggtcgttaaccaggtctgtaaggaataccggtgctctgacccgcagatggacgcttacgtgcgccaggtacggcgtatggagcgccattttgacgggatagagcttcggcacgtgcccagacgggataacacgattgccgacgaactctcacggctcgcttcctcgcgagcccagtccccaccgggcgcctttgaagaaaggcttgcccagccgtcggcgcgacccgaccccataggggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcgacgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcggatttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaatggccaagtggagcgcgccaatgcggaaatccttagaggccttaaaaccaagaccttcaacatcctcaagaagcacggcgattcgtgggtcgaggagttgccagcggtgctctgggcgaaccgaaccacaccaagccgagcaaccggggaaacgcctttcttcctcgtctacggcgcggaagcggttctcccatccgagctcaccctgaggtcccctcgggccaccatgtactgcgaggctgatcaagatcagcgtcgcagagatgacctcgactacttggaggagcgaagcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccgatgtgggagggtccgtatcgagtgatcggcgtcccccggctgggctccgttcgactggccacgggcgacggcacagagctgcctaacccgtggaacatcgaacaccttcgtcgcttctacccctaagggggatcgggtgtcaggtttcgggctcgggccaaccccgcacccccctcgggcgtgcagggttggccgggggctaccacatatgcatatttttatttcttttatatctgtatttcaataaaagcattttcaatttcctaaaagttgtatctgtgctgttatttccttttgaagaatcttgacttgaaataggtcgcttgtgctcaatcctgccctcgggggctcgggccggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccgtttgaggactgggacctgggcacgagtccttgatcaagccaagacacaaaaggactgtggcacagaccatcctcgtctcatacacacaacaaatagaattgacacaaaaaatttcctctttatttgattgcagattaaattagtctatacaagaagggggcccgaaggcctcggaagaagaaagaagaaactatttagagattggcgggggcctgggggctcactccgatgcacccgggttgccagcctcgtcgccactgtcgcccactccgccgtcatcgtcctcctcgtcggagttgagggcgaacgcgagccgaggggccgaaccctcgaagctgtggacgatgtggtcggcggcgtcccggacctgcgcgcgcgcatcgtcctcggttccgggagggaactcgtctagcgccgcccatggggagaagtccgggtctctggcctggtagctcgccagtacaagctccactgccccccgggcgaggtctctagaggatgacttaatcgtcctctcgagctcctcgaggagccgttgaagagtctcggctatctccgagaggcgctgggcgaggcccccctggttggcggcgtacttcgcgatccgcccaccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggctaagtcgctttcgcccgcggccgccccgccgctgcgcgccctcgcgtccagctcctttgcctgcgcctcgagttcagtgacccgctggttcagtgcggccctctcggcgcggacgccttccagattacggcgcgcctactcctcccgcgctgcctcgcggagggacagactgtccgccagccgttgcgccgcggcctcggcctcctcgagagctcgctcccgctcggtgagcgcgtcctcgcggaggcggagtgtggactcctcttcggcgcaggcggcctcgtgcgccgccagcgttgcctcccggatggagacggcggcctcgcggtccgcaaggtccctctccacgacgcaggcacgctcttccagcgccatggcacgggcctcaagggcttcttcgcgccgccgggatgccacctcggtctccgtcgcccgccgttctcgggcagcggcagcgtcaaggaccccccgggcggcgtcgagcttcttccctagctccgcctcccagctcccgtattgaaggcggagggtgtcctgcgcctcgttcatcacggtagtggcgatgagggcagccccccgctcctcctccacctccttggcgatctcccctagcaccttccgacgggcttcgagctctgagacgtgccggcggtgtgccttgcggcccacctccaccatggcctccaccgagcgtcgcccctcttcgacacgcgcccatgcggcatcgagctccgcccgctctgctttcagggcctccacctgggcacttaacccgtccaacaccgtggtgtttgcgacggccaaggcctgcagaaggggttctgcgctcagtggggcaacggaaggtgtggggaagagccgccttggagaggatgccgcgcggctcagcccgccgatggacgtgccggactcggggatgtcacccggacctggttggtcctgagcgtcgcacgagggagtgggcccaagcgatgcgcccgcggcctcgtcgcgagctgcctcggaagtcgtcgtcgcctcggccgaccgaagtctggcctcctcccgagcggcttcttcagcttggcgagcttggacggccacctgggcagcttcctcggtttcccgaaggcgatccgcagcctcttgccggtcagtttcacgggtcgcctcggaagatgtcgtcgcctcggcctggtggagtccggcctcctcccgagcggcttcctcggtctggcgagcccgggcggtctcccgagcggcctcctcggcttcccgaaggcgatccgcggcttctcgccggtcagattcccgcctccgggcctctgcggccgccgaatcctcggcctcagactggccggacttggaatggcgggaggaacgcgatgggatctcgctgaaacagaagaaagaccagaagacaaacaaaatgggtgagtggaaactcgcgttgagagaatgaatacagccacgatgggtgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccaggtgcctgctgctggcacgcgccgccccgccccctcggggaggagatgggggaggggttccttcctgcttcctcttcccccgggcgtcggcagggcggctgctccccgggcccccgtcgcggggcccagaagcacgaccccctcctggggtagattgttcccccctgtggctcccgcccgtgccattgtggcctcgaggagcccgctcctccgacgccccgaccgcctgcatgatggtcaggatggaggcgcggtctggatcgctgcagagggggaggactccttggggaataagggatgcctccacggagctgagattcagcaccctttggaccactatcttgaagtcctcaggagcccagtcccatctgactccctgatgggtcctcatgtagtcttcagacccggtgtactcccaggcgccccgggcgcgccgctggagcggcgcaatccggcgacgaaggtagtcgtcgtacaccatggcccctgtgagcccctgggatcgcaggcccgccaggcggtcgaggacggcgtcatagccatctcccagatctaccggcgcccgccagtaggaggcctgcgccgggggctggctcggaagttggaggcgcgcttcgtcggcaaggggggtgtagaaccagtcgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcacccagcgtgactatctcccggccggtggcagattccggcatgaagcggcgcggcagcccggcctgcctctcgctcacgatgcgggaaggcggcagcacgctaccatcaagcagagtggagccccgtgccatgacgccggaggaagagatgtttgaaagcgagcgcgtgtggcgaaggtagggcacaggaaacaaggagttagggtgcaagcggcgaagacaaggggaataatggtgagaggaaggaagcaaatctcttcctcggagtctttatacccttgccaacgttgtgcccggctcctcgcttctcgcgcccactatatcgctccctcgtttctcgcgcccacgcttccactaatcccattcgcccgcttgcggcgcatgaggtggatatgcggctgtggcagtcgagatggaacatatcgtgcgcgcgttaattacgctcgccaatcgaagcgccatcaccatatctccaggcaaaacgaaccggctcgtcccgattcgcgtgctactcgagtaatgtggcagtcttgaagagaccgctcattattgacagtcgagttaccattgccgatgtgcgtgattggcgaccgttgggtttctgcccaactatggagaccggtcccacctgtcaccaggccttagggagtggcgtcacgcccgaccgcttccctcgaggagggcgatcgccctagcataacgccgggggctactgtcggtgacatgggaccgggagtatcatgactagaggcttgggcaggagcaatcacccatgaggcctgaccccctctggagggtcgggcccgagggtgatgtggccgcccccctcttagtctccccgaggggtcggaccgctcccgtttcggccccgagggttgaggcgccccgaccccttgggagttttgtgccgcgtgtatgggttaggtgagcgcagcggggctcacctaaccgcatttattgaggttcg

SEQ ID NO: 59092 - DNA, 1098 bp, Oryza sativa
gtaatcgggtagaccggcgtcttgtcaggattgaagagcccaaaatgcctctcggtctcatccccgggcttctggttctcgttgaacatggcgaacacgtacgtctccagtggcccgggccgcttcggcgtcccgttcttgacgttgtcgatcacgccctggttgtggttcatcgcgttctctgccgtcgccgcgaaccctcccgccgacggccacccggtctccgacacggcgatgcggacgttgggcgtgccggccttctccagcgcggcgtacacggcgtccaccatggcgttgaagaggttggtgtaggtgaggccgctgtcgctgtccctcaccgtggtgcccggctggaacgtggcgtagttgaggctgatgtcgcgcgggttctccctgtaggagacgtaggggtacacgttgacgagcagcggcgacatggtgttggcgaggaactgcgcgatgggagccatgaactgctgcacgtcggggcggaacacgccgtgcgacggagggaacgagtcggtgatcgcgtccatcctcaccgccgtcgacaccttgatgctgttcgagaggccggcggacacgagcgcgtcgtacacgttctgcatggccgggaggatggtccccatgtcgccggggccgagctcgttgccgacggcgatgtaccggatgatgacgttcggccagtaggcctggacgttgtcacgcacccagtcggcggcggcggaggggttgttggcgaggttggccaccgcgccgatgccgccgacgtcgatgatgacggcgatgccgctgccgcggagcgcgtcgagggccttctgatccgggctgtagatgcgcatagcaccgatgccattggacttgtacagctgcacgacctcgctctgcgacgggaggttgtcgccgttcatgccatagcaaacaccgtggacacctgcaaaaacataggagtgcatgttgataccaaatcagacgatttaattgatgtgtaaggaaataaaatagcaagagagagagaaagagagagagagatcgaattgcatatgagagggttagttaattgattagcaatagatcagctcagcatgaaagagaaaa

SEQ ID NO: 59093 - DNA, 5404 bp, Oryza sativa
catcctcttgccgccgctttggctgcaagcgccgagcgccagctcgcgccttaaccgtccaatgtcggttcccctctcccaaaccgacattgccgtccatttaagcccaagccctccccctccaaactccctcattttcgcctccgcgccattgctgccctctgtttcgccgtcgccgatcgtcgttgcgcgtgtcggaggagccggcacgagcaaggacgcggaagaggactccggccgcgccctcttcttcctcttccccggcccgaggccggagagattactcccgcgccgccggcctctcgtcacagcgcccctcctcttctcggtgatgtctctctccgttcttcctcctcgctccatctcctccccctagctttcggtagtagcttgagtagcctccccgtagttagccggcgccgccccgaccgttgccgtcgctcgccgtgtgttcgccgccgtcaccgctcgagctccgtagcacccgctcgtcgccggcctcgctcggcgtagttccgtccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcaccgtggttcgctccgccgctcgccgccgtcgcccgccgtccattcgcggccgggtcgtcgtctacctcccgccggcccgcgtggcagccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcgcatgcaccgcgtcccttccccgcccgcgcgcgtgcgtcgcgtgctccctccgcacggtgagccgaaccgctgacaagcgggtcccacccgggaccgcgcgtggtgagcccggtccacggcccctctctctcctccctcccgcgcgcgcgcgagtttgggccgccttgggccggccggcccatttagctcggccagaccgctccatttctcttgggccgcgccctagccgtcctagaaaagtctatattccctccctcccttcttttctttttcttttcccaaaaggatttaaataaatcctttttcctttagaccaaaaatccaataatcttagaaattcaatatcttcccaaccgtaattccgtttgactccgttcaacttctaaaatttctcaaatctcgagatctatctagtggcacgcttagaggtctttaatagggctttatttttgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgtgaactaaatgaatttccaaaaccgcggaccggggaacgtaccgggtgtacggtttcccgctctcgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccacctctgcagaggttaacaaactgttcgaacagccgtgcccacggtcatgggcggatgtgaggtgattcctagcgtagttttgtttgactactgccttgtgaaatttgctgttgtggaaaggggatcgatgtttggaaaatctgcagctgatgggatcagctaggcccgggtggccgtttgaaggttgttggcccgggtggccgtttaaaagttgttggcccgggtggccgtttgaaagttgttggccgggtgccaaccttgaatcaattcaaaagactgatacattgcacatactccgaccggacgagacgcactgtctcatccgtgtcgtttgagaagcactcacttagttgatttcagaaaagagttcaaacaaaatcaattacgaaaacaacagcctttccttgaagcctgcattaaacacttatttcccgtggcttgctgagtactcccgtactcacccttgctctatataaataatcccccccagttgctgaagaagatgaagtggatcctgctgacgaggagttcttccaggagcaagccggctacgatgagttttagggtttcggcctagttcccaagtcgcgcctgtgatgattggtccaagtcctggcttccgctttccttttgtaatgcagttgtgagttcaggatctgtccgcagcccaacatgactgtacttctactctataataaagagacctctgttgctgtgatactctgtctccctgtgataccagcactgtttcctgggactggtatcgattaacaggttaatttggagcgtgacgggctagttccggtcgggactagttcggggcgtgacactggtggtattgcatgggttgacatcctggcctagggcttaataggattaatagaatactcatatcaacaagttgcaacttcttttccggaagccaatctccaaataactccagagttaagcgtgcttggcctggagcaatttgggatgggtgagatatgtgttggtctgtgagggcagtctatgacctatgaaagctatcagatgtaagcgggcctggcctgggggaaggcgggacgttacaaattggtatcagagccgactctcgcggtttcacgggcgcgtgtgttgcagttgcgcaggcatggtgcgcatggctggtgtagaccgggagtggttacacagcatggcacatgtgctggcactggacacatggacgtggccaagagaggacgttcctggcctagggttgatcgacgggggcgtcgatctctcttaagggggtgagggtgtaacatcctggcctagggcttaataggattaatagaatactcatatcaacaagttggaacttcttttccggaagccaatctccaaataactggcctggagcaatttgggatgggtgaccgatcgggaaattcttcccgggtgcacacgagtgaggacaaagtgtgcagaaaagatatgtgaccgatcgggaaattcttcccgggtgcacacgagtgaggactgcatgaaaaagataagagtgaattacgctttgggccacattttattacctaagtttcactttggaccacccttaaacatatattttcactttggaccggataaatttgccattgttgcatttggaccaccacgaacgatttttttcagtacaattaacgatcttaaacacatcagctttagtatacggccaaactcctatatgtatggttcatatgtttgttgaaagggaagttagtcatgacgagaaaaattgtttacggtagtccaaactgcaacaatggtaaatttatccggtccaaattaaaaaaataggtttaagggtggtccaaattgaaacttgggtaataaaaggtggaccaaagtgtaatttactcaaaagataactataggcaagcatgtgaaaacacactgttctctttgatccacaatcaatatgcattcatataaataacgaaatctcgtagtcataagcatgttgcaaacattgacaataccgtttgatattctcttcttggtttggtcacgtaactgaaaaaaggtttgctcttgacagttatggatttcaaatgcaatatggattgattggttggttggtaggtgcaactctgggatatgcctcggagatctaagctttttaggtacaaaaaattcagaactttgataattccctgttgtgtgattccttatttattttcttgtaacattgataattgtgcatgtgccaatatctttagttttttcaaacgtgaaagaaagtatggtctgtttatttactgtcaggaaaaaaaacaattatttgtgaagtagaaagttaatttggactttttctgcagttgaagatagcatgcatataacgttaaggattaatttgattctaatttatttatcaggaagtttcttggaccttagttagtaactctcattatatacatatttgtgttattacatctatgccctacgggctgcagctattattggaggctggtgcattttcctaactgccatttacattgtcaaaactttcttttgtgcaaactctctcttttcaacatcgtcaacaggaagagccaggaggataattttttcgaggcagcgacataaatcagttcgttctttggtcacctggtaccgatggttcattttaaacactccatgacgcaacctgtctcctgttatgcgaaaaatggaatcacaatcagactacagtgcagcatgcccctcctgatgatttttatattcgatgataggcgagacatatttttttctgcatttttaattgcaagttgctaccacatgtttgttttatataatttctttatcacagataaaaaaagttttatgtggccaattacgagaatgctaattgagcgcctttggtgacaatattactacattgaatgcacaccaacgaattgtaaatcagatctgaagcactttttgccattttggatctaaacactagtagcaaaacttgacaatttggcatttagcatttgctagtccatagtagtaaattgtgccaaaaagtgctttgggaccactcactctctctttctctctctcactttagtgctagaatagcaaaagtttaggatgcatctaaacaccaactagtacttttacaatatcaaaactttgccaccaaaacttt

SEQ ID NO: 59094 - DNA, 994 bp, Oryza sativa
ccctttcacagtgacgattgaccctagcatcctcctatcaaatgaagacaccccttactcacgtagcgatcacaaggaaggaacaatagtgaggagaaagtacgtgcggacaaccgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtggtatttacatatgttaattacaatttttaacaatttaatatcatgcatatgctaattatatatgattattagaatttttaaaagttttaaatcatgcatgtgggatttacatatgttaattacaatttttaacaatttaatatcatgcatgtgctaattatatatgattattagaatttttaaaagttttaaatcatgcatgtgggatttacatatgttaattagaatttttaacaatttaatatcatgcatatgctaatgatatatgattattagaatttttaaaggttttaaatcatgcatgtgggatttacatatgttaattagaatttttaatgcattatttactattttagaaaacatatgcaacgaaattcaatatcagtgctattatctttagacccggttcttaaccctaaccgggtttaaaacagaatttggaaatagcgggaaaatatctttactcccggttggtgagaacaaccgggagtaaagatatctttactcccggttcgtaacaacaaccgggattaaaaatctaaagatatctttactcccggttcaaccgggagtaaagatccgggggtatatatattcccggtgcgcccttgtcttctccaccaacacttcgacgtttttccatcgagatcgagcatcggcttctccttcgccaccactgtctagggcaaccccgcgccgacgccgccgtcgtctctcaccgtcgcctgg

SEQ ID NO: 59095 - DNA, 2991 bp, Oryza sativa
ccgccgcacccgcatcccccgcgagccgcgcgcgtgcgccgcccaaaccctagcgccgcatcgcgtgctccctccgcacggtgaaccgtgccaccgacaagcgggtcccacccgggaccacgcaaggtggacccggcccaccggctccctctctcctctccgcccgcgcgcgcgctttgggccgccttcttgggccggccggaccatttagctcggccgagccgccccttcctctcgggccgcgccctagccgcccgaggaaagtctgatttccctccctccttcttttcttttctttttctttttcaaaaaggatttaaataaatcatttttcctttagaccaaaaatctaataatcttagaaattcaatatcttccaaccgtaaatccgtttgactccgttcaacttccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcgaggcaagccacccttgaacatcttgagcctatatttgaacttaattatgttgcttgaaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcgaaaatcgtgcactctgcacgagtatcgacggtcgccttcaaacttaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaaacctgcattaaacacttatttcccctggcttgctgagtactcccgtactcacccttgctctatataaatattccccccagttgctgatgaagatgaagcggatcctgctgataaggagttcttacaggagcaagccggttacgatgagttttagggtttcggcctagttcccaagtcgcgcctgtgtgtttggtccaagtctcggcttccgtttcccttttgtaatgcagttgtgagctagggatctgtccgcagcccaacatgactgtactcctactctataataaagagacctctgttactgtgatattctgtcttcctgtgataccagcactgtttcctgggactggtatcgattaacaggttaatttggagcgtcacgggctagttccggtcgggactagtccggggcgtgacaggcatattaccgaatatatgcatatggtactattggctggtttggtggaattccaattctgagccttttttatccacagctcatgttctctgtttttattaagacggatgttctctgtgattagaatatttggagaattatgatcaaacatggactatactatatcctgactagatgtgaattatatttgtataaatcaggatttgttatgtgaactagcacattgccaatgccaggtcaaacagtaagtttttttttcttcactaaatatgagcgcatggatctgaaatatattaattcatcggtcaacatggagcaaaaaaaaacaagcatagcacaactgatctaaaaacaatgtctgacgaattccagtccattaattgcagaaacaaatgtgcaaattctttagttgctataacaaagggaattccagtccattagtgccgcaagccagagcagcttgagtggccaaaatcgagctggtgaagcagtcttctctgttcatgatctgtgtcctctgttctggaactggtaagccgaaaatgtttgcgtccatcagtacgtttatgtgccatttgtttggcacaagatggtaccaatatatagtcacagcaggctgctgtcattagcagataaagagatcctgaatatttttattttacaaacacgcaaaatgattgcacgtcggtatattagaaaaaaaagtatttgtttacctaacacaatcagcccagtccaacttataccaagggaagggagaaaagacaaaacaagaaaaaaaaacaaggaaaaaagggaagaggcctgaaattttctttttaagaaaaaaatttggaacttttattcatgtagcattgtcaaaaaaaagggccatacagag

SEQ ID NO: 59096 - DNA, 3430 bp, Oryza sativa
gcctgcaggtcgactctagaggatccccagcgcatattaatttgtagcttcagttgctttggaatttggtaggaggtttctgcattttatatagagctcggatggtggggattaatttgtgatgccccttacgttcgagaggcccttttaaaattttctatttcctcgtttttcatgcgcccattaagactcatagtactaaatagtaagtgtgctttctcaaaataattataaaaaatattctgaaaaattatagtattaatttattttaaagttattttaactaataattaattaacctcagtccctggcagcttgggacatggtatgcaaacccaagaataaaggaggagttctgggagtcattgaccttgaataccaaaacattactcttctaatgaaacatcttgacaaattcttcaacaagcacgagctcctatgggtaaagcttatctggaccaaatattatctcaacgctgacctgccccctcatgcttgcaaagaaacagggtccttttgatggaaagatattttcagactaattcctatgttcagagcaatcacgacaataacaattcaaagtggagacacggctcttttctagaaagataactggaattggacaggcaactccttggaacaacaatttgccactcttttctcctttgttgcaaaagaagatatctcagtctttggttttctatcagaacaaaatttagaaaacctgctacacacacctttatctacccaagcaatgcaggaggggcaaacaatccagtccaatctcaattgggtttcccttaatagctcagaagacacttggacatacaaatggaacagtcccctttatcggacgaaagtggtttactccctgttctttgctcatatcacacctgatctgcctctctctctcattaggaagagcaagtgtaccctgaagctaaaggtgtttttaggctacttcttgtggatcgtctcaacacaaaggaacttctttacaggaaaaatctatttgtcagcactgggcccaactgtgttctatgccctctatcaatcattgaagatttcaaacatctcttcttcacttgcccctttgccatcaattgctagaactatcttggaatcaactggctcacaaaccaggacttcatgatcatgataatctctgcatgaagaagtttcggccacccctttttttatagaaaccattgttgtggatctttggaatatttggaaaagaagcaatgatttcatttacagcagctgtcagccttctttccacacttggaaatctctttttagagaagattttactctacttttgcatagagtaaaagctcaggaccgacccttctgactgttttcccgtaaaaaaaaagaaaaagagttaaaaccttgtgttagaacacaacctaaagttgtaatgttgtggcatctccgtaagtttataagcgaaagcccagcctatttaggcaccatggagttcaagttcgccgagatcgtcaatgcagtggaggcaaccatccaggttcgagtcaccgaaggatcaagggacttcagagcacggttcttcgttcgcacagcggagcatcgatgaagatttcgtgctacttaattgattctaaggacgagaagaatgtcatcgttgacgatgatgatgatggcctcatcttgtttcagcgatctgttgcagtggtggagaatagggggaattgaggctgttcatgatgaggttgaagaaggtggtggtgctactgctagctagtccggtgaccatggagtacccgttcaatcctaggacagctttgaggagcaagctagggtgggtttgaccttggtttttgcaagatggatatcacggttgctacttgattggtctatgcttccatagcttaatttaccatgcatgcagtgacgaaccctgaataaaaattaccgagggttcaatacatattaattatttaattattgattaatatattaattaatataatgtaatttagataggatttgaataatctatccagggtcctgtgactccgccgggtagtataacgtagacacgcccctgcgtgcatggctgatgctcgatgcaaagcgagttaggagtaacaggtcgaagtaattgatcgtgtgtgcttttgcatgtagtaacttaatgaaatgtatggacatcttgtgaccctaatgtgaatattaagtaatatgactttttgagttttggggcgtagtgattttgtgaactgtcgatgatggggcgtagtgtctattttgtttctcattttcccaatagttttgacgaccatgaaaaaaacttataaaaaaaactggataattagtttgttttaattatgcctacaactacaattacattatcataatcaaccgcagtataaaagtactcctaatcaattacaatatggcatgtaatctctatatttgctagattagcattcaaatcatgtgttgccttgtctacagataaacttcttctctccaacccattcctctatgggtctgtttggcccaactctaaacttcggcaaatagtttcagctccacctaaaatagaaacggagcagagtggagcgctctcacaaaataaattagggagatggagctgggctgggtttaaacagcttcacaactacactacagacttaactcctgaagctaaatttagaagttagagctagctttaccaaacagtccctatatatacccctcaagaatcaatagaaatccaccgaattcctccactgttttgaagaacctctctatatatatacccctcaagattcaataatacagcctcaggatttactcccggaagtgctaatgggcgatcgatcgcccgacgacaagggtagcgatcgatcccgcttccccctccctcccttcacctggtttccttttttggcaccgcattacttttctattttagtaaatttatgcacctaaagtttatacacctcaagtttacacatctaaagtttatacacctcaagtttacatatctaaagtttagagatcaaaagtttatatatccgattcaaatttgaatttgaattcaaatattttttttatatatagtatttctatacatctaaagtttatagacctgaagtttatagacccaaagtttataagtcaaaagtttacatacccgattcaaatttgaatttaaattatatcaggattcaaatttgaatttgaattcaaatattttctatatatagtatttttatgcatctaaagtttatacacttaaagtttatagacccaaagtttataagtcaaaagtttacatacccgattcaaatttgaatttgaattatatccattcaaatttgaatttgaattcaaatattttctatatatgggatttctatgcatctaaagtttatacacctaaagtttatagacccaa

SEQ ID NO: 59097 - DNA, 10036 bp, Oryza sativa
gagggcattgattgcgagctcggcacccgaaaatttatacatatactttcaatagtattacatctacgtgcaaagtcgcatcttcaaattcattctacatagagaataacaaaaaagataaaattctgacaaaattgcaaccttaaaactgttagattttttgtttttttgttacagctaaaatataatgaatttgacgttaagattttaacactaggtataatacaattgaaagtatgtgtatagttttttttagattttttagtgatattttttagttggtgtgcacgtgtgtacacgtgagggcctgtgtgtataggatatgttgccagggttaggagttgataggtaccgcttttatacgaagccatatgcaattgggctcttccgtcacacacgtaagatggacaagttatgaataagtccaccttggtcccccaactatgactcgaattctatttacatctttttaactatactagcaaatatgcccgtgcgttgcaacgggtgaaaaaacgtaatgataatatacgtttttcatgcataaccatgtcgataacaatcagaaaattagaacaacgaaactttattttctagcgcgttttcttttgtgcttttttctgacatttttccctcacgtgtttttttaaaccgtttttattttctcgtgacattttatagttagattagattagattagagataaagaagatatataaatggactaaaaaacgacgaatataaatttgacttttttcctccgcgcttttttccgtctttttaattttttttctcgtacatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccttttattggatcggacagatttttttttgcccggtttatttcacccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggaccgatttgtttttttttcgccccgtttttttatcggacttttatcttttttttcgcctggtttttttattttttttaccgtgtcacatataattcctttttctttatcggaaagttttttttcgcctttttttaccgcatcgatggagtcagattcttttcagctttttccttttcttttatcggacaaatttttttttcgcccatttttttttctcctgtttttttcggatcggactatttttttcttttttcgcccggtcgatttttttaccacgatacatataattcatttttctttggaataagaccgttttctttttatttttttaaactctttttaccgcgtcgatgtagtcggattcgtttcggtattttttccttttttttcctttttttttgtcggacatatttgttttttttccgcccggttttttttccccaggtttttttatcggacttttctttttttttcgctcggtttttttctcccgttttttgacggacgatagaagcacctagagaagtgttaagcacctagagaagtgtttttttttcttttctccaatccaatacagatcggatcttttttagggaaatcagattttttttctccagggaatcggactcttttttttcgctttttttattcattaaacggtttgtctctgggactttttttccctttttaagggatcgggtgttttttttgccagggacgggtgtttttttcgcccgttttttttttcactttttttttggatcggactttttttttcgtccggttttttgatcggacaaacttggttttttctgcccggttttttttcacccggttttttttacggacgatagaagcacctcttattttttaagtagtagtagactagcaaaatacctgtgcgtgactgaagttagatattaatgatttaccaaaatatcatagtatgattataaacatcggctatatgtagagtgataaacaaaccatgtttgtttttcacaattaatctaatttatatttgcgtgatgtggatgacgcttctgacgcatgggcctaacgattatagcaagggaggaacaaatgatgaacaattaaagtgattgtttttgcatagaaagtgattgatgaaaatttgagcgatctatagaaaaatcaatatttttaaagtacataatcctaatgaaaaatgaatggaattgaccaaaggacacatctgaatataagtcatgcggaaattatattttcttgtaatccatataatgtaattgtgagaatatactcgattttctatgcattgtacttgtgagagctgaattttgttttaggttaaatatagtgtgcaacagaaatctgtaaaatcatattagtgggagcgctaaaaatagcagaaagaaaagcggggcagacccacactcctggacgaaaagggaaagaaaagctaactgaactcctgtactgcaaaacttttttttgtgtattttggttttctttttgtattttggaataaaaaaatatgaattataaaataaataatattggaagagagtaatattctccaatagaggctatagtccacataaaaaataattaatattatttattttagtccaaatttaaattctatatcatgaaaaatatacaattacattttttgttgactccatttagatataaataatttaacatgaagaaataaaaactatatcaaatctcatcaatttttaatggctcaaaataatgcttatattaagtttgttaatggagaaatagtttaaatcaactcagaatagataaaactcaattaggcccataaggatgggccgaatgtcttccacaacttggcctgttaagtgcacataacccatgtggcccaagtcggcttaaatacgctgagagccgtcggattcaatcgaacggttaggatcgctcgatatatatatatatatatatatataacattccatgttgaaaccctaaccctaaactcattatcctccctctccaaccgcgagtggcgcggcggcggtggcgacgcgtccaaggcgaggcggcggctacctgccctaccacgagcagcgacgacgatggtggcggcgacggcagtggctacctcccaaccacgagctacggcagctacctccctaccgcgagcagcggcagcgacggcggcgtcctcccccgtcgtgagcggccaggatggtgccctcctccattgctagcggcggcggcggcgaccggcgatctcgcggcggaggcggggcggcggctacttgccctaccgcgagcaacggcggcgacggcagcgatagcgatggctacctccctaccgcgatccccatcttcctcagcggcggccggtgatctcgcgactgacgcggggcagcggctaccttcctcatcacgagcagcggtggcgatggcgacgccctcccccatcgtgtgcggccacggcggtgccctctcccaccgctagcgacggcgacgacggccttctccaccgcgagcggccgcggcggcgtcctccgatgggtagatccggtggcagcggtgtcctgcgggtcggcggagcggcctcgacgacggcgcgtctcgaggcgctggcgctcgcctctcctccccatcttccttcgccaccaccgcccatcctctcgtcggatgacgagcttgtcgccatcgtcaaaacgataaatcgaggttgctttgtgattaatttgcttgattccattgatttcaaactttctatcccgttgatcatcccagctgattttattgagttcgattctgagtctgttggtttaatttgtagatgattttgtatcaaactcttgttttttttttctttggccattgtactgacctaactgcgctaggtcggattgacggacccaaaaatactgtgatgattggaaaaatacaaatatttatattagttatagatatactattgcgcgttgtaacagatgaagacaacttttataattgataaaaactcccaccaatttaaacgataaatgtcaaaactagattttggctaatctaaagtgggtagcgaacaagcagaaaagtggatgggttatgatacaaggaaatttttacaggttcaggcattctcgataagaaataataccctactcatgtctggggaaatattccgccgattgtgttatcgatctgatgatcttatgtgtgattatgccccaagaggcatctaacccttctttagatagtctgaagagctagcattacaatgcaagactatcccttacggttcagagtcctgttaatgccaaaatttggtaagccccgaagtcatcatcggcccagagtcagtatcggcttcagagttatggaatcggccgatgggatttgtcaagtcgccagcagtcggattcttgatatatccagttaagaaaatttatctagaagagaccaagttcaaggaggatgcggcatgacagtttatctattaattaggaagagtctgttagtttccttctatctttagaaaagtgtgtttagtatccgataaaaactttatgttttctttttaactttaggaaagtttttcttgtccaagaaggactagtgtctacccatgggtactttaggaaagtttttcttgtccaagaaggactagtgtttacccatgggtataaatatgtacacccggagttattgtaaactatctctatagatcaataaaattcggcgcatctccaccctttttacttttctactttttcgacaagttcctgcttcaagttagggcattggctttgatctccgacgatgagtaaaacttgctatggttgtttacatcggcagagctagggctttgacactttgatcttgtcaatgtatgcacctatttatcatatatcttagtttatctagtttagcatcttaatttgatcatatcggatgagattcgttttagggtttatgctggtatcggctaaattatcttgctagattagattaaataaggtatccaccaccctaaaaaccagttaaaggcttgattgtctacataatatgtttcttttcatactttgcactgcatcagccttagtcgtgcttagaaccataatctctagcatgctttttgattttcaataagggtttcatcggggtttcagccgatgagttatctggacgttgcatcggcttataaggattatatacaagatggatttagccgattgtgacaaagatttcattgtttatctaatcgtttggatttcatgacatcggtcctccagccgatgtatgctttaaccttcggatcattgtttattctatcatattattattagttgattgatttctactggattatattgttatttatcatcatcagtcgattgtctttatatcattatctatattggatatataaccgatagctcaaaacactattgatatcggttggcatcagcatggactgaactactccatcggctccttgctgctcctcgttgacctcctccccggcctcctgaacttgttctctaagttcctcttcctcctccttaacctcttcctcctcaatctcctcttcttcctcctccacaacctcttcctcctcaatatcctcctcttcctcaacttcttcctcctcctcctcctcctcttcctcctcctcgtcgctgtgaagctgctcgtcaagtgataaacaagcaaacttttctgacatgactatgtcttgtgcatcaagtagtgatttagttgtgttccctctgaaggaaatggaaggaaataggggatgactgggtgcggctgcacaactccggtggcgatggtggtagctcggttctaagtacgacattgtgttttgtttcaaagttttctagatctgtttttgtttaggtgataactttgattgatgttgtttgtttcgtggttggagctgatggtgattctaaaatccaaagcaggagctaccaaaatgctcaggtaactttctcttcaacaatccaatgctggcaagcgttgtggttcttgcttagcaattccccataattaaactcatctcactacctttagtttttttccttttaaattctgtggagaaaggtttagtctgcatcaccccatcctccagtacgaccgctgccaccatgcccgaagcgctcttccgcacagtacgacgaacacggggtgctcagcgaaatgtcccgtccgtctcctcacctgcaatgcatcatgaaggtgtgtatctgccgactatcgttgtttcgtcgaactattatgaatgatctttaggtgataaaatattgattgaattgtctactgctatcgctcagaatccatactccagcaatcttacatatatacatatttgttgcgtcaatcctaagcatgcttttcatatatccctgaacaattcagcctcacaactgctcttcatgtatctcattcagaattttttttctcaaattagttggactgatagcaaaatattgcttttcaagattgtaaaataaccaactagcatggacgttcataaatttttcccttctgtttggtgttattttatcagacatatataatgaaggcgtatatagcaaagggaggagctgttgagggaaaggacaatagctcaattttttttttttttgcggggaagacaatagctcaattgactgggaagttgatgtcaaatgtcgggagcaatctgctaaaatgttaaagaggtgcatgagtgaactggaaatatctatcttgtttttgattagtagtttctttggtttcaaagtaactcttgacatgagaattttattagcagaggaatgggacacattcttggaaaaatatatttcaccattgaaagggtcaattaggcctagagggggggtgaataggctaatttaacaaactaaacaaatgcggaagcaggaattttcgaaactttcgaaaataggcagaacagttgaacaatgcagtaaaagtctagatctagagggctaccacaagtaaatcaaggaacatacaacaactagacctatagcggctcaagcaaataaatctagaggatgggaaggaggaatatcacccaaaatgaagctcacgaagtttttaccggagttcaaatccttgagggattctactctccgttgaggagctcaaaaagagccgggtcttagctaactctttcctcaagaggttgcacaaagcactcctctttccactaaggggtatctctttccttgcggaggcgagatccggccttcacaaacttcccacggccaaccacaagtagatcggtggctcgggagtgacacctagctgtctaggagtcctcaatctccaagagtaaaagatgatgcgaagaactcttggagatgatgcaagtgctcacaaatcttcacgaaaaccacaagaagcattcacacaaactcgaatccacactcacacacacgccaaatccgaatcaaacccgggtggagagaggaatcgagaaagcaaggctcaaatgagtagagagagaagcaagccaagggctcaaataattgcaatgtcaccagcaacacttacaagaggggggatgggggctatttatagccacagcctcatatctgcccgttggtgcataataattgcgattttcagaacttctgaaaatcattttcggaacttccaaaaatttccagatctgaaaactcgaagtcaacgcacctttttggaacttccgaaaaatattttcagatatttccgaaaaatatccagaacccaaaacaaccttttgcaaattttcggaactttcgaaaattattttcggaaacttccaaaaatatccagaagtgaaattttagttatgtgaatttttggaacttccgaaaatccttttcgaaatttccgaaaatttccagaacacacggccaaggagaaaatgcttccaaaaattgattgtgagcacacacatcactccttatatgtctatgtctatgcatcatcccccttaatagtacgacattcctaagacgtaaagaaagtaagatatacaatataccatttgctcatgccataaattcatcgtgatgtcacattcaaaggggtatgcatcgcattacaacacatcgaggacgtaacatccttcacatttgctttcatgaaaattgttagtcatctctaatcgtattgtaatcaatcatcaaaacaattaggggcctagatgcactttcaatctccccctttttagtaattggtgacaatacaattagatcacaagagagaatgaatataatagattgatttggtgcaaaggtttagtgaaagctccccctaaaagtgtgcattaaggcaagtggagagctccccctaaatctttgcatccacattgaagctcaaaaagatatgaatcaattcatagtacattcatcacatttcatatctcattcatgacaagcacaattataaagggaataagaacattgcaagatcataatataaagcatataagtcattacatcccaatcatccataataaagcattaaagtctcacaatagtaatagctattacacaaatgacttaaaatcacacatagtctcatacactgaaacaccaacaatgttcgaccacaagctaaaatgaaaaagagatagatattctccccctttggcatcgaagcaccaaaaagagaggatgaagcgaagatggctcacacgaacggggcctgaggtggatcctcgggaggtggaggaggagggtagccatggccaaacccaccaaagaagtcgtactccggaggaagatcaacaaagggatcctcgatgtcatcctcaggcccatcgggctcagcctcatagcctggtggggacggtggagcacccaactgaaaccgagagtagaggtgcgcctgtgtttgctttgctcgccgggatgctttcttgattttgtttcgcgccctgcgattctgtttggcctctgcagagcaaagaccgaacaaacttcgcaagatgcgaaacaaagccgaaggctagcgatgagccccaggagagggttgcgcacgctcaggaggaggctgagtggaggaagacgggatgtcccgagtaggcggccaagaggatgaggtgggtatgtcaggagccgcagagcaagccttgggcactcgcagagtgagataggaatgggactcctcacaaataaactgggtttgagtgacatgctcgatcatccgcatcaggtgaggggcaaaaggaagcgccctcctgtactgaatcgaggccatgcggatctcctccaacacaaagttgtaagcatgaaagggattgccagtaggattaaacccgaggagcacattacgagagtgatggttgatgttgctagcattaccatctttgggagtgagggtccttctcaggatacggttgaggtagacatggaaaggcttgaaaccctcagttgtgcccaacttgccgccatcaagatacaggggatgccgctcatgatgcataggaatggaatagtcatggaggttagcaaagtacctcatccagttttcatcaaaaccccaaagagtggcaagagcctcataggtaatggagtaccactccccttgagtcatccaatgtatgccccgccggctgtcaaagaaaacggtggcataaaattgggcaataacctccttgcaccaaggttgatggagggtcataaaattgtggacacacatctcctcacacatggcaatcatagagttgagggtggggtcatcatgtgcctacaagtcctcccaattgatccattgcataggaacaatgggatcggttatgggaaagataacggtttcatagaaatcttgctgaaaaga

SEQ ID NO: 59098 - DNA, 2668 bp, Oryza sativa
ccccctagccacctcagcatcgccccgccacgtcggcggtgggacggcgccaaagaggctggcgccatcctgttgaacgatggcgccagccactctggcgccccaaaaaggactatttttaggataagtttttctagagatctacttgcgaaataagtttttcaaaaggaccaaaatgtgaaaaatccaggagatcgaattgcatatgagaggcagagagggttagttaattaattgattagcaatagatcagctcagcatgaaagagaaaaggaagggaaaaataagttctgaatatacctcccatttgatcaaatagctatgataactcgagctctgatctgcttgatcagtatctggagatggaattatgaatggcgcctcgatgctcgcgctcgctagctcgtgatcgtagctaggaaagaatgtccccccttatatactgcaagatggcgtgacttcttcctcttgtcaatgagacacttcaatcggttaaccagtaatcacgagatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacagtccggaaagtttccgaattcccgacgtgtttttggaaacgggaagtgtcggtcagaattttttcgaaaaatttggaaacggaaacgaattccgaattccgaattttttttctcggaaacggaaacaaacatgataaggctgctattcgttggaaaccgtaatccgacggaaattttcaagaaatgaattcaaaaacagaaatgaattcgttggaaaccgtaatccggctgtgggagaacttcacggcgctgcaggaggaccccgcgctctcgccttgctacgccgaccagctgcgcctcgtgtacgaccccgtcgccggcgactaccgcaacgtgcccggcgtcgacacccgcgtcgtctccttcggctccacccgcggcttccgctccgacgatcctgctcgaaagtaagcgatatcatgtcgaatttatcgtactccactccacaaggagatgaacatgcaatgcatatagggacgtgtgcatggagaggctcgtggaggcgctggaagaggagggatacgcggagggagagaacctgttcggcgcgccgtacgacttcaggtacgcgccggccgctcccggcttgccgtccggggtgttctccgacttcacgtcgaggttaaggcgcctcgtggagcgcgcgagcgagaggaacggaggcaagccggtcatcctcgtgacgcacagcctcggcggcctcttcgccatggtgttcctcgaccggaccccgctgccgtggagaaggaggtacatcaagcacttcgtcatgctctgcctcggcgtcggcggctcgccgctgaacatgtggcccctcgccgcctcctccatcccgtcgtcgtcgtcgttggtgggcagcgtgctgacgtacgggaacaggagcttcgcgagcatgttctccctcctgccgtcgccggcggtgtacggcgacacgccactggtgatcacgcgagccaagaactactccgccgacgacatgccggagtttctctcggcggctggtttctccgacgacgaggtggcgctctaccgggcgagggcgctgccggtgaccctggatttccgggcgccgctcgtgccgctgacgtccatcaacggcgtcggtgtgccgacggtagataagctggtgttctgggacggcaacttcagcgcgaagcctcaggtggtgaacggcgacggcgatgggcagatcaacttggacaccgtgttggcattagaaaggttgatcggtgatgacccggatcagggttacttcaagtcaattttgatccccaacacgacgcacaagggtgtcatctccgatgaattagcgctcaagcgtgtggtcagcgaaattcttggagcaaattcaattaactaaggggaaactgttttaatccctcgaggggatatcccctcgttctttgcatgtcacttaaatggttataaaaaaatttgaaaaaaattaggaatgtgtattaacatgtgatataacactccacaaacatgcaagttcaaattcaacttctacatctcgtaacgaaaaaacaaatt

SEQ ID NO: 59099 - DNA, 21650 bp, Oryza sativa
  unsure (1)..(21650): unsure at all n locations
tctctatttttgaaacggaggaaataattgatataggagaaggtgaagaagcagatcctcggacacctcactcccctttccaaccggcaaaccctacttttccggcggcggcggcggtgatggagtccggccagtctggtgacggggctagccacggccacacgagtacggtggtggagactgccaaggaggaagcgctcgccggcggctacgatgaggaggaggaggactgcacaccgctacctaatgggctcatatgctcgcggcagaattgggaaacgatgtacggcaaattcggtgccttcgaggacgagagtaagtggatttctctgatatatatatatatatatatatatatgtatgtatatatatgtgtatatatatatatgtatgtatgtatatattctctctttggctctttggattcgctagcctgattcaaaatcaatctaatttcttctatcttcattgtgcaccgccctctcatttgtgatttttgacacaatcatttgacagaaataatgaacggacttagcaatcttgtatgttgtagatgcactgcacgcacatatattaatcttatagatgaacacttttcaatgtattgggatgcccaaccacacaaacctagttggggcagtcatattttgcaatttgcatttctttcctgggtcttgggtttgaaggcttgaagggtggccatggacagttataagaacagagtgaattttgggaaccaggagccattggaaggaagcagattgtaaaaaaaaaaaagaagttaactcatatgtatattttcttactcacatttgtcatttggttgtcaatttctgctccagtccaataatcactcgatgaatttgtgtgtccagcggatgcttctccaatgaggaacacggataggccagtgccaccatattatctgccaattagcatgatgcaattcttctcagtgaaggtgatcgagatcatgggaggtctccaatggccactccacgtctatggtatcgttgctacgcgtgactcacaagataacaagaggaacttcttgtttcgttgtgatagagagcactgccagacccttgcctcaccacaggtatgtgcattgtgtagcccttcattatttctggtccatttcattttgttttagttttatttgtcgtcagtcatgaatcaagtgggtgcattatcattggtagttaaccaatttactgctaccaaaagctaaatagagggaacccatgttttccaaagctttcttactgttcctgttatgaaattttggggatgatctcatccttaacctagcacttagcagcaatgagttacagccatgagttattcttttttggaaagagatgcaatcattacttcagtccacattaacaactacagtttttactacccatcttgctgcatggtgacatgtttcttacaaaccgttggattgaagtcatgcgcagtatctttgcaggtgacacagcctatcaaagattatgaaacatgttgatctgattgcccctctttctgtcgcccatgcgtgcaggattcatgtttgagacttacacgtcctagtcgagctattgtaatagtgaaccctgtagttgttgaggttgacttgaaagtgaagggcagcagaggacccccatctgaagacaaggttttaagcgagcatgcttttgttcacaaccacactggtcataggattaaacctggctttcctcatagacagctggaatcaacagaggacagcacgatggagtttgtgtttgcacatctgcagagtgcagtggaggccaccatcacggttggagtcgttgaaggatcgcctgatttcagggctcgttttactgctcgaactgctgggattgatgaggatgtgttgcttcttgactttcaggatggtaagggcctctttagttcgcgaactgaaattttttgcgtgtcacatcggatatacggacacacatttgaattatttaacgtagactaataacaaaaacaaattacagatttcgcctggaaactgcgagacgaatttattaagcctaattaatccgtcattagcaaatgtttactgtagcaccacattgtcaaatcatggcgcaattaggcttaaaagattcgtctcgcaatttacacgcaatctgtgtaattattttttttctatatttaatactccatgtatatgtccaaatattcgatgtaactgggtgaaaattctttgtttgggaactaaacagggcctaaggtggtggtcgatgatgatgggttcgtcgtgctccggcgacgtgttgtttctgttgaagggacagggaagctgattctccggatggaggctacagatcacggtggcgatgacacggctgttgttaaggaagaaatcttctgtgctagaaagacatcaaggagccaaagttacttcatgcttgggttttgtaagctgtcgatcatcatcgcctggtcgttacttccatagatgtagcgccagtttaagtccttgcgtaattgtgtgtattgtgtactagtagtactgctttgactaagccagattggtgtgactctgggttcttactaaagagcatctccaaaagagcaaatcaggtgaagaaaaagataggagtcgatattcatctgatactatcttggtaaagaaaaagataggaataggagactatgcattcattataggcaattaaatgctaagaacaaatactcattcttattataaaaagacctgctagataaactccatagtaatgccttttggtctcacaaagccccagcaacatctcatgttctcatgaataaggtgttggctcctatcttgagaaaagatatgctagtatcttttgatgacattctaagaccatagaagaacatgtgatacatgcattttggacattttaaggtctaactagggtttttttttttgcataatcaagtaaatgtgtgttcagtcaacagcaagtagaataccggggctacattattagctattaatcgaagctgtataactttgaccagaactcactaatgtcactcagttgagaggctttctggtttagttggctattatagaagatttatcaaagttatggagtgatctaattgcatatctaccatcgcaaaagattggattcgcgaatgcgagcatcaggtggcggcggtggcgattcctgtactaggcaacaaaacgagcggcaagcgtaggcggcagttcctcttgggggcagacagaaggcaaccagagggaaagtttgctacatggaactcctctatttgttgctgacaatttgattcgtatgattgtatcatccggctggatcgatttttttctgtcatccctcctgagattgattcctctttcgccggaatcaatttccgttgattcatgccatgtaatttgcattcatcactgctaattgggacgatgacaaaggagattaatcttggatgattttgctattttttttaattgctggtgcccatgacgtgcagttgttgccgtccaccgatcgttgccgtcgagcatcttcggcgcatgaaggaggaagaagaggagccagggtattcttgcgaagtcgttttggttgagtgtggtattttctgaagcatacttaagttatggtaccgtagcgaatctttctttttcgatggtagaaatataattttttgattgtgagaaaacagaagcaatgtctgaacgtagtttcacagttagccgtgctcctcccaacaagctatttcagatttcttgtttcctgacagcattccgaaatgagaaggggaatcatttcaacatttgttcttgttttgcagaaacagaggtgcagagtgggaggtgctgcaataatataatgcacaccccaaattaaggagaaactaaatcacgatcacacacgtcaatggtccaaccttttcactatcaacaagagtccacatttcaccattcattatcatcacagtgctttcgctcaaaaaattaacacggtccaaaataagcatccgcagtgcacggtacagaagtacaaactgggtttagatcctatttaagagagtttctagctgctgcagcttctttcacagtcataaatttctctaaacagttcggtttttagttcagattctaaaaagctaaacaagtgacaatcacctctagcttaccttaattagttcggacttaatttagagcacatgataatgcccacacattcactaatattactaattaagaattcatttgctatttttattacgagtaaattgcattaacggtacataaacttgtcaggtgcgtgtaatttagtgtatgaatttgtaaaatgcttattttggtgcatgaacttgtttggtacgtgcaaactaagactaaaatggcacgataagattgatttttctatgttgaccattataaattacaaattagtagatgactaacgtgtacgtagtagaaatgttatatttgtaaacttagataccattttatctttctttatttctatcccttgcattattactcggtttttttatgcaatcattatgtcttattatatatttatccttcttagactaatgtttacacagagtttaaatcaacaacagaatcagcaaaattaaccttatagtgcgatgttgaccttgttcgcacgcaccaagttcatgcaccaaaacgagcgttttacaagttcatgtactagattacacccacctgacaaattcatgtaccgccgatgcaatttactcattaccataggaagttagtgtaacacatctatggaagggaagcaccgaccatgaagtgacctccaattatcaaggtgaggcatagccctgatgatgctcacctgcttgggtgcaatgcaagttgcgcgcgcagaggctacctcaacccaggttcacaatcccgatactagatcaaaatccgctcacgaccagtatcattggatccattgataaactaacaaaaaatcgatgaagtacggatagaatttgtcaaaaaataaagaataaaataaaattcggttgttgatttggacattttgatttgtgtacatatctcaaaaacttttcatcatcacattacatatctcaaattattatatatggacacatcacaaattgtgtacgtacatttaggtcgtatctcaaatttttctaatacacgttcaaatcatgtacgcattcttgagatattccaaattttatacacattcggaaactactactccttttttttcacattttctttatatgtagtttttctttagcccatcaaagacacatgctacaacagtcaggggtatatatcatttttttttaaaaaaaaacatacatgtctattgttcagaaagcaaaaggtgagagaaatttaaatagaagagaatactacctgttcttttttctcataaagataaagattttaccttggtttccatttggtttccattagcacgcttttccaactacaaaacatcgttttgtatgaaaactttctatataaaagttgttttaaaataacaacataacactttttcaaatttgtaataattaaaacttaattaatcatgtgataataactttctcgttttgcatgcctgcttttaatctttatctttagaagattagacgatcagtcccattcgtttcctctataaaaactggatacaaatttgatacttttggtacgcttttcaaactgctaaacggtacattttgtgtaaaaactttgtgtaaaaactttctatatgaaagttattctaaaatatcaaattaatctattttttaagtttgtaataattaaaactcaattaatcacacgttattatcacctcattttacgtgaaacaatctccatctggatgttggagatttaaacaccaccgatgttggagatggatgcggggtcggtacagcatagcagaggacgatctgcactgcacgaggaagcatagcaaccaagtgaagaaatcaaacttccacacataaacttaggaaaattgagatgcatattaatatgggcatgaagatgagatgggatcaaaggaacagatcaacagaaaccgaatgcgaggcttgatagagcttataagggccagaccaatgtgaagcctgagaaaatctgggttaatttggcccgtgcaaacccattttacaagtatagccgaagacatgcaaacacacgatcagaagtttgctcctctaatacactaagtattttcctctttcatcatagggtataacagtacagtatattcgaccacaaaattttgcaaatttcaaccatggatacccggaagagaagacggccaagataaagctatactcctaacaacgcgctgttacatgtcacgcaagataacgctgcactcctaggaacttgggaagttaagtttgtgccctatcagaattctgaagactgccaatgctccagcaaaatgttgatgtggcagaagattctcaggtgttgcgctatactttttgccgtttcgactgcgactgcttcatccactcgatgcactcctccgtggttccccttggataagcaagctgccacttcaacagtcgttgttgctaccagaacgaaggaaaaatgtgttaaaatgtgttcaggaactagaacaattcagacatagtcgattagtgtcaggtatacccattttccgataagtggacctcccttgacctgcataatccccataatggccttcccatcaagcaacggtttcatcttccatacgccatcaagctctggagaagaggtagtaagatataaatcagaaaatcttaacaaggatatgaataagttggttttcacattgaggtgttcagacagtaatacaacatcatgtagaaagtcataaggaagtcggcagtcatcagttgattctttacccagttcagttattaaacgttcagctcttgtgtatttttctttcctttgatgtaattcgtctggctggccgagagaatcaccaccactgctaacctccgggtaggtaagagtgcagataaacagtgccacacgccaaaagtcctttatctcccgaagtataagccctgtaactctcgaagtcacaatttttagattactaggcaaattaaattcccaaattaagcaactggcacacaaaaatagacagtaaatactaaccaatataaattattttcaaattttaaaatcaaactctctgctgacctgccaaaacacgtttaactgagtctgttgggatctcaaggtattcatcatccaatttctctttcacagttgtcagattttcattcgactcaaggagattaattaattcagcaaacttttcacttgcagcatgtacgttgacaaccttcaagtgcagaacagattataagttgatttattttctcaccgtacaaagtaacgggaataatattcgaggaaaaaaatagcagtaataagctaaaaaggacgatgaggcctgctcaggaaattgtaccgtgtcagcatcactagcttttaacttcagagagtcacgaataatatagttagtgacaggaatctgtagatgatgcaacaatcttgtcaggatacttgctacaaaacaatacaatacaaaagaaagtggtgattaaatagttgtttggttagtaaaatggttcactgctaataattgttgtaggctctgttctgatcttctagcccattttttacattaagttgaatatagctgtggcagttaaaacaagcaccagctatttcctcacacaaagatattgtttaatagccacggttcgtcagcaaccaacctcaaaagaatttcaagcacagtaaagctaattaacagaaaactcagggatatgtggcatttgaaataagatctgattatctagatgctacaaaccagttaaatctacaatttgccaactggttttactggagaacataaattaacagtcataggtaaccaatgctggcattgtacaattgtacagaaattaatctaagaactactctacatattcagctcagtccgtagaaacaaaactatggctacatatgtatctaaatggtcacaatatactctcttcactctttgacagccacacaaacaacctgacatcttatcaaaacttaggatggacttccaggcaaatctaagcactacctcataatattcagcatctatacttctatactcctttaaaaagactccaatggtggtggcagtgaatctgccattccacctactcccattgaacttttacatattaccctttgaacttcttgatattatataacagctaaatctaaatggataaccacatataaattaaagtaaggccagtcttccctataaaaaaaggaaggtacgaaatttcatgaacaatatacttttatttattttataaaatattataaaatgttttcgattgtagcaaagcacaggcatttagctaatacctaaaaaaaatcttaaccatgatgcacaaaaactgctctcaagaaattctagtacttcacactgcaaaatacaagtgcacccacaagtaaactaaaagttgaaaaaaaattttgctagtacaaaaatgaacgaacttgatgaacttactgttcagtctgtacaaaaaaatatggccatgatgcatctagcctgcactctcctacaggggcagacaacccaggtcccaggccacctgggccatggcctgggtggcctaagtctaaagcccatggaagcctatgtaatttcaccatgtattcactgtgggggccaatatacaccatgggttgcccgaggcctggagaaatgctgggttcgccccatctctcctgctaacctagtaggaagcaagtctagctataacatccttgtagaaaagggagatgatttgtttaaccaaagtagattaagctgacataatttacctgcttaaaaagttaaaagcatttacataggagaaaagtgtggaggatgcatgagtaagaatttagacattaccttcttcgactttttatccaaatatattgtattccgaacaggagtgaatagtgcactataaaagcaaagccttcggtgctcatcctaaacacaatcacagatcttaatgttaggaaagcaaagatacaccaatgtatagcaaattgtttaattcggtttagccataacatggaaagtgtaacataggaaccaatcacagaaataagatgggactatagtgaaaagtttagtgtcataggtcctctgaataataataactattattttttactccaaaacttaatggttcaatcaggtgtacaaatttctgtaagttctctacgtcatttattccaccaaagattaagggtgactatggtttgttaattatttgcagtgaagttattgaagtaccattttgaccataaagcaatttttgtgtgtgtgtgtgtgtgtgtgtgtgagagagagagagagagagagagagagaggttgtttgacttaatggtgtgtgcttaacaaagaaaaggacacattctgaagtttctcacacctgtgacttggaatcagaaccaccactgaacacagagcagccaatagaatgagcaagattccatgcaacttcaatatgtgaaacacaaagcctgcatacaaatataagattaggagataaaactgtcaagtgaagcacacatgctaatggaaataactagaagaagctctacaggtacagatgtctgaaatgtaattgtgtggccctttagtagaatgaattcaaaacatatagtagatatatgttatagcaagaacacaccggtcacatttgtcaggaactggagggtcgggcttctcaggaaaagcaaagacaacataaaataaccccaaatcacgaatataacacattgcattaacaggatgtttgtctgacatcataagatctacctgcacgaaatacaagcagattaaattggtgataatgggcgttctattatgttactcaatacatattgaatgatgatgtctggttagttttacgttcatgaagaaagaaaagaggaattgtaggttggctataagtaggaccaaaaccaaacctcatgaccgatgcgctctttgctaatcttgctaccaagttcagacttcaccttttcatcagaagcagcatctttcaaatcttcagttaatgtaaagttgaatctagcagctgtgagagatatgcattagtatatgcaaaagaaatgcaatgttccatgcacgctattcaatgataaatctataaacaaggtatccagttcaattatcagtagacaattacatgtctactgatatcatgcctataattatcaagctcttatatgcaaagaaaattcaaatatcatgattcgtgcacatgataacataagcatataaagtgaatctaaactggctattgatgaacattcagcaaagagtatctaacttgaaacagaaaagcaattctggagttttcagcggccaatttgcccagtacgaatgcaattaaatatgagatgttatttacttttaggaaaataaacttgtcatgaataaatctgtaatctgaaagtatatttgtgatgataatgatgataacaccatcaagtcctaaaaagccaacaacaatggtatagcttagcataaaattagcaatggaaatattgtatatcaattaaaaggatgttttaccaaatcggattgctcgaagaactctaagggggtcatccaagaaggtagctttggcaggtaaaggagtaacaataagaccctttttcagatcttcaataccttcatggaatatgaaatcaacatgattacaaacagcatgaacatttgaaaaaggttatgtatatctaaaagcttctatgttaggatccaacaaccaagctcacctcttccggttaaatcttccactgtgttagtgttgatattgaagaataaactgtccaagtttgaatatagaaagagtttactagacaactcaacattgtagcaataaaagcattactttaaatgcagagcagaactgatctgaaaacaaatacctatttattgttaggtccctacggaatgcatcttctttggctgtaccaatctcctgcgtattgaaaaaaatgtcatagctaagagggagatcagagttaaaaacatgaataacagaataagcaagaaagaattatagattgctcccaaaaatgctaatggttatttaggacatctgagtcaacaaatgtaccattccctagtactatacccatataaagccacaccaaaaagacacatgtcaatgcaaatttaactaaaaactcagatagtcagtacatgcaaatatataatggaaatatgaacataacagcatatacacaattctggaaaaaaaaacaatgcttgatatgtgtgcataccacggtaggaatccgactgttttcagcatatttttcagacctcaagttgacaaagtcaatccaaatgtcgaatataagcatccttgcagtttccaagtgctttgattgatcaggattgctgaaagaaattacgaaacatcacgatcccatgacagcatgcatctggcattatacaaatgccaatatgacaaagcatgataaacttaaggtacagaaagtattcataattttcttgcactaaaggtcatgatactctatgagaaggttatttgtttcacaaattcaactgagaatattttgtaggactaactcaaaccaacatgaaacttataatggcaaaaaggtcgtggaatttatttgataaactgtgtgctgatgtgctctgtgatctcagtgaattaattgctgctgctgagcttgaccaaataagtgataaaaacaaactgagataacagtaataggatatactcgctgggaataaaattataaagattgcataccactgaataacgccaattcctttctgttcctcacccaataattctgaatactcatttactttctcgcagaaattctggcccgtcatattatcaagtgcaatatcaatgtcagtggagtctttccccaatagctgacgattatatgaaaagagaaaggttgagtcagcaaaactactcaacaatatattcttattagagatgagctgcaaatgacaacagtagtgcaaatccttgtttttcaaagcagggatctacctgcatctcctttgactgtttgtcatacaatgcagtatccaatatccatcatgcaaaccttgaatgtgtaatacaacattcacatagcacacatccaataagacccaaattatgcatatcaacaaggaaatattcacttctctgctcttaaaggaagatgcctgtaaattacactatgccatgtgcaggtgcactatttgcatctaaaatttccaactaaatgcagtggaagcacatgtctcccgcttacagactagaagaagccaagaccaacaaaacaagttgattgagccattccctgagcccatcagcctgacaatccccacaattcacaggcagtcacctaatttctcctgtcaggaaccctaaacatagccatacaaggaactctccacaggaaacactaatttgaaactataacagccaaaaatccactgatttttttttataaaaaaaatgtcaatgacatagcaaaacaatgtcttcaaaatgcccaggaaaaaacccctaaaacttacatgacaaagcacacattccagtacctaaacaaactagtatcgagctcttcaaagttaaaattcgaagggccacaaaccccaaaagccctaaaccaagtttcccaagattttttttctccaaaatggtttgatacaatcactacttctcgtactgttctccatgtactctactgacaatgcggaaaaggagatgtgtccaccttttctcaaaaaaaaaaagggaaggggggggaactcaccttgtccctgacccagccgccggcgacgcggagctgggtgccgaggccgaagtggcggacgacatcgagcaggcgacggaagatccgctcctccttctccgtcagctccacgccctccctcacctccaccacgcaccgctgctgctgctgctgcggcgtcggcggagacaccgccgccatgcccgagaagccggaggaagcgcaggctcgggcgggtaagccggaggaaccgaaggctctagatgggatcgctgagacgagcggcggaggccaaccgcgaagaaggcggcggcggcgaagaaggagaggggagcagttcggcggcggaggacagggaggaggaggagcccgcggaggcgaagagacatgggcggcgagcgatttgcggttgccagccgccgcctgttcggctctgcttcttgtgggccgtctgtgtttgggcccttttgtgtgggccggtcgttttctggtggctggttcgttgggccgtgattccagtgggcctactgcttgcgagctgtgcttatacgctttagggcatgttcggtaaatctccaactcgcttcaggagcttggactggagtagagtagcaacctaactccgctcgtgtttcatgtggaactgaaattttttggctgggctaattggagttgtaccaaatagacccaaactattccataactccactctatacctaactcctgtagttaaatttaggagttaaactctaccaaacaggccctaaccacctgagcccttattcgttttgtttaattgtttttgcagaagacggtagtacaggggttcgcatcctctgccattaggaggtaaatggcagaggggaacagtaaaacgtgagtagcgctacagtgttttgccattgctacagtaccgaacagtaaaaatcactgttcggttattttattggaattactgtatcgattgatctcgtacgtccacgcttgatccgacggatgtaagtggctaatggcatggatcactgtagccctatgccattccagttggaatggcagatgatacgaacccgtagtacaggctgaggtagcctatgaaacatgacaggaaagcttctggcgccaaaacggtatagcccatttctctgaatttctgaaccacgaaatgctgtacctgcctgtcgaacaatttctgaatattgtttttttaggaatacgcaaggagcgcattttttttcattaagagaaataaaagttatttacaatgaaaaatgaaaaacaagcacgggactgatactggagactagcgatctaacgggatatctcgcgctagatttggctaccacgacctcgcagagataatatggaagggacccctgcatttgccgacttccaaagtacggcttcttccaccattactttcgctacttcgatccaagacttggactgctgattgaagatccgtttatttcgctccttccaaatcgaccaggccaccagcgttgcaatggtgtcaaagccccggcgatgttgctctctcaatttcatccggcttccacagagccagaggtgaaaggatggttcgttgatgggtagacaatctgaatattgttttggtgttgatcagtcactgcaagttaggcacaggcaagaatgccaaaccttcatcatccttaacaattgtggttcgcaagcccggtgacgacggcccaggagcaggcagcgcttcatcagtggcagaactaccttattatactagtcagaaccccacgcgttgccgcggggagcttaagcaaaacaaaatatttaacatatgaacaaacataaagatttctgatgggaaaatttttctatacagaacacctataatttacatagacaaaagtgtattcgagaaatattccatcctataaacctagaagataaatacctaagtagaaaaaacatggaggtgacatgattttaattggaagtacaaacatgacaaagtatgacaaatacaggtgattggctgcaagtctatgatgaacaatggactatctatgctcaattggctgttaacctaggtagcttgattccatctatgattttattaccagtattgactctcttactatgtgacgttgagttaaaagacagatcagatttcttgcaaactcatcatcactgacatcaatttgtagccagcacactctgaataatcgacaaatataagaattaatcttaatgatttgtttttgatatggtgtataatacaaataaagagcatcttcacatgattcttcgtgaactaaagcatcagatgaatttagaataagaaatgtcatatatgaagggcaatatgtacttttatgaatgataatttcatccttgaatagagcaatagatcatttacaaacaaatagaatgtcaacatgtatatgagatgctctttttttttcatctgtggatcattgtggaaatggaaaccatgatattaaaggtaatattcatggcaaggatattgcttgtaagatttgactgtgtttaagaaggaatttaccttcggaagtaaagatggaataacacgtgcagagccgtaggatattgtatgatttgaatgtaaagtctgattaacttgtcagtaattttgcatagctggcatcacaaccatcaagctgcaacatttgtatcaagacataacttaacagttagcacatttgaatgttgcgatccaaaaagaaaaataatgcaaaagcttttgtatgagataaatatgagtaaatccaatgtataaattgcaacagagcatctcctatgtatgatttatgagcctttttaccattcaacatttggtatctcgaggtacgacaaagtgttggatggcaaaattgctcatgatttatggcacatgaaaatgaattgatgtatgtatgtatatatatatatatgtatatgtatatgtatatgtatatgtatatgtatatgtatatatatatatagataaattaactggtgctacatggagtataggctccaacagaatccaccgtgtacgatgctttgagatccgtgctacttgaaaccggagtgttagacatagtaacgggttaaacccgattagacctttgtatcctcatgatttgcatgcagcgtgtgcacgacacgatgagaatccctttccatataagagcaaacatgcatgtactacctctcaaaaaaaaaacatgcatgtactaattttctggtgattgcatgataatttgtttccatatgattgcgtgattatttatttccatatttgagataacattgaattgatccacaaatttcgatgtaaatccactaattgcgttgtaattgatttaattatttccatcataccgattagtactttccattttttgtgtacatataaaatgatggagatgacacactccagtcgactcaatgctactacaccgatggccggacgtcggcgagcttattcgtcgccaagctattgcaccaccggcctgacgtggccgacatcttcttaattcgtagcgggctgctggtcgtttgcgagattcgtcaacacacaaccaggtctccgacgccaatctgttgcttttttttttgcgccgccgatcgtccgtgactctcaagctcgttcctcgccatgaaaattttttaaggtaccttatgtatgtatcgatgatttttcgttttcaaaggtattttactgatctgggagcgtaacatatgttctgtcgcgcttccgtgttgtacgtagcttcgtcgccacgcgcggctcgccgccgccggtcgtctttgagattcgtcgtcaccgccgccggcatcggtcatccacgatcgcgcagccttgtcatcgtgtgcttcgtcgccatgcaccgccatcaccagtcgtcggcgaggttcgtcaccactgtcggcgccggtcgtccacgatatgatgttcgtcgttaaccccgttactttcaatttgaattatttgattcatatgtatgtatgtatatatatgtatatgtatatatatgtatatatgtatatgtatatgtatgtatatgtatatatatatatgtatatatatatacatatatatgtatatatatatatatacatatatatgtatatatatatatagtagtactcattttccaaaaatacagctagccaccgcgtgatgtgtacttacgagacttttgaatttgaccaacactatatcttagcctctttgtttcaacttaaaaactattatagtttagattatttagtcaaattactataagttgtattataataagatatcgtataataagtatgaggtatttgtttctctggattattggagacatggattattgggttttgaaaagctaatgtctataatgacctcagctattttggatgccttgatcatccttttgtcaccatatacaacaaatacataatttgaaatagctaaaaaatattaccatatattaataaataaaacattcatgcatattttttttacaataggctgaacacaaaattattatctcttagccaagagagtatagggttggagcttggggaaggattcacgcgtggggtggggtggggtggggggcttggggaaggattcgcacgtgactggggagagaggaagcagatgtgcgtgcgcttgagggagagaggaagcggatgtgctcgacctgttgggtttgatggcgctagttggtaatttgtataaaatttttaggggtggtgggtctttaaccacccaataatctgaaaaaagcatgtttagaggagattgccagattatactaatctggcttatagattataataatctatcataataatctacatgtttatttctgattacggataataatatagactataataatccaagctaaaacaaatcaggctgacggttcataattaacaaataaaggatatactctagcataaaattataaaattagatttacttttcgtaaatatatgtttgctacaaataattatcattgggtcggtatctttaccacaagttgcaatctactacgtcatataaaaaaaattgttaacatgtcgtatcatcatttttgtgaagtgtacgtatttacgggctgacttttgaatttgaccaacattatcatttagacggtccataattgacaaattgttaacgaccaaatttgataaatttatgtcggatttggagttaaggccgaagcggatttgggaggaaatcgttaatggaaacagggtatgattcggcttcggaaccgcatctgctacagtgtgcatcggcagttactgaatcggataaggcaagccgatgtagttcattccggcaaggtgatattggaatcattgtcggattgagttgatatgcttcatgatgattgccacgtgcggatcgagtccgaagaaggcagttgtatctattaattaggaatagtttgttagtaggaaagtgtgtttagtgtcctataagtactttatgttttccttttatctttaagaaagtttctttcttgtccgataaagacttgtatcaacccatgtgtataaatatgtacacccggggtctatgtaatctatcttcacaatcaatacaattcggcgcatcgccaccttttaccttttctactttattttatcgtccgggggaacttggcacctgacgcgaggctgcatcggtgttcgatctccggctaaggggtaagtccaatgttccgccggcccaggcaatagtatcgtttacgtcggcgtcgttcaaggctgcatcagtacattcgacctcttggattgctctggtttggatgatatattgcctacctatttatcatatgtctttgttaatctagtattagaatatcaatttagctctatcggctgcttctcgttttagggtttctgccggtatcgactaaatcgcgttgctagattagattagattagacatctaccaccctgaaaactcagtcaacggctttattgtctagatattatgtttctttttatacttagtgctacatcagttaagtttgatctactaagtcatgcttagaacccataatatctagcctgcttcttgattgccaataagggtttcattggggtttcagccggtgagttatctggacgttgcatcggctcataaggattgcgtatacatataagttggatttagccgatgacaacaaaggtttcactgtttaatctaatcttgtgaatttcatgacatcggacctccagcctgtcggtgatatgggcccgggggtatcccagctagagggaggaggccgccctcaaacccacgtggctccccccgaggggggtcgagcccagggtgaagcggcggctgccccctccctgcttggggtcgagctgtcccgaccccctccacgtatcagcccacgtgtacagggttaggtgggtgcgcttaacgcccacctaaccacatttaaagcggtctatgcagccacgccatgccgcatttaatgcggtgtgctgcgcatctaaccggtcgaatgaccgatgggacggtgactatataccatcgccctgtcagtgtgtcaggcggcgcgcaacgtgctccatcctatcccatcattatgatgaggggcttcacagcctcttatcccggtcagagctggtccaaccactctgaactgacccgggtatctgtttcctggtgtgaacaggaacctggaagtcctcaaccattaaacggcgaatgacaaggacgccccgcatgatctgatagaccccacgcagcagccgacgcgcagatagctttgggctaaggcacaagacatgtaattaagatagagattattttcccttctccctaggtagcactcgcagcatatgtgggatccccttagagtataaaaggaggaccatgcctagcgagagaggggatcggattctggatccccaaactaaagcttctctaaccctagcttgtacttgggagattaagaggctttgcaagcatagaagaatcatcatacacacaggagtagggtattacgcttcatagcggcccgaacctatataaatcccttaggtctcttttgtctcggaaaaccttagatctcacccgctcccccggccgaactcacaaaggggggtctcacgacctctcgctagagaggatcactcctcgacacagccgatgtgtgctttaaccttcggatcgatgattatttatcatatcattattttattacatcatcatcagtcgattacctttatatcattatctacattggacgtatagccgattgctcaaaaccctatcgctaccggctggtatcggcatcggctatcggctggaactactccatcggcttgtcagccgatcggctgttttgatctactatttgtatatcttgtcagttgcaggatcaaactgactggtatgcctgcatctcatcaagatttggacctgcacaggagctaagcagatctctcaggccggtgtgttcgattttttcgtcaacacaaattgaaaattatgctctcgcataaaattataaaattagatttagttcccataaatatatgtttgttgcaaatcattgtcatcgagttggtatcgataccttgtatgcccgccgtcgtaaaatataaaggattttgcatagaggagatatttccaagaactataaatctactctaaaatttcacatctgtccaaactgaacggggggagtaagatataacccattatttttataaaataataacataaacatgtcacatcgttatctttagcgatttagcgatttgttcgataactgactgatatatggagcattatactccctccgtcccattttaattgcaaccataaatttacgtgtccaactttaatcgtccgtcttattttaagttttttcataattagtatttttactgttatgaggtgataaaatatgaactttatatgtgacttatgttttttaaatttttcaaaaattttttaaataagatggacaatcaaagttgtacacaaaaaatcatggttgcatttaaaatgggacggcgggagtaaattactagcagcaagcagtagatcgagtgattaattaagcatttactccgtaatttattgatttaattaactaactaattaatcaagcacgtcatcgtaattaatcaactagcaacgagcgcacgcaccgtcatcctgatctccgtctttggtttggttttgctccgcggcgtgtggggcttgtcgtcggagaagacccacagccgcctcaccgttccgtcgaagctgtacctcgagctgttcttcacgtcgtacggccactgcagctggaagttcctctcgccaagcctcaccgccgtgaagccgtccgtcgggtcggccgccgccggcgacgacggcgccgccgccgccgccatggccaccgccaacaccaccagacaccaagcacaggaggaggaagaagccatattaatttgtagcttcagttgctttggaatttggtaggaggtttctgcagtttatatagagctcggatggtggggattaatttgtgatgccccttacgttcgagaggcccttttaaaattttctatttcctcgtttttcatgcgcccattaagactcatagtactaaatagtaagtgtgctttgttcaaataattattaaaaatattctgaaaaatcatagtattaatttattttaaagttatttaaagtaataattaattaatataagcccctggcagatggggaccctctagagtcgncatgcnggcngcnagtacagcantaattcccatg

SEQ ID NO: 59100 - DNA, 9095 bp, Oryza sativa
gcagaaggccaggattggtctcaccgcaagaagagagctctatttgtccctcgctatcaattggcgccaaaggttcgtgtggtggagaaagaagttgccccagctcaagcggatcctccggtcatcatcataagtgatgaagaagaagaatccaagcgcacccgttccaagattgagtgggtagcaactcaagatgatgaagacgagccgaacgagcctacaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaatactcgcagcaacgggaatggtcccaacaaccccaataacaataacaatggagagaacccaactctggcccaagttcttcctcaacagacacagcttatgaacatgatgatgcagcaattccagaatcagcagaaccaaggaaataaccatgtacctccccagaataagttagcagaatttcttcgtgtgaggccacctgttttctttagtaccactaatcctattgaagctggtgattggctgcatgccatagagaagaagttggatttacttcagtgcactgatccggagaaggtatcttttgcatcacatcagttgcatggctctgcctctgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattattctgatttccagaaattagtggataaggctatacgtcaggaggacaagtacaattgcatggaacagaggaaacgtcggattgctcacttcaagggcacaacaggggagtaatcaaaagccgcgtcttactttaggaccccagtctatgccacagggaggttcttcgtctgttgttcgtccgccgcgtcagttcttcaacaacaatgctggcaataacatccgcaatcaaactccacgtcctgttgcagctccaacacagcaacagcctgccaagagggagcaaggcagcaagcccgtggtgtgtttcaactgtggagacccaggacattatgctgacaagtgtccgaagccccgtcgcgtgtaggttgtccctgcccagagtaactctgctgtaccagcatcaaaggcccgtgtcaatcatgttgctgctgcagaagctcaagattctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacatagaggtgtgatagactgtgccaacagaaaagtaactctcaccagcaatgatggtcgagttgtgactgttcatgcattgtcttctgagtctttaaggtcaagactgaaccagataactttggaagagattcctatagtccgggagtatcccgatgtgttcccagatgatttacctggtatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagaccatacccagagaatgtgtgtggactatcgtgcgttaaacgatgtgactatcaagaataagtatccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatcttcgccttgcattggagaagctacgagagcatcaactgtatgctaagtttagcaagtgtgaattttggttgtctgaagtgaagttccttggtcacgtcatctcagcaggaggagttgccgttgatcctagtaatgtggaacccgtaaccaactggaaacaaccgaagacagtttcagagattcgcagttttctaggcctcgcaggatattaccagaggtttatagagaatttttccaagattgctaagcccatgacacgattgcttcagaaagatgtgaagtacaagtggtcggaagaatgtgagcagagttttcaagagttgaaaaatcgcttaatatcagctcctattttgattttacctgatccaaagaaaggtttccaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccgggaaaggctaatgttgtagcagacgctcttagcaggaaaggctattgcaatgctaccgaaggacgacagttgccattggaattatgcaaggaatttgaaagattaaatttgggaattgtcagtagaggtttcgttgcagctttagaagcgaagcccactctaattgatcaagtcagagaagcccaaattaatgatccggatattcaagaaatcaagaagaatatgagaagaggaaaagctatcggtttcttggaggatgagcaaggaactgtatggttgggtgaaagaatttgtgttcccgacaacaaagacttaaaagatgcaattctgaaagaagctcatgatactttatactccattcaccctggtagtactaaaatgtaccaggatctcaaggaaagattttggtgggcaagtatgaagcgtgaaatcgcagaatatgtagcagtatgtgatgtttgtcagcgagtcaaggcagaacatcagaaacctgccggtttgctacagcctttgaagattcctgaatggaagtgggaagaaatcggtatggattttatcactggtttacccagaacgtcatcaggccattactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtgaatcagattttggaagacatgttgagagcttgtgctttagacttcggtggaagttgggataagaatctaccctatgtagaattttcgtacaacaacagttatcaagctagtcttcagatggctccttacgaagcactgtatggtcggaagtgtcgcactccgcttctgtgggagcaaacgggagaacgtcaggttttcgagacggatatcctaagggaagcagaagaaaaggtgaaaatcattcaggaaagattgcgagtggctcagtctcgtcataagagttatgccgacaatcgccgtagagatttgagttttgaagaaggagattatgtgtatcttcgtgtcacgccttttcgaggagttcatcgttttcacaccaaaggaaaattggcaccgcgttttgtgggaccctataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaataaatgagagaagaaccagaaatcgagttatccgtttttgcaaagtccaatggagtaatcactcggaagaagaatcaacttgggaacgagaagatgaattgaagtcagctcatccacatctgttcgccagttcttccgaatctcgaggacgagattctgtttaaggggggtaggtttgtcacaccctgaaaattcaaaatatataaattgttgtttaattggaatttttagaaataattttaaaaagtcttgaaaagaagatctaatttttaattaataaatttcaacataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctaccttcggccgccgccaccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcgctctagcgccgtgtgccctagcttcgccgtcgccgccgccgctccagccgtgctccgccgccgttccagacgtcgccgtcgctcgggaagaccgttgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccatgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccatcgttttcggagagtccgttttcgccggagaagagcttgaagagttccaaggccagcaaggcaagtcacacagatcccaaacaaccctttgagcatgttgatcatatttaaagctattgtttcttttcaactattgcatttattttcgaatgtcattaggtggaattaacctattgtttgttatagcccttttgttcttgattactttattccttgataccttgggttataatttgactagttgagctttatttatattggttcaactaaatattagatataattgcttagccctgcttagaaaccttagcacatttatgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagatgtcccctcagtgatgttcgaagctggaggaagaaactacatccatgcatgtcaggaagtggcaaggatcgccataggagagctccgtgatcgctacagtgatcagttggccgatactgagtatcgctaccatcctcgtcaaccccagggaagtgaccgtggcagttaccttgagactgaaggaattgagaatgatgctaccacaaggcatttggttgagatgttgtgggctatggatgaaagtcgtgcggagactgtgttagcggctcaagatcgtgaagaccggaatcgtggtaagatttgcaagttagaggacaaggtggatcgtttggagaaggaactcgccgcattgaagggagaagcaccgccgcagaaggccaggattcgtctcaccgcaaggaagagagctctatttgtccctcgctatcattggcgccaaaggttcgtgtggtggagaaagaagttgccc

SEQ ID NO: 59101 - DNA, 15985 bp, Oryza sativa
atcttcagaagattcaaacaccatctaagtagggatttatattattttatgttcaacccagatcgagaacttggctagtttactgtaaaaatcatgtgaagcaaactttttgctgcctttttctgtaaaaccatgtggacctagagatggcaatggggacccgatcaccgatcccccgtggtgaattcacacattagaggatggggatggttgatatctaccctccatggggaatctaatgttttacaaaattgtaataagctcacctaggataaaccactatggtatctgttattaggtttgaatgtgacatggtatgagaaattggattgaatttggtgggctcaaatttaatgggcctgtttagtgggctttgatctaatagttggttaacaaaatgggccagttctaaaaaaataatgggccactatgaaataattaatggaccaatgtaaaaatttaatggcctgtaaaaaaaataatgggccattaaaaaaataataggtcgtttaaaaatatttgctgacgttatctaccacgtcatcagtgacacgtcatcacacgtgttaatgaccacgtcacctgccatgttggccgccacgtggcaaccatctgtgacgtttaattttgtcacaaaagttgggcctgggctgaactacatgagcccaaaagcgttttatgacagttaaaaatgtcatagattgtgctgatccgtgacgatttcggagaaaacgtcggcagatttaatctgtgacgctcaatagatgacgataagtagaatcgtcacagacaaatttatgtgacgaattttcagtgatccatggcgaatttttttcatcatagattaaatagattattgtagtgttatccttgaacacacataaccaacaactttcctgataaatgacacttatgccccccattcacatatatatgaaaaaaattgtatgcaatgaattctttttatagataaaataaattatgtacttccaagtgtatacaatagccattaggcttaattttcatgtgcacatgttgaaataatgggaagtacatatgtaatgttgtttgttcattttggttttttttttctagtctatagctgtatacaattaagggcaaaagggacattttctaacataattgttgactaaaaatagccatatggcatattaagtgggcccaaggatgattttaggccaaaacaaatatttagaggaactatgtggacaaaatgaaacctgaaggaccaaattgagccttcggtgaaacttgagggattaaattagctattcacccttcctacaatgcatttccttttaggttgtatcagattgtgtagagcaagcccatgcctatggataaaaggctttatgggacttcataaccagtacgttctcttgtctggattaaaaaaagcctgactattttcgatctatgtcttattggcgaagtgacggtcataaaaagaaatatcttcttgtcaaatgggacatattgtgcgggcctattgactaagagggtttaggaattcatgatctggatattaaaaacatagcctactaagggagtagctattcaggtttcttagtgcataaggtgtttggtaatggctaattaatatggaataggtatttatgttcacaacccgcttgcaagttcaatgaaaagcaggggactcacattttttggttagcctagtgaaggtggaaagggatgtcttttcattttgaatccttcgtaattaaggatggctcttaaattaggttacaggaagataaatggttggaaaatataattctatgaaaatagtatcagtgtccctacaaataatgctaggcataaataggcgactgttgcagatgtcatatcgaatggatattccattttttttcttgaagaagggatctaattagatcaaattagtagcatggactaacttattaccgtattaccgatattcatctaattcatgagcaagatgagtttcgatagaacttgacttcttatagacagttcattgtgaagtatcattcccttgcactactccataatgacatcccaggtataaatagacgcatctggaaactaaaagtgcctctgaaggtaaagattttccttcggtatctttgttgtggagttgtgttaactaagaacaatatatctaaacgtaattggcaaggcaatcaaattttttgttttcgtcacattaaggaggcaattaaacacgtcatatggtttctacaaaaaagttattccttcgcctatgcaggtcatcacaggatatggttattgtggcgtgtctacgcttggagcatgtgataagggtgtgttttacctagggacatgggtgacgatctagttctagaattgatggtccttaatgcttcttgtacttgttttcttcgaaattggttggtgtatgttttggttatgtgcatcctagttgtgcaaaggctaggagtgttctcaaaactgttgtatgatcttgttgtagtcgactgggttgtataaagggccaattgcatatttgccactggtttgaaccggtattgtgaatttaccattatagaagatgtaattgcatatttgccatcaaaaacggttagaacctatcatatttgccactggattgacagattagactaacaccgttagaaggttggttttcagaaaaattaggacaaggatacccctaccccgaaattgcaagattgacatcatatttgccataaaaagcttacatattggtttgtcctccaaaaatgatgtggccaaatgagattcaactctaaccataattgtcaagaagccggaccattgattcctacaacataagaagaaaattgatgaatgttctagtagatcggtggagtatctaccgttccatggtgctcctgctgtttccttgcagctcctggcgcgtgttgctgctgctgctggtcgccgtcggcagctgctactcccttgccgccgccgcccctgcagcctgatgctgctgccacccccttgccgccgctgttccccagccaccgccgccactgccccagccgcatgatgctgttgctacccctaccgctgccatccccagccaccgccgctactgccccacggctgagctcctccattgtcatctcctattccagtgtgacccattttttggttgatttgctcttgatgaggggaaagtgacgaggggatttgggattagagagagaggagctgattcttcacggtggagtgaagagcactgatcgaaagagatgggcagtgaggattaacactggctaagggcaaaacggtcttatcatgtttttttcttttttatgaattatcttcatctgcttatttgcactaaatcaaacgatagtggcaaactgcatcaacctaaaccaaaaccagtggcaaatttacagttcgtgtttttaatggctattttgagttagagggtgaaagtagtggtatatttgcaatttctccttgtataaaagcttttattattaaaaaaaaatagctgcttccaagaaatttttataggttggagggaattggactctggtgggtgctcaggagtggcaaaactgaggtagcctgcaaacactctcccacatcctttccaagcatggaatctatggcaagaggtggggaatggtactgttaattttatgtttcaataattaaaatttaatgttaaatgagtgttacaagaatgttttaattgggatttgactattttttatatttttaacttttgatcttacaacccttttttatgtttcaatagttgaaacctcaatatttactacagggttgtcccatcgaattcgggggccttgtgcaaattattgacaaaatactaaacatagttgatgaaataaaacaataacaatttatgagttttatcttcttttcttgctttgttcttacacttttcatagcctaagtcataatttatactagagttaattgcacaatgggccacttatgtttaccaaggttgcatcttggactagggagaagaaaatattttcactttggactagataagtttgtaaaatgagtcactttgtaccacttccctctccagctctctcatcactttcttctctaccatataggaaacttggtgagctcatgaaggcagcagcatgcggctcctcaaatcctcagtgcatcatatcagcatgagcaggaatgcaggattcaactactaccaatcaatgatctgctagctaggtgctcgcttcttacgttgattttgggaactgggaaaatgggagatcctcgagcttcacgtcaggtagagggcatggctcagaggagatgctccttggcgatgagcagtaggcgctcgctatagcctccacaaattgggggcattcaccggtccagttcaccaaagcatcaactatgcttgctccaatgctccacgatacgcagggcatggcagaatgtgtaggtcaagcagagcgcatacggcaccaacggaaatcgagctcgagcagcaatacatggacagcggcatactagtggaggcctgcattcttgaacattttttttgtgcgtatatccttctcatctccttcatccgttgagtccgctctcatctcggcttcctcatcaaccacaagtagctggccgtgattagggaggagaggagaggaagaacactatttgatgctgacgtatgggccactgattaaaaatgccaagtttggtaataaaacctagtcaaaggtgaaaagatctgctgattgctgctccaatttgcaacttgggtaataaaacctgccataaagtgcaattcactctttatactaacaattcgcagatgtaaacggcaaaatttggcaattattgttagttaaggccgagtcaaagatggaattcacgccatgattttagttgatttggttggcaagtttatctgggtttttgtaaattacttccgtgataaggaaggtttttaagtttctatttttatagatagatttctgggctgatggagtcgtgttagaatcagacttagaagatttatcttttaggttaaccgatcagagtcgtgtttgagtcggagttgtaatagtattttccttgcttagaggtacagtcctgagtcgatccgattgtagtggagtcggactttctatagcctattggtataaatatgtacacccagggtctttgtaaaacaacagttcaatatacaaatttcgatgcatcaccaaccctagttttactttcgacgagttcttgtttcgagtttaggctgcatcggtttcaatctctggcaagaaagtaagtttttgtcaactttgcttgtaacagcggaattagtactttctcagttaagtccggcatactagttaaggttcgactctttgtttgatcgtttttgcaatcatagtcagggtttttatatcaaacactatcaaaagtatcgatcgacccgtttaaatatactaaacttgttattaatctagaaccatcttggttgagtccaatcttctaggttataacatattaactatatttactcaaactgataggtattcaatatagttttatcggagttttagctgataagttatttgcttatcataatttaatctactgtatcggctaatacatagattttgtcagaataggtcaagctgctgccttcattactttccctacaatgtcttagttaggtccgatctatctagattgtgattaataaatttagattgctaatgattacgatttaaactatcatagccaatattagtttatctactttgcgagtaataataagtttcaattaaatatttaagtaaattgacctacatctggaaattatatatttgataaatctaggttttattattcttcgatcttgatgcaaaattccgttgttcacaataaccgcccttccaatagttccgattgtcattggcacactataaaaggagttcatacacacttcaacttgcacaacaaaatagagtgcaactcacttttagacattactttagtatgttggctgttggagtacctccgagaattttatggaggagtgccggactgtcggcattcttcaaattgaattccggagaaagtcggcattcttcaaatggagttctggagaaagccggtactgttggccttcttctctcaattgtatttcagcggatgcttccttctataaggtaagtattcgagtttctttatgttctttagttagtttatttaagtgagatatattctcatcgatgttggttcatcgcttagtgtgaaactatgttctagtactaggactttagataaagaaggaagttattgcgcaaggttagagtagtaattaataacataggtgtggtgtctaggttagaaattttctttgtttgttgtgtgctccacggaaagtgaggtagaatgcaagtggtgacagccttgtccatcccttgtatccctcaatgtttgggtacatcatagagctcaagaccggactcagcctggcagaccaggggaggaccggtgcccgaagcattcgatagagttttacctttaatttaagtagctaattaaaagatagaggaattatctctacccaatctatcatcagttgttgtccttggattgaattttgttcgataccattggaatactctaaggggaagtactatagtggtatccgtgaatttgcggatttatctgtgaacataagaaataccaacataaataagccaagaaatccaaaacagaaactacaattcaatacattaataagtcctagttagcatcatggttcgatcaacaccgctatcagctagtgtgaccaagtcattaggacaactaagactatagataaaacccgggatgttacacaaaaccaaaccgactagtagaggtgggcagaaaaagaccgaaccgaaaagaccgagaccgagaccgagaaattcggtcatcaattcggtcctcggtagtgatagaccgaattttgttcgatcaattcggttagtctcctcggttaaccgaatcaaaaagaccgaattatccaaaaaaaaaagtctaaatgcaatctacaatccactatgtttaataggattaaactcttattttcacatccctacttcttctatgcatgcaacctaataagagtttttactcataagtgcttacgaatttttttgtgatttttttgttgaaaatttctattatttctttgcatatatgaaaatgttgttgaatttcgatcaagaccgagaccgagaccgaaaagaccttgaccgaatttgtcggtcctaacattttttgtgctgaaattcggtctttacttttcaaagaccgaaaagactgaaagaccgaagaccgagaccgaaattttcatttagaccgaatgaccacccctaccgactaggggtagaccctgttagaatcaagggttaattggatctatgccattacaaatatgttgatttaaaaaaaataccattactattcaagaaatctgttgtgtgccaataaattgttctaaaatttgaagttaattctgtaaaccagagacttaatattgggatcgaaaaagtgaaagaatcttatagacaacctatcattcttgtagaatatatagctttccaattaaaaaaatagagtttcattccgaaaggcaatgaaaaaaggcattgaattaactaaaaaaatggatataaagggagtaaaagtaaaaattgcaggccgtctcgcgggaaaagaaattgcgcgtgccgaatgcatcaaaaaaggtagacttcccctccaaacaattcgtgctaaaattgattattgctgctattcaattcgaactatctatggagtattaggagttaaaatttggatattcgtagacgaagaataaccaaccctgtcttcccattatgttcagtaatagaataaaaaatgacaagagcctcattttccctaaaatccctaaaaaaagaagaaattatatctctttctataagatttaatgaaaattaagaaatcttttaataaaattgctatgcgtgtggggggagaaagcacatgggccgacaagctaaggggaaagcgttcatgccctatgtgtcatgcttaaggaacccttgacttgaagggtttgtttagatatgggataagaagagtaagatcgggataggaaaatgggtaaaggtttacaatgaaatgaggatggataatggatggctaggaaaatcatttgtctaacccatttgccaaaaaggcccaaagtagacagaatggtcaaggctgaaatggctgccccactgtgagaccctcacagttttcaaggcccattgaaaaacaataaatcactatctttattgcttatttatcttttatttcacaataaacaataacaatcaggtagaatgttgccatttgtgcagccaaaactcatccaaatatatatatccatggtaaacccacgaacaaaagctaatagttcttcccattgttagactatagagaatgtaatttagttggtggcttaatcattttccatgcagtttagtgagcagtagtgagattgaacacctgccaaacaaagaaaaaccaaagtgcaattagaacatggaagggaattcaaatatatccaacatattcactccacagagagcctgcatacctactaaagattaaacaatataagaaacattcataccttgtgcggtttttgcaatttctgaatattactattctgtcctaaaatacaacaacttttagctatgaatccatattcatagctagaaatatggtacagagggagtattacaaacggattactatcctagctaccattaaagaaaaacaaattccaagtactagcgttgcgtgtaaacttgtttgagtgaaatacctgtaaaattctgctacaagctgaaatccatttacacagaatcatgacatgaatgaaagaaggggagaacacataagctcactgactaggaaagagagagttcactgggtacgccccatttatctgcattgtttaaattaaaaagaaaaggtaaaatgttagcattacacgcctaaagataaaacatgaagaaaatctacttcctttgtttcgttgttgtgtttcacagtataagacattttaggttttgaatagattcatatttcatatatctatctaatttatattggatgttaataaatctaaacgagatgagagcccaacgcgttttataatgcgaaatagagtaataaacagagccacgcgtagttccaacaaatgatcctcaaattaaggtaaataagtcttcaaatgaactaattgtcatcatgttctaaacagtactagtaaaataacctttactggtaaattcagttgcacatgaagggcagtaactaaatactccattcgtcccattttaaacacaaccatatgaagggcagtaactaaatactccattcgtcccattttaaacacaaccatgagtttctatgttcaactttgattgttcgtcatatttatttttttttgaaaacattaaaaaacataagtcacgcataaaatactattcatattttctcttctaataacaataaaaatactaatcataaaaaaaattaaataaaacgaatgatcaaagttagacacataaactcatggctatgcttaaaacggacgtaggtagtaagtataatttcatgttgccagtacatggtaaccatatggtaattcaaacttgctttgctatcttatgaatgaattaataaaagatcaaattaatttaaacccatgctgtcttatgaatgatatagtcgaaaaacattatgaggctgcaaaaaattgtaaatgcttttatagttttatgattctcgacggggttgtttagatctcacgtgctgttaattatagttcacttaatcttgttttagataaattattatttgattattgtaccaatcttctggataggaaagcaaatttgctctaaactggaaatcgcgtttttatcacaaagacaccagagtttctacaaaagctggtttcattatgctatgcgcgcacttaaaccacccagccaaaaagtgagatctaaaataacacgatactccttccgtacaacttttaacgcttaattacaataatatcaatattacgtatgttatattagtagattcgtattttaaaatatttttatgtgatattatttttacagttattaataatataatatgaaataaattaataatcaaaatatgtcattgaataccgtgtattaaaaaatacaggctttataatttaggacagagagagtaataagctagaactggttttgttttttggaaaaattgaattaaacttattttactaaaacctgcttttatttcactcattcaaaccatcacgagttaaatctatttcaggcttgacccgtgcgcttatcgtgtttcacaaaacatatcgaatccgtggcaacctgttcttgttcaaaatccctatagaattcttccacaaattctttgttcaaaataggcatgtttgaaagaaactagctgtttgtgtccttttgacgttactaaccatgacagttgatgttaagccctctccagttagttatgttttgtcaatcaaatccggtaatcacccaaattagctcaccaagtgtttgtttaaattatacaggaacatatcctttacacacaaacttcccatgcacactccgtacacaccaactagcaaatgtcacgaaaaattctacaaaaaattgtatacatatttcgaatagtattacaattacatgtgaaattttatcttcaaattcattatattttagccataataaaaaagacaaaattctgacagacttttacccttaaaactgtcagattttttacttttttgttacggctaaaatataatgaatttaaatataagacttttagatatgtgtaatactaataggagtaaatgttcaattttgtgtagaattttttatggcatttgctagttagggtctgtttgttatagtttcaactcctaaatttagcttcagaagttgggtctggagtggagttgtggagctacctatatccagctccataactctagttcattttgtgagagagctccacccagctctactatcagttttggtggagctgaaactgtttggctaaactccagctccaggaggggtggagctaaagctagagttgtgccaaacaggcccttagtgtgcacgggaagcttatgcgcataggatatgttcccaagttaaactggcataaaagaagacatttctagtagtgataagttcatttaaccccctcaacttttcactctatataaaatacacccttagactttaaaatcaggtatcgagcacacgacccccaccagcaattttggcaacggtttgggaacagtggggcgcactagtaaaaaaaaactaaaagtagtgaggcccacgtgaatggacatctcttttttctctatctccgtatttgttgcaaaaatccatagttgctcgtgcgtttcacccaacagacactatcttgtgcaaacgataacctctaattactctatttaaacaatctggagctcaattaggcatgtcgtttgattcaagagtatctgtatacaattctcgagcaagcaaatagtcagaacaaatatgaaaatgttagaaaataggaatgaatacattttttctattatgttaaaatacaaaagcaagaatagaaaatttctagaaaagcattggtacagaagggagcgtaaagaggcaaacacaatttaccacaaatgcctcctcggaaaaaatacaattaagcgaatctctcgtttctgtgagaacatcactaagagcaagtttgtttaatattagagctaactaagtagtattaaagctaacatatactttctccgtttcacaatgtaagtcattctaacatttcctacattcatattgagtttcacaatgtaagtcattttagcattttccacattcatattgatattaatgaatctagatagctataaagttgtctctaataaagttgtctctaattttcctctttctctcacttatgtaactaatgcatttagcttgtagcatatctcgagacctaacacttcatttttcttgttctctcttattcacatataagcttatagttagacttgctctaaatgaagcaacaaggcaacaggtgcataaaaggttgcatcacccaaatttgatgacagattagaacattctatgcagatgcacttatctgtacaatatcaggcttagacgatattgaaggggggagttgctattctgctagcactcctttcacactaacatgcgatcctccactaagttacagcttgatttgatcacaagttcaatttacatacacctgtgaccactaatgattgtgaccagaaaaactgaagatcacactagctgcttcccaaatgacagtaaagtataatataatacaagattgtataaatacataaagcagatataatttaaatcgttgcccctccagcacccctaagaaacgcctgatcaaacaaaaaaccagtaaaccaaacaaaaggcatctaagaattgaacatggagttaacagcgacatgtactgtacaggttttggagaaatgataatttaccagcttagttgctttaacagcatgaatctgcctctccttcttctcacgtttacattcaccacaccagtccgaaaagtccttctgatatttcttcatctccctgaacacagagctgtgcacaggaactattaattttagctgcaagttagcttgctagtagccagtagccacaagaaagataatcttttcagtagccagtagccagtagccagtaaccagtaacaagttctctttgcggatgtcaagagaaagaataacctttgggattgcatttgaatgacataaatataaagataaatttagcaaaaccacatatattttgacataactacagattcaacacgaagtatcacagatctacatatttagcaccaaacttgttacaaattaagatatgcaatagagcatcttaaatctgtaatcatgaccattatctcaaaatatttgtaattttgcactaatgctttgttgtctcaaacttctagttccattaatgtttcgttgatttactaaccttaagctatccgagtggtaagcactaggctctttcagtatgatggacagacagtggaatctcatacatcagaagaaaatgtatgtctatcttgtttacagaaaaatcaaatttgaactcaaccttatggagttccatatatatgttcagtttttggatttgtcaatggaagcaaaatctttctaaaatccctccctaaattgcacagaaagtagcatacgtacagatacatagctagggagatgatacattgttaaagagaagtttttcatggaacaacttatgttgacctcttaaacctttcctatgtttgcatcttgttttgttcctgaaattttactattgcgcctggctgcatcttattcaaacaacataacattgctccacctttctccattcaaactaccccatatgtcttatctaatcttagtcctaataaaaaacatccgtgtgcaattttattcaaatcactgctaaagaacaagtacggttctaataaaacaaaaaggaacagaaataaaatattgatacttcaccaaagcataccataagttggaattttgatctaatgatacaatacaacagctcatatagtcgtatgctcgtatgtctattatggtttaccaaatttccatcacttcatcattaaccacaaaacagatttgcgtgcgaatctgaacctttttagcatcatcattatatgatagtgcacaggtgatacaatctaaagaaatcaacattacactatctattatagagttacgtacactacaaatctaataattacctctaccataaaaaaaatgtcatgttggacaccaacatgatcttcataatacaacttctacaactaagacatctgtaaagcccaacaaaatatatacatatggtttgcctgcatcctttttaaataattaaaatgatattgatgtttaaaattttcaaagtttgaattgagagatgtccgaaacatgtttttgcaaccagatggagtattaagttaaaagtttcatgaggaagttatgctaggtgaagaacattatctttagtattatttggtgaaaaatactaaaataaaataaaatcatcagtggttgttatgttctgtcagtaaaagtaaggggcaactgacctttctggataagtatcctttttaatgtttaagagctagttgagcactcaatagaaataagagctgctaaaacagataatgcagaaagagctccccactaccaagtaagctctttctacttgttcgcctggatgaaaactccctagttttgtttggctaccttttttattggctagtgtggttttatatctcaggctagactcgcttgagctgtcttatcagtaatcaatctacaaattgatttccaggaactattgtcaacatttgactatgaggaatgtcttcgttgagactacaaccatgttggaaatagctaatcccttcaaaacaataggactccgtaacttttgcaagctgtaacagcaaaatcttaaatcagtaaagattccactaactaccttgattccacagcactcatgagaggcctttgatcaggtgtattttgtagtttcaggtttcttacccttgacatgaactacgcaataccaacacaactttccgtgaaacaagcaccaataaaacatgataagttaaggaaaaaaatgcatacatatatatggtcataatatttcactgaactaaacctcaaatgtccgcataaacggtagctataatacatgcccagtatgtgctttaaacaagcaagacaaaaggtcactgaaatctttgacaatcaaaattgtatgggaagatctgtaagacttgtataccttctgcaccacaaaagaagattgattctgagcccagatgatgtcggtcgggcaccatgcctatgacgaccacgatggagcacagctcgtccaggaacatgagagtaatcgaacatttcctgcaacatgagtaatgaaattgaaaagggtaaaaaaatatatatcttcaattatgtattgtgtaacttccgtgaacaaattaaccagaatatgttgcaagtaaatgacaagtttcatgcaaaaaaaaaatctgaacaaaataagtttcaacaccacataaatgcactcacagaagagaagaaaagaggtgggtttgaaatttaaaaatagatattaaatgcaactaaaacataaaagttcatctacctcatgctgtgtctctgaattcacatgattctcacaacggatgccacgaaagtataactcaccaccagagaattgcttgccaaggcaaacattcaatgtaacctcagaatcgtcaacgtggaaacctataatgttgagaaacggtttagaacagaaaagaaatgtttgaacaaaaactgagaatgaaaaatggcaaaagtatcattaggaactaaggcaaatcgatatacttaaaaaaaagtgcaactaagaaaattaatgaaattatggaactctgttaattacaaaagaacatttctttatggaactctaatgcggcttaagcattacaaggttgcgcacccattccttgtgtgtggccttgtaggtattgttttagaacagtgacaaatataccatatcaaaatttcacgcgaatagaatgaagttttctgacatgcttttaatgtttcatatttaactacctggataaaagaagtaaataaaagcgtgaaaccatcttaacatccagaaattctagtaatgtgtgcgatgtgcgatgcaggaacaacctgggaaggtggattggctctgaaaagaatttaagactaataggcaaggaccttaaagtttctggtaacatgata

SEQ ID NO: 59102 - DNA, 27741 bp, Oryza sativa
acggctcgcgtggcgggagggcggcgggacaacggctcagcggcctgagggtggtgggacggcggtgcaggactgcaggccggcggcgcacagaggccgctcgcgtggagagatgcgagagaaggaaaggggatcgaaactagttagggttggcaggggcattttggtatttcctaaaaatactgacaatacaacacatggtttgattaacatctctaacggaaacctgacgggaggggcatgggagggatcacaacgaaatttcaggggtacacaggggattgggtaaattacggggtatagaagggattaggtgtgttttcatgggcacacaagggattttctctaaaatatatataaacctgactccatgtatgcaaacaaaaattagcacctgcaatttagttatcatgacacatcagctgctatacgtccgactagcgcgttcgactggcgtacgactcaacggcgaattacacggcgtgaggcagtactgacttggtcagatgggctgctgctccaactgtcccacgtaacataatccacatcaaagcccatatattatttcaagcctgaacttataaggacacaacatgtccttttagccgcacaacgatattttgtctcatgtctatgattttttagataaaaatttggagtaggcataaataaatcagcagctttcacatactttttttttcggggaagcagctttcacataccttgtgtgatgtgatcagtgaatactattggctagataaaacaacgtggccgtgtggccaaattacatcttattgaactcaagaaattgattagagatggaacacaaaggaattagatcgtggggtttaggatagaaggagatggaaagtcacgttgaggcaatattatcggctagatgaaacgatgagcggaagtgcggccagattattgaattgggcttttgtaaggcccaactgaattagtgatctatgcggatgtgtagacacggacggcggacgtcttagtcgtacaagggtcggatgctttggttgtatgtatagcatttttggttaacaatatagtgaaatggactaaaatatagttagtttcaaactgttaatgctacaaagccatgggagaactaaaacgtgatgaaaggtcatcagaacagccaattaggggcggtttagatggggtaaaattgtttagtccctatcgcatcggttgtttggacactaatttggagtattaaatatagactaataattaataaaaaaactaatttcataaataagagctaatccgcgagacgaattttttaagcctaattaatccataattatcaaaagtttactgtagcatcacattgtcaaatcatgacgtaattaggctcaaaagattcgtctcacgaattagtctaaggttatggaatgggtttttgtaattagtctatgtttaatactctaaattagtgtccaaacatcctatgtgacagggacttagaataagtcgttgtttcccaaacagcctgtaataaagctaaatctacattttggtgcatggcagggaggagggagctcggctctacgtacggctcagctcaaacgacctcggctctacgacacatgcgcgcgcgaggagggagctgtggcagggtatggcgagcggtagagaaggtgtcggccgacgtgacccaagctctccggtgggcgcacgcgaggaggctgtgccccggccgacagcgaccccggctctctaatgggcgcacacgaggaagcgaggaggagcgaggaggtggtggggattcgcagggcggattcattgcggcggagtcatcgcttggggcggaatcggcagaatcactgatgaatgcgtactgcgagaaggacagtggacggatgagattagatgagacggtagatggacggatgagataagaggggatgatttcacctgtaggatttctaggcacaactcctccttttttatattagtatagattgtgctgatcttgtttattttttcttccggcatggactcgtatatccctagtggagaactgatctactcccgtgctacccaaaatcataattgtcccagttagattaagaactggtactaaagatgctccaagtccctcgaaatatttttagtctaggttggtgttatcaaccgggactaaaaaaaataatctttagtcccggttggtaacactaacacggactaaagatggaggatctttagtcctagttggtaactgatcaggacatcactccttcgaatatacacaacaatcctctaccggtcattcaaggagcaatcacaagagctcgctcctatgtccttctttatataattttgagaatagattgctatctaatgattatgattatattacaattaggaacaatggagaggacaaagagatatttagagagggacttagaggcgtggaggaccagcaagggcgtccaagtcaagatggaggtccaaatctagttgacttcgagtacgtttcaaagtccatgaccaatctgtactaaaacgggcgcccaggtcacatacgtgctcggattggggtgttctttatatggatggaaagctaagaagataacatttccaatggttccaatcccatatccaaattctttccgagtcatcgggaatcgaccgaacaagttgacttccaaattttgttccggtgctgtgtcaccgtattttggcctttgggccgtgtatcgtgttggagcccattagggttgcgtatgttagattaatgggctagacccaattaaatcctaataaattccattggtccacattaagtgctatgggtaataataccaccttggaaatctaagtgaagaggtctcaacttaaatatggagctagtggagagtctctgttgaccggttgagatggtgggcgaacagcaacacgcgcgcgccgggccgtggcgtgggcgtgggtgagacaaggctgctttctctctcgttttgtgtcacgtcccaaaacgactctaaaatacatcctctaaattatgcctagaataattaaaatccgtgtgaaagcctccaacaattaaaaggtgcaaagttaaaagtcaaataaggcttgggggatttttgtatatttcctaaaatgcgtaaataaattttagtggaattttcagagcacaaataataattattaagaaataaacaaagttaaaatgattttgtaaaaggaaaaactctaaaaagtcccatttccctccctctccctcttgggccggctcggcccatctccctccccctctctcctcttccccgcggcccatccggcctctccccgcgcgcgccgctaacgggcgggcccgcccgccaccctcgctgacgggtggggcccacccgtcatccccttcctcccgccgctcccgccgcctcccccgcgccctagcgctgccgccgccgcggattccgccgcatcccgccgtccccgcgtgcaataaagtgggaagaatcacttcccgtgatcccctctccctttccccccaaatttccctccctctctcccttggattcgtttggaaaccctcccctaatcccgccggcgccattgatggagcccgagaacgccgcgccggtttccttcccctccggccgccctctcccccttccaaccctatttaaaccctccccgcacctcctccgtccgtttccgcctctcgccaccctttctcctcgccggattcgagcttgcgacgtcgctctctctctccgccgtcgccgccaagctccggtccgccgccgtcgtcgccccggaccgcctcccacctcggtgacacctccttcgggttcgccgcatcctcgccaacctcgtccacctccccgtttcggtcgccgaccgccggaacgccgtcgaccccgtcgacccgagccgcgctgccgcctccctccgctccggccgcctcctccgtcgccgccgtcgccccggggtgagccgtggaccgtcgcctcctttcccccttccctcccctctctcggccgccgctccgccgcgccggtggtcgccggcggcgaccatcggggcgtgggcgcgccgcctcccgccgactgcgccggcatggccgccctccgggcgcgccgagtggccgccgcgtggggcccggccgtcagccgcccgcgccctcgggtgcggctgacgtgtggggcccacggcgccggccggtgcgagcccgggtgcacccggtccaccgtggaccgtgaggctgccgcgtgggccccactcccgtggacccagtccgcgcgcccctccccctcggctgacgcaaataaaccctttttaaattaaaatttaaatggagaaattcgcaaatattcatttaaagagcatataaacttcaaatggccataacttggccatttgaactcggaattggaccattcaagtctctaatttttccttaagaagtcaagaacccatttttgcgctttgttcctgcttgttatatggagtttattagagtaaaagccttttcttttccgttggtcgtgtagacgctgcagcttcggaagatccgctcttcgtggaagttgaagccgacgtttggcaaagagagcaaggcaagtcacatcatccttgaacatattgaatcccagtttataaaattattttgatttaaattattgcattatcgctttatttaaattcccgcgttatcactgttttatctagccatgcctatgtacctttgttatgaccttattattgttattgttattattaccttgtccaccctagaataaacaaaacaccaactagtggacactctactcatggtaccactagtatgattttaggtagatgcttcgctggttaattaggcaacattaggtggttttacaactctagactttgggatattctcatcacctggacactatggaattgttggatcagtgtggaattggattcacacctccccctctattcaaaatcctcaaaatggatttaggttgggctcggggtgcatggttttgatagtagcacctcggccatataaggaccggtcttcgggcctctgttgcaaagcactaccgtacttccacatgtttagtgggtaaggcttagtttgtggctcagtctggttataaacaaaagtacacggatggagatggacgaagtcgggggtcgatggacatctctagggcaaatgaaggctacacgagctgcggctcggtagtcgagatgtcatggcacagggccggtgtcctgctgctaggggctcagtcctgcctacctgtcccggaggttccggccgtaggtggggttgggtctgtactcttgtctatggctaggatgggttggaaactatgtcacgtcttccgtccgtataccgtggtggtatgtggcacgtgtgatgaaccctgagttcctctcgacactcaaggctgttgttggcccgatctttcggtgagttgtgatatctacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatggaccccacctgggccggggtcccaaatgaagttacaagcccataggcccattataggtgatgcaacaccttgttcctgtgattctggccacacgagatagaattcagagaagaggctggatccgttaaaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaacgtggttacatgtgaggaagatgtgtcttgtgggtaaagatgtacacatctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcagtctgaatcatcgtaggccttgggttaaggcaggttcgtgtgggttcacggccttgattaataatattgtatagctctaggatcgtatttacaaaatagctttgagcaactaagtgtcttttaatgctgtttgctgcaaaccctaaccctttatattataacccccttgtactcccttggatttatcctgcacttgtgagtgtgtcttgttgagtacggtggttgtactcagtcttgctcaattttttcccaaacccagaagaggagcccctggataatgaaggctttggtgtctagctcgtgcctgccgtcaagcgcctgtggtcgtcgccctagtcttccgctgtttttcgtttgtctttttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttctggtcgtgacattttgtaacgaacaataataaatatgggaattgatttagtatgagcgagcgcgtcggttacagaattaaacaccgtggttgatgatcccgaacattactctcgcgctcgcacatactctctcgttttgtaacggacaataataaatacgggaattgatttcgtatgagcgagcgcatcggttacagaatttaacaccacggttgatgatcccgaacattactctcgcgctcgcatgtagttcgtctcttgcacttatgttcattgtggagattatggataccccatatctgcatgacagttatactttagtcggatatacggcaccaaatatagatggaatatctttatgagaactcgggttggtttttaacttgtatgtcaagaaaatatccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccaccccttttattattgccgaaatcttgtttcaacagttggcgtgccaggtaggggtagcgtcaagttctcgccgactaagtgcgatgggctttgtttctggcatcgacgacttcgccttccctctcgggcaggcgttccggttcggcagcctcaacttcatcaccaacgacttcggcaagatctctctccttgactcggattcaaaccagtcggggagagaccaggtccccgtgccattcggtattccgaactcggcctactctaagatcatctctcccgagtcggcttcaaaccacttggacgagatccaatccgctcggcctcgtccagatcaagacgacgggtcctatccctcaatcttgatgaaacttcctgatgatttggccgccgtcttcactgccaagacatctcccactcgaagatctaggcgagctccggcttcggccccgatccaatctagatccagggaggttggcgttatactccaacctctcgggacagtctcgacggaagagttggatggctacctcagctcccccggcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaggagcgagaacgactacagcgtgagcaacaagatcacgaacagattgcaaaggaggctgaagatcgacgacaacgcgccttggaatctgggcggcgagcgagagagctcattgggcaacaagacgtcgatggaacagcggtctttcacaccccccagcagaacgcggttgcagcaatcactctcctcgacaccctcctcaaggaagacgcactcaaccaagctgatcatgttgtcaacatcttgaaccagatgaagaccatgatcgctgcctcggttccagccaactccgcaagcacccgcactccgactggtagccgagtccctcatctccgatctcatgattatcatcagccaagcctcagcatcatcggcacaggatctagccgcaggagcaggggtcacgacgaacgatctgttcactcgcctcccgaacgtcacagggagcgccgagtcgaacggcctcgctctccacttcaccagcgtcctgtcgaccttcgcgacatgatcaaccagcgccgtgcagcacgaggtcaccgccattcaccaaatctctacgacgacgacgtggatggagtagctgccttcactaatgacctgcgtcgagtggattggccagccggctttaagccgactggaatcgagaagtatgacggcaccactaatccggagtcttggctcaccgtctacggactcgcaatccacgcagcaggaggagacagcaaggccatggcaaactatctacctgtggccctagcggattccgcccgatcctggctccacggactaccccttggcatgatcggatcatgggcggaacttcgtgatcacttcatcgccaacttccagggcacctttgaacgccccggcacacagtttgatctctacaacgttgtttagaagtctggagaatcccttcgagattacatctaacgcttctccgaacaacgcaacaagatctccgacatcaccgacgacgtcatcatcgccgccttcactaaaggcattcgccacgaggacctagtcggcaagttcggacgtaaacctcccaggtcggttaagcagatgttcgaaaaagccaacgagtatgtcaaagccgaagatgctattaccgcgtccaaacagtcgggcaccacttgaaagccaaagaaggatacgccgaccgcaggagagagtggaagtaacaaccacaaggatcgcaagcgtaagcccgaagaacttgtggcgaccacctctccatcttcctgacaacgttcccgcatcaacaccttcgacaagataatgaactcccaatgtccgcatcatcccaactccaaccacatggccaaagattgcttcgtctacaaccactttggagcaatacgtcaagaacgcacgtaaaccttcagacggagatcaaggcacatcaaagaagaaagatgatgaagacgatgccccgactggttttcaagatcatcgcaaataacttaatcacatcttcggtggacccctggcttatgagtctaagagaaaacagaagctaacataatgggagatcaatgcggtttagcctaacacgccccaatatcttcggtagttagaaatagcaattaagtttgaccgctcggatcatcccgaccgagtgatccacccggggcggtaccccctagtactagacccagtggttcgcaatgtcaagctccgacagactctcatcgatggtggcagcgcactcaacatcctttttgctaagaccctggactatatgcagattcctcgcacggaattgaagccgagtaatgcacccttccacggtgttatcccaggattgtcagctacaccactcagccaaatcactcttccagttaccttcggcactcgggagaattttctcacagaaaatgtttgtttcgaagttgttgatttcgagacagcatatcatgctatacttggacgaccggctttagctaaatttatggtcgtcccacactacacctacatgatgatgaagatgcctggtcctcgaggagtcatatcactacggagcgacatcaagcaggccgtcacatgtgacaaagaaagttgcgagatggcccaaacccacgagactactctcacccgcgaagagatccgactggctgcgaccacggcaagcgagggagaagtgcctgcaaccaagctgacgaagaccgaagaacgtgatgctaagacgaaaaagattcccttagatccctccgatcctgataagactactgtaataggcgctgagttaaattgtaaataggaaagcgcgctcatcacctttcttcagaataataaagatatttttgcatggaaaccatccgatatgcctggtatccccagagaggtgattgagcactctttacatgttaggaagacgccaaacccatcaagcaacgactccgccattttgcacaggacaggaaggatgcgatcaaggaggaattaaccaagctgttagcaacaggcttcattaaggaagtccttcatctcgactggctggctaacccagtcctggttcgaaaaaagacggggcaatggcacatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaagaatccgactgcttgaagacctcgtttattacgccctttggggcctactgctacatcaccatgccctttggattaaagaacgcaggagcaacctatcaacgcatgattcaaagatgtttttcaactcagatcggtcgcaatgttgaagcttatgttgatgatgtagtcgtcaagaccaagcaaaaggatgacctgattgcagatttagaagaaacttttacaagcattcgtgctttcaagatgaaactaaacccggaaaagtgcatcttcggagtaccgtcagggaagttgcttagatttatggtatctcaaagaggcatacaggccaacccggaaaaaaatcaacgccatcctcaacatgaaaccgccaagctcccaaaaagacgtccaaaagctgattggttgcatggcggcgctcagccggttcgtctcacgactcggcgagcgggggatgcccttcttcaagctgctgaagaagactggcaatttccagtggggactcaaagcacagaaagcctttgaagacttcaagaaacttctcaccactccaccagttttggcctcgccacatccacaagagccgctactgttatatgtgtcggcgacctcccaggttgtgagtacggtcctggttgtcgagcgtgaagaggaaggccatattcaaaaagtccaacgtccaatttattttgttagcgaagttttagccgactccaagacaagatatcctcaggttcaaaagttattatatggtgtcttaattaccgttaggaaattatctcactactttcaaagtaactcggtcacggtggtcacatcgtttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggggctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttggttgttaatcaagtcatgaaagagtggtcatgtctagatgataatatgaccgcttatcgacaagaggtatgcaggttggaaaataaattcgatggactcgagctcacccatgtcctccgatataacaatgaggcagccgacagactggccaattttggttcaaaacgggaagcagctccttcagatgtgttcgtcgaacatctttacgaaccgaccatgcccagaaaagagacagtcgaagccatggatacccaaggcgtaagcatgatcgaagctgactggagagaaccgtttataaaatttttgagcaaacaagaactccctcaagacaaaaatgaggccgagcggatttccaggcgcagcagactttacattatccatgagactgagctgtacaagaaaagtccatcaggaatactgcagcgctgtgtgtctttggaagaagggagacagttgttgaaggatatacattctggtatttgtggtaatcatgctgctacacggaccattgtcggcaaagcttaccggcaaggttttttctggcctatagctgtgtccgatgcggacaagattgtgcggacatgcgaaggttgtcaattttttgccagacaaactcatttgccagcccaagagttgcaaaccatcccgttgtcctggccgtttgcggtctgggggcttgacatggtcggcccgtttaaaagggcagtcggcggttacacgcatctctttgtggctatcgacaaattctccaagtggattgaggctaaaccggtcatcacgatcacagcagataaagctagagatttcttcatcaacattgtgcatcggtttggggtacctcatcggatcatcactgataatggcactcaattcactggcggagcatttaaagacttttgtgaagacttcggcattaaaatttgttacgcctccgtggcacaccctatgagtaacggacaagtcgagcgcgctaacggcatgatactccaagggatcaaagcatgagtttttgaccgactacgtccctatgctggcaagtgggtagatcagctgccgtccgtactttggtctttacgcactactcctagttgggctaccggccagtcgtcgttctttttggtttatggcgcagaagcaatgttgccgagtgaagtggaatttgaatcactacgattttggaacttcaacgaggagggctatgaagagggccgagtagacgacatcaatcgactagaaaaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccgggttcttatcgactcaagggcggagacggtactctcatcaacaattcttggaatattgaacaccttcgtcgattttatgcttaggcatttcgtttgtatctttcctctttgactactaacttcaagtttttccttgaagttttcagtcagggggctactatgataataatggagtgtgatttttatcaattcaatttgcttacttgatttatcattgccatgtttggtctttcgacttagccaatgaggactaaaggtttttaatagcttttgcgggttttaggctcaataagacttgacaaaggcttttaagaaatcagaagctaagtatggaacaccaagcatagcataaattcatcagtattgtacaaattgagcctccaccgtcattgatcatcaaaatcattgttatatcaataagtatcagttttttcatcatcagacttatcagacccagtcagccgaaggtcgatatcttggaatctctcaactacatcagcagcaatcttgtcagcggctttctgcgcatcactgatgaggtcaagagcagcttcttcgctcgtcccgtttgcaaagccatcaatggcatccatatcaacccttggataaagggatttggtcatcgccaacgccagacttgctcccatacttccagcttctttgatgttcttgaaataagtatctggagcgactctcagcttgtcaaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagacttgatcttgcggtctccatcaacagattcacattaatgaatcagcatatagaagataatggcttttgaagtattgattattggtaccttcaacctcttttaaaaccgaatccctctgtcttgccagctcagccttgtcattttccagagtttggatctgcttctctagttgagatatcttggcagcttgcactgcattaacttcggttaatcaagattacagagataatagcacaaatcagttgggcagagtttgcgcgaacctagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcagttttcgcctcgttcctaagatgaatcctctgcggagcagtttaatcagcgctcgcgccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggctgctcgtatacgggggatttcttcttcatcaccaatcattggtcctaatgtattcactgacaaaggttagacaattgatcagagttatttgggtcaacatggtttcagataaagtgtttacccgtaatgatttctggacgaggacgagtggatttggatgcctttaaaggagatctagatctctagttattgctggcgttttgtccgcgcgggctgtctgcttgggtttcgacttctggaatctcttggcttggccttgcgtccgactggtttccagtcgggggctcctgattaactccggcttcggcttcggccgactggtttccagttgggggttgatcaccggattctacattatcggttgccggctgattgtcactcagatgatccccagcagttggcccggtttctttggacgaacttgtgttcatgttagtcgggtcagagtctttcccagacggatccatatcaaatggtttcctgcaaatttaattatcagtattattgccgcaatgggtgcgcatcaatacaagagagatcgttatatgagttgcacctagaagacttcctgatctttggcacagggcgattggatgttttcttccttggagtagcctgttttggtagtttcttggttgtctctcggtcttcaggcctcctggtggtatcatcggcttcgtcgtcacttaaaaccagcttcctctttcgataatcggactggccgactagatcagaagcacttggttgagtttcagaccgaattcttggtcctccgctcccttgcccagtttggtgacggggagatcggcgttgagcgattgggggatccgacttcatcaaagcaaattcctgggtgtaatatccttcattgttaactgattcaacaagaaaacaagatcatattttgagaaaggttgaagtgtatgaatatgtaccggtggaggaggattgaatgcattgaatggtacgactggcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaaccgacattggataaagtgccgggtgatctgttctccttgaaggccctgttctttcagctttatcatcctctccatcagttctactgcttgtgcagcttcgtctcccattggcagtgagttccaagtatcccgataaactggaggaagacaggagtactcgggaagaacaggcttggggttttgaacataaaaccagtttgcgtgctagcctttatttgaggtcttgaagggcatggagaagtatttttggcttagtgttcccctgagttggaaaccagcacccccaatgatgcatggtttgatcttatttggctagggcttgaggaagaagatgcggcggaacaaggcgaaatgaggcctaatgcccagaaaagcttcgcaggcatgaataaaattggcaatatgcactatggagtttggattcagatgatgcaagctaatcccgtagaaattcagaatgccccggaaaaatcttgaggttggaagagaaaatccgccatagaagaaatgagcaaataccatgatttcgtgtgtatcgggggtcaggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtttgatttagtttgagatacggctggaaagggatggggaatcggagcgatggatgcggggagaaatttcgtgaagtttttgagggtggatttgagcggattgatgaaccctagtttgcccggcgcagttttgcactgtagcaggaaatggggaaaatggcgagagtctcggcggggaagacgaagagacgtttttcacttcggtattattagggtatcgggagtactaatgggcctgggcctgtatagtatttcagcccaatactataatcagcgtggcctgttgtgatccctagggacttaggcactttttgctttggtaatttatgttcacaatggtgtggcctaatgctgttaaaatcctttttaacgcgatttaataattctttggaattattatgatgcacataaaaaggtgcccgacagaaaggtgttataccattttttgtaagctttattaggctggaaaagctgattgggttgatttgagatgactggtttattaatagtcattcttttagcatgttatatgcttattttggttatggtaagggtcacagcctaggctattagactcattaattaccatgattttctatcatgtttggtgggtcattctatgagatttttactcggattcctatcaaacatgtctatttttggacctttgagtgtttatcgctcggcccttcttgtattttttgtccttgatatgttcaagttgagcagcagtcagctgggtatcgtactaagtaccatgcatgcttcgctataaaactactcggttcttgactatatgtttagtttttcaactaatcacatagtcgggggctacacctaattaggtgcatctactcgatgcaccatgttttattttcgcccttcacagtttttgatttctagtactcggcaagctggagcaagttgaattgaagcactcggactactgttttttgtttcgagaaggttatttcgtcaactgcgaaggtctcgggggctactgtggagattatggataccccatatctgcatgacagttatactttagtcgaatatacggtaccaaatatagatggaatatctttatgaggactcgggttggtttttaacttgtatatcaaggaaatacccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccactcccttttattattgccgaaatcttgtttcgacattcctccttcggccttgaacgttactctcgcgctcgcatatactccgtcaaaggagcgaacaaaagtacgacaagttcttcagttcttcccgtctcttgcacttctgtgcatatactccgccaaaggagcaaacagaagtacaataagttcttcagttcttcctgtctcttgcacttctgttccacctccggcctctgttcctacgctgcaagattcttcctcggttccgttcacctgtgtgcacaggtgtacgggattcttccccgtttccattcatcggcgcgcacagttgtacgggacgagcaggtgccttcggaactccgttcgcttgagaacctgcacgggtaggcgagagatcaagtttttggggagcgctacacgcgattgctcctgttcgtcttcctctgcatcgtctttgccaacatgtcgaacaccggcgataacatcaacactggagccaaggagaaggaggctcccgtcaacaccaacggaagcaatactgcctcaaactctagcggagggccattctcggggtataacgttttactactattgttcgttcttcgtttcctgctagtgacagccacaatgtcattgcgttgtcttgtttatgttgacgcttattttatattaagcatactcatgttgtatacatttagcactgtcactagatccacttatattgcaaagtcatgtttattgtcttaatattttggattaaaatatgccaaattatgaccaaatttccaacagcgtcaaggggtgtttgcatgaccctaaacttcatatattagtagctgccaccacttttagggtttgggttttgcttagattaatctgtcagaacagattcgtcgatccttcggtttgtgagagccccaacttgtgagtttaatcattcatatataatttggttgtattcgtttttgttcttgtttgtgttcttcgattcgcaagcagggattagccttctcggtgaggtcaaccgggtttcgacacggttgataaccaaaggagacgtggtgctgcgattgcggggcttaagagcgtgtttgtttagaagttggatcgacttgtgtcgcgactccaccaaatcgactgtttatcagaacctttcggaagatcgggaacccttgtccacatcaataacaccaacccggactaaaaaatcgatctttagttctggttggtaacaccaacccgaactaaagatgcctctaagattagttcataaggaaagcatctatattctagtcagatgtgtgtagtaggtgtgatggttacacgcgtgagtgctaaggtgaaagatcataattatcctttcttactacataaacacactgttgtgttcggcatttgagcaagaacaatagtaggctacaagtctgctataagcatgtgtggaatagataagagaggatagagaaggaaatcaactataagcatgtgtggaagagataagagaggatagagaaggaaagcggagcaggtacaatagtaggctacaagtcagctataaacatgtgtggatgagataaaagaggatagagaaggaaagcgagctacaaatttgtagccagctgcagcacgtactccaaaacgttatgtgtgtatgagagataggaccatatattaatgatgtagtatatgtttatattatatgaatgaactattaaatttgctatagatgatttggagctaatagttggctatactattaaacttgctcttacgaaactgggaggaaaactaactcatttttcgtgcacatgcttcccgaactgctaaacggtgcatttttttaagttttctatatgaatattgctttaaaaaatcatattaatctatttttcatgtataaaataattaatactcaattaattatgcgctaacggctgacctagtttttttttatcttctcaatcttcttcttttccctcctctcaaacacacctactgctataaaactcaacttctatgagaccagatcatcaagattatattatccattcgattgaaatgtctttctctatcaattatcatattagcatttctcaacaaagcgacagggccatggtattgccccgtcttctcattattttcctacttcttccatccccatgcccccggggtgccactcaatgggctcgatgtgcacaggaggatacccaatcacgcatatcggggtagaggcatggcgctcctcattcgtgcatctcggtggcgattcaaatgtccaatggatcagctttgtctatcacaactcctcatctactaccaccacagacaatgattaatctgtgacttgttatccttgtatgacacttcccaatccgttctagttttgccttttttactagaacagtttaagtttaatccctctctcagccaccagtcccacaaagtggcaaatctattgccgctcacccctccagagtggtaaaaagttgatgattactatcaatgtcttgaaatcaatttgttttccaattattcattctttgtctgattgtcccccaaccatttttttcaattgctggtttatctcccatttggttcagttgatcttcattatattccggacctcaaagcacaggtaagttatatgttttaggtgaagctttaattctagggataagtccatttgaccctccccccccccccctcaacttttcacttcgtctaaaatacacccttaaagtttaaaaccaggtattttacatccccgaactttcaataccacgcagtttaccccctgggtggtttctatcctagtttctgcaattaattaatgagaatctccggatctgcaattacacataagaaattgcattgaattattttcgatgtgtcttgaataagaccgtcacgtagccggcgagcagctcgtcgccactggtgatgatcgcgtcatttaattgatcaatcgaaattgcatgctcccatttaattttcgatgcgttttgctgtgtaatcgcataccgctggagttgattgatcgatcgaacagcaagatgacgaagcgcgccgcgagcagctcgtctacgccggtgatgcacgcttgacagtggaacgtgcggtttcgctatggacggtttgcatggatcggtgatgctccgggcggctgccgctgccagtacaccatgcaaggacagaaactccgtcgccgctggtgcgtcgagaaggtctagcgagagcaaccgatgcgtttgcattccacgcttcgccggcggtgcatcgagaacctccggccgtggttgttcgcattcgccggcggcgggcggggcggcaaagacgacgaccaccacgggccacggcggcggggccgcgggggcggcgtccgtgaccgcaaccgcatcctcatcgccaagtgcgcacgctcccagcggtgcggccggcacggggactcgtacacgcagtcggcattcgacaccatcctcgctggctacgtgacggtcttcttccacctagactcaggctacacccagcaccagtggcagtgtggcacctgctgcgcaagcgcaaccacaccacatgcatggcgagctcgccatcgctcgatctacttccatggtggagctcgacgaggcttcaaggtcggcgccggggagctccagttgacgtggctctcctctttgcgctgtctgcgcgttcataggcatcagcgctcgagctgaccaacccggtggctgctggcttgggaagagggagaggggaagatgaagaatcagtctgagatgtgggacattaattattttctaatatattttgctgacttagattgacacgtcagcgccacacattggcgaaaccaccatatttcaggacgggggggtgatttgaatggttttaagaattgagggacgtattatacccggttttgaagttaaggggtgtatttcagacgaacgctatagttgagggggtaaaatggacttatcccttaattctatggtcatgccaatcacaagtgcaagtcccctcttatatctcactaaatagaaaaggtttccttacctttctatacttttatttatctttcatttcttaccattaatcacccacaaagatcgatttcataattattcaatgatcgattcaggactaaatcaaattagaacatttagaatttttatcctacaaggagacaacctatatatttaattgctttctttaataattagaatcatgtaaataaatgaccatatgttatttctatgtcatttttattttatttttttcatagatataagagcaaatatgagaaatgtcattgacaagcggctcattctataatcaaactttggtatctctattttgtagtaatactatataaataaatgaccataggtttcaagtgatttgtgttctttattatgtgcattgagaataatactttgttatctctattttgtagtactagcttatggacgttagagcaatgttatcttatcattggtcgatcctaatcgccaagggactgattaggtcgattaatcgtcaattaacctcaattaatcacctgatcaatattttgtatacacggactagtacgggcgtgtttggttacctgcatgcatggagggtggctcgcatgtgtgggtgcaagaggaggttgtctggttgcccgcacggtcgtcggggcttggatccacgcatgcaaaacggcctccgcagctaggcccgcgagaaacgcccgagttgagcttcgctccccatccaggctgcgcttgtgcaggcggcgtgacgtgcgggtgcaggcgcggggatacacagatgcaggagggcgagaggggtcgcgctcccttcacctcactcctcctcatttgctcgcttggcctctactcggctcatcgccatcttcgtcgccgcacagccatcttctccaccagaaacttgcctggggcttgccttcctcctcttcttgtcgtagcctccaccaccttctccaccagaaactccacccctcctttctccagcgactggaccgcgcggatccggtgcccacaagcttctaagcggtagatctggagcggcggcgacaccatggtttggggtgaggccgcgaacgacgagcggccaccagatttggatgctatgaccgcgggaagtgcgcacagcaagctccatggtgagctgcagcacaagcgagccaggggcgacgctgcaggtgagctgagctgcaggcgttggggatggcggcgcggcactgtggatgtcggcgatgtggacggagaaatctcgtcaacgcggcgctctttcttctttctttctcttttcttttttttttcttttcatttttttcgtctattcatgagtaaatgctgtgcatcaatgctgtgcaatgcgcacaccttttgaaactaatgattgtttttttcctgtttttttaattgtattttctatctgtttatgttgtctattaaaaagtttacatgtatataatgttgttagagattttaaacaccattattactttttacatgtgataaattattcatgtactcgttggttaatccattttttttcatatgatgtcgcagtggtaatcttacctaaccaattgaataggtaagcacactcaaattcatacaaccaaccaaacaaaatctcccttaaaccgtatttctcatacaagcaaccaaacaatgtcttgtgctagtcaggctgaacccatgcaatcaaccaaacagctgcatgtgtatctcctcaaccaggctatactcagccgataagagagatggaccaggctagagggtgcgagcaaccaaacacacccttaagtttagcattatatacatgtaaactttttaatagacaagatgaacagatagaaaatgcaattaaaaaacaggaaaaaaacaatcattagtttcaaaaggtgtgcgcattgcacagcatcgatgcacagcatgtactcatgaatagacgaaaaaaatgaaaagaaaaaaaaaagaaaagagaaagaaagagcgccgtgttgatgagctttctccgcccacatcgccgacatccacagtgccgcgccgccgtccccaacacctgcagctcagctcacttgcagcgtcgcccctggctcgcttgcgctgccgctcaccatggagcttgctgcgcgcactccccgcggtcctagcatccaaatctggtggccgctcgtcgttcgcggcctcacccccaaaccatggtgttgccgccgctccagatctaccgcttaggagcttgtgggcaccggatccgtgcggtccagtcgctagagaaaggaggggtggagtttctggtggagaaggtggtggaggctacgacaagaagaggaggaaggcaagccccaggcaagtttttggtggagaagatggctgtgcggcgacgaagatggcgacgagccgagtagaggccaagcgagcaaatgagggggagtgaggtgaagggagcgcgacccctctcgccctcctgcatctacgcatccccgcgcctgcaccggcgcgtcacgccgcctgcacaagcgcagcctggatgaggagcgaagctcaactcgggcgtttctcgcgggcctggctgcggaggccgttttgcacgtgtggatccaggccccgacgaccgtgcaggcaaccaaacagcctcctcttgcacccatacatgcgagccaccctccatgcaggtaaccaaacacgcccttagaaggaggtgtactaactgtcgaaggaggagctcatcttcctagtgccgacggtgcttgaggcttgagtccttgaggggcggcaccataggagccatctagctcggcagctctagcagcagaccaggtgaagggaagagagagatctaggcagcagcaggtctagttctagcagcatatcagggtggcggcttgagagagggcgacggcttctgagaatagtggtgacatgcagtggcggatttagtccatttctgtggggtcggctgaccccacagctttttgaaaaacatcttataaaccttgattttcatgtataaatctaaaaaaaattatagaaatgaccccacttaaatataaaccactagtaattgaccccacaggtataaaatcttggctccgccactggtgacatgccctcatgactaaaccctaaggagaatggacccagcttcacatgcagccaagacttgttgtgagatcaatataggtgctctaatcggacgattaatcgtgcctgatcgccaattaatcggacgatcaaatttctagtcaacctgattgaatgaatgcccatgatgggatgattaatcgtgattaattggacgatcagataagatttctttatagattcattaattaattgttctgaggtggatatcaatttgatagtagatcaatatcgataggtacgataatttggtctttggtaaaaaaaatgtgcaagatataacgtgaatggagagaagaggagaagtcacgattggaaggcaaatgttcgtgaagataggcacatatatgtatcgtacaatgtcctctccgcttgtcgaaatgcaaataacatcatcgggggatatgatcatcagttcacgagaacagaggaagaaacaaaagctaaaaattaaaaccatcaacagcccgatcgagtttgcattactagatacacacattgcagccttccttccctctctccatgtatcgatatatcaacccggcacgcacaaaacatttgttcattccctactcgagctgcgcgtaccacaccccttggatcttgacatccttggcaccttggcgccgaggtctgtgtccgacggctgcacgctctcgaagacgccaatcacctcgccggtctctggcttgctcttggtgacgctcaacgtgatgttgcccgtcgacgacgaggcgttcttgacgttctccttagcgagctcctcctcgtctcctctgcctccggcggggagcgccacagcgttgtcgtagccggtagagccaccgcggccctttgggtcgaggaaggacgaaccacggtagctgggcacgaggaagggcccgccgaagctctccggcttgccggtggcgaccagattcttgatggtgaagaggaacggcacgcgctcgcctcccggcagctgcacggtgacggcggcgtagtcgattccgtccttctcctcgaacttgatggttccgtcggagctgacctcgagcgggccctcgatctcgtcgagggtgtaggtcaggcgggtcatgagcttggtcttctggaactcgggtggcgcgttcttggccacgccctccgccttaacggtgaaggacgtcggctccaggcagaacttcttcatgttgtacttgccggccttgaaggcgaaggagtcgacgccgccctccaccgtcgggcactggttcgccgtgccggttcccttcacctccatgtacgtcttactctgaatctcgtcgaaggtaagcctcctcggcacgccctccgcgctggcgccctacaccggccggccaccacatgcacggcgttacatatatagtaattcgatcgtttccaccttggccttggccatggcgccatgcaacatactcctaaatcctaattaaggtcttaccgagacgagcagagctgaggtggcgagggcgaagccggcgagcttggcggcatcggcgcacttgttggcgacctcccggatgtcggactgcagggagcacgtgatcctgccggcggcaccggtgtcgacgccgaacgccctggcgacgtgcgaagacgggcgcgatggcagcgcggcggaggaggcccggccgccgagcttggccggctgcatcagggtggccgcggcttggagcgatgctgccatgtccgctcgctcgcctgctcagctctcagttggtgggtggtgtggccgtgtccgtgtgggttgtatcgtgaagggcgttttgtgagggcgggacagtgttatctatcgcagagcaaggggggcagaggaggataagaggattggataaggcgtggcctcccattggtggcttggggctatggtgatgctgagctggacgtcgacgtggcacgcccaggtgccactccttccccggcgtgtggtggtgggctctttcatttgtggggctggcgctgtgaagatcctacttccagccaacgaaggcttgccacgtcaggaatggagagacaaacgaacctattctcttgaaggcacagggaacccaaagaaaatgctaaaaattaaagatctcgctcataagaccgacatttgtaatgtgttagatgaaacaggaattataaaaa

SEQ ID NO: 59103 - DNA, 13203 bp, Oryza sativa
gccacacaccgccgcaccccaccatcgccgcgccgacccggcgagaagggagggacggcgccggtggcgggggagtcggccggctggggggagggggagagacgccggtggggagagggagggggagaggcggcgtcggggcgggggaggaagaggcggccggctcggctcggctggggggagggttagggttagggtttcatcaattttaatctgatctgagccgtccatcaaaactaacggctgagatcgatcgagggtttgggccgcacgtgggcccgcggtccactaaatgaaaggagtatgggggtattaagtagactttggtctcttgcgggctgaagaagaaaatgggctgaaaaaggcccatagagaaaaaaggatttttatttagatttttatttcaataaatgctgaaatgatatttgtattatcaaaattagcaattaagctaggtaaattccaagaaaatttcaatgagtgtaattaatatagaaaatttaataaaagttaaatccaaccacaacattttatttcttacacttactttacttataaattaatttaattgtatacctacctacttaaaaaatacctaaatatttcagaaaatttatatttcatttaattagaatttaatatgttttaattcaactttatctgttttttctattcgttgcaacgcaatatcacttttgctataatttaaaagagtgtaattaatattgcagaaaattttatatttcattaaattacaattcattttcttcatataaatagttcaaatcaaatttcagtcaccatatcattacccggtgcaacgcacgggtattttgctagtattatacaatatttatagaacttttgcaaaataaagagcgattaaaatttaataggctgtgtcaagtaaaaaaaacaatcaaatactaaaagatatgttacgtactcccttataagaacatctgttagccaatcaaatcaaggtatatatacatatttaattaaaatttaaaaattgataaggacgcaaaggatatttcttgccactacaaatttgcatgagaattgctagaaataaagttttcagggttggagtagaattttttttttgttagttctactttcgtgagaaatgccccgtcattgtaaggtctaaaacattatttgaaattgggtataggtattaataaactaggtgagtttttagataatggataaaatccagtgtttacttcaatagaagctatagccattattacatagttcttagttgaaaaccaaatataaactaggtgagtaagtggaaaaattaaataagaaatattaaccaaatataaactaggtgggtaagtggaaaaattaaataagaaatattatgattggttgagacaagggactggatactcaattgctatattctgatataaactttgaatgcttatattttgaacgaggaaaagatgttcttttatcataaattcgatttggtcttttttatatatatataaaaaacgagtacggtcgttatttaaaaatgtccattttgtaaagcttatttttaaagaccatggcttatttagctgaatataaagctcgataattaatatttttaaaataagtacattttaaataatgtagacttacataaaaaaacagtccattttataaagcttatttttaaagaccatggcttatttagctgaagataaagcttgataattaatatttttaaaataagtacattttaaataatgtagacttactaaaaaacactttttaatagctatgccataaatagattaaaatatgatgatttttaattgaataaatctacatgttaaatgaacaatttaatgaagttggcctaatcctaccaaaatcttttgaaatttctacgttcatgcataagaacatgctaaatggggcgcgccatttggcgcgagattttctagtatagtactaatatttatctgttcgacgcctccaaataattcgttctcgtgtagtcgtcagctacgtaccgaaagctttgcgctttgcatgcagcaccatcaccatctagttctactaataaccagtaagtccatacttctcgatacaactatggattaaaatataaacatgtaaatttaaatgcaaactacaaaataaatataaacacggatgtttaaattcaaactataaggtataagaaagaatacattcttaatttgtagattgagagattgagttttaaattgaacgttatgaaaggatggaatataggtttacttaaaagccgtgggatcggtggaagactaccagcacatcagcaatttttgcaaaaaaaaccctacacttttggttaattacgcaccggtccccgctaatatccgccgtccgatctcgaggtagggtcgatctggccgtccacgttcctcactgtgctggcccttccgcacccgtgggatcgtcggatctctaacggacggtgtggatttcgcaagcctgaacaaaccctaagtcaaggtaaataatatccaaaaatagaaaaaataaaagagagttcaagtaggaatacaaatttgaaacaactgaaattgaaaataaaaaataaaaatattaaaagaacacaatacgatattaattaaaatttgaaaaaaaaaataaattccaaaattagaaaaagaaaaataagatttcaattaggaatataattgtatcgctgtgggggcaagaaattcccacattaatcggagaaaaagaaaaaagagtccaagtagaaatacaatttaaaaatagctgaaattcaaaattaaaaataagcaatattgaaagaagagtccatataagaacacaatacgagattaataaaattttaaataaaaataaaataaaattagaaactagaaaaaaaagagtccaagtagaaatacaatttaaaaataactgaaattcagaattaaaaataaggaatattgaaagaagagtccatataagaacccaatacgagattaattaaaattcagaataaaaataaaataaaatcctaaattagaattaaaataaaagaatatttcgtatagaaatacaatttaaaaataactaaagttcgaaatttaaaataagcaatattgaaagaagagtccatacaagaaaccagtacgatattaattaaaattcaaaataaaaaacaaataaaatccagaattagaaaaaaaataaaaaagagatttcaagtaggaatagaatattgaaacaatccaaatatctactattataaaaattgaagatgtttccacagtcggtcatctgtgtttgagtcggttataaaaaattgaagatgtttccgcggttcgtcatccgtgtttgagtcggtttttttttggtattaatctatatctcttatctatctcttctctactattataaaaatttgttaacgaccatgtttttatcggtattttggtaagtcatccgtgtatgagttggtttttaagtttgtttgcttttgaaaatacatatccgtatttgagtcggtttttaagatcgttcgcttttggtaataccgaaagaatcatgcaagaaatctgtttaaaaaactcgcatgctaacttgagacgatcggactcctaactacagctcatgattttctaaaaaaaatatatatccaagcgaaatcccacagtgtattttatcttaactaaaccattgaaattagaaataaaaaagaaaaaatattaagagaatagtctatatagaacacaatacgagattaattaaaattcaaaataaaaaataaaataaattcaaaagatagaaaaagaaaaaaataagagctcaacttgaataaaatttataaataacttaaatttgtaagaaaaaaataaagacaattgaattaagaggcaatctagaacacatgatgagattaactaaagttcgaaataacaaataaaataattttcaaaaataggaaaaaaattataagaattgaagtttgaatataatttatgaataaaaattatcggaatgaaaaatatgcaatttttttttaaaaaaagtccatctagaaaacaacgatgacaaatagcattaaaaaggggagaagcaataggcatgtaaaggagtagagtgttggtggttgatgggatatcaacaaaaactataaacaaaaccccaaatagaatcacaatgatgattaagaggagtgacgataggtatgccgttaagcagcatggtcacgacggttggcgggacttatggataattaaaaaaaccacaatgataatcatattttatgtttaaaatgtcaatggcaataagaaggggaagcagcgggtttgctgtagaggagtatattggtgaagccactaacgattggcgagacttatagaaagtaaaaaggaacacaaataataattatatttgatttttaaaatcccgatgacaataaattgaggtggcaacagatggccgtagagtagtaaattggcgatgtttgacgatacttctaaaaattatgtaaacgaaacccaataagataaggtactctaaaaactataaggcctaacttttaaagttctcaagaggatgaatagaagtagtgatagatcaagtaagcaaataaaaatgtgacaaaggagtaaagggtagcgactggcgttgcttttaaaaactataaaattattagaatagcatgaataataattttaaataaaattatgtgtaaaaatagataattttaaattgatgatagccgtgtagttgtgcgggtcatccaactagttttaataattaagggagttttatatcagattttatggttaagggactcaaataaaactacatagttcatagcctaaagtggactttttaaaaaaatgaaaaagaaaagaaagaagttcatttgggccttctcggcatggccaggcgcttaattacagcccgcaacatgtcaggcactcaggccgggcctcgagcccttgatcatatccttttcttccttgtccaccatccccagttccccatcacaaatatcttcccataaagaaaccctaggtgctcattccaccgccatcgcctccggcgaactctccaccgccccctttcctacatcccaccactattttataagccagcccttcatctcatctggagatctggttctactcatccaggaaagccccaatctttatcatagcaaggaggtcatgtcggaatcggccctcggtaatagttacatcaaccaatttttgttatttcagtacttctttcccattcttcttcttcttcttcaactcggagtcttctacggtgtatatctcttccatctccaaaattatttgcgaatcgccctcagatctggagctgttcctcatgtcgaaatgtcaaatctataattctgatctcttctgaaacattcagagcctaattaccgatttgatttcttttcggcgtatctagtacagcaggaggtattgttttgttgaacagaaacatcaatcttattttttgatttgttcgatttccataagttttacacatcactcgttcaactagtatgtgaaaaacttctttttaccgttcatttcacatatactagataaatatctgtgatttgcgatggattaaaataaattaaacgcgtgctaatattgcttggaacaaattaattgcgaggttttggggacagtttcgtgcttgtagattatgtagaaggactattttgtaatattaaaacacgaaggagtagttggtaaaagaaataatctatacaacagagttggtgtggtggccgattcactgccaccaccactgccttctttaagaatgaagtataggtttctatactattacacacaatattattatatccagctgtgggggtggaaattcaatgaattcatcaatttcagtgatgcatgtgccgtttgattcaaaatatatgttgttgcagggtatggttcctaccagtcaaactattttaactttgaccatcagtatataaagtactgcacatattgacagtatattcatcacggaaaatactcataatatttaatcatctttacttgaaatatcatgtttccatagatattgctagcctaagtgccactttgtagatcgtgtccatgtcctaaatatcatttattttgtcttcacagtcttaaggatcattgtttaccaattgtatattatattatattactagcagtacaaagttatgatattcttttgaatgtaactagagattaatcctccttgttacagacaaacatatagtggtgaaaattcccgatcattttctgccagatgctttcataggagaaagtgttggtaaaggtaaagaagatggagcaaccgtagataacatggacccgtcccgcccttttctagttatcaagaagtctgatttggataaggctgatgaggtatggtagcccatctgcactcttcctctaggtttctgtcttccattggtacctggctgctgacattctctcttccagtgggttaaaataaaatatgcttggatggccaagtccttaacaaatgatataatcatcccagaccctacccctcaggttgctctctagtcttcatgtacagaattcagttgctagatcatcctgttacgtttgtccttttttaatcctgcagcattttagtttacgtaagttgtctcttccattttctcaaaaaaaaagggtgccctttgctgaaatgaaatgttttgtcatgaaggtgcacggcaatgagactttatgttttgctttattacattgaaagctgatttcttttcatctcttctgattgtgaacggaccaatttaggtggtgcgggatgccttctttgatatatctccccgcttggactccgtcttgagaaaggacagtgtccggtgcttcttccgtttgttcgcggaatgtactgcggccatggcatttaagtgtaacatcacctcagaaaccttatcctgcattgtcaggcataatgccttgcgatgtgcgaaaactgtattggagggcaaggcacctcagctcagttgtatgcatgccaatccaaactgcattaacccatatggaatttttccactccatgaagctgctgaacggttctctgttgacatgatcaagttgctgttctgccatggtgcttcagccaatttacacacagtcaatgatgctggcattcccggactactcccgctccatgttgcagttggaaatacttgcttgcataaatatctggaggacaatctatctcctgtgcagtatcatgaggattatatctacaagctcattcatctgctgtgtctacctgagatggtttgtttcacttaacgctctttccaaagtatcatcttttcagcatgacaacaaaatgtgttcctgtttgtcatcttttaaaaattttcacatgtgctgaggcattttcttatttcaaatttagaggcaagaagtcagcagttcaaaattccattactccctccttttctagtcattgtagttttgtcctaagtgagctatctgtatctgaccgtctatttctggtcatatagtttaacacattaagatttatgtttttatattcaccatgagaaatactttcataatatataatttgcatgttgttaaaacacacgaatttatagaaattgatggtcaaggatataaatatttgactttggataaagctagtaatttgtaacagaggaaatagctaaatgctccctccgtcctataatatagcaatctaggaccggatgtgcatgtccagattcgttgtactatgaaatgtctcgtccggtcctaggttgttatattatgggacggagggagtagtaggttttattccgcttgatcctagttcatccttgctacaattagtggaaacgagatgtaataggaagtaatttttcactgcttgcttgcatacaaatgctcaaagtcatttagatttcattcctttgccttctttttattgtgcagaaggtttttttggatacagttagactgcttgctgaaaaaacagataatctagctgatgagctctggaattacatgaagaatgacaagcttgtagaatccgcagttttactcctggcagcccgaaaacatatccgtgagggcaaacctgatgggttcgacattatcgcgcaacgtatatatgaggactatgattccctagtgtgtgataaaggtgatactgcagaggggcagaagctgctggaggaaagaagagcacttttgaaatgtaaatgtctgattgtcactataatttcgcaagctggtgaggttttggataactacattcaagcacattcagaggtactattgtttttttaatggtgtaaaatcacagcaccatatgatctcttactcactgtatattttttcatattggtattaatattttaataggtaattccatggctccatgccctgatcctaacaagaatgctagtgatttgttgatttccgtggccactttccgttacttgtactatagggtagcatatccagcataaagtgaacggtcagtccagttttatctatcttcaacattgtgttaaaaccatcacaagagtaagctgtctaatgaagcttatgagttatgacgtaagagcctccgctgctttgagaagctggagccctctattgttagggatgtgaccttagcatgttgcaggagcttctgtaccttgggttattttgagtagtcatggctatccttgaaacatattaaattagattactatcctctggttgatttgagataggtttgaattagggcatgtatacaacagcaactaatagcaggctcttagcattggtaacaaggtaaagtttgctgacatggatgagaggggaaaggagggtgaaacatcgttgttaagcttaacaacggcttaacatcgactcttagcgtttataaaaggaaactttgttgcatgaggatagataaaagaaaagaaaagaaagataacaaaaaaactgttttggtgcattaatgtcagaaccttttgtcgtcttatctattgtaagagatagtatctgaatagagcctgtagcagactctagctggtgattggtactattatttggggcatgccatttgtcaagtaatccctgtgaaatttcctccctcgcccaactctagtaccatatcccctacaatttgtcctgttatagcattactcaccagttcataacaactactagcttcttaggggagccaggttctgaaggctcacccttccaaaagaacaactttagggtattcctgtcagatgctgatatgcattctaatatctgagttgtggagatgatttaggaaacaaatctcaaatagtaataaaattttcatgcatttgtatcaaccttttgtgttagtgatttatagcgtggaaatattattgcatttcaattcaactttgtattggatattatgtgagttgttttttgcttttgcttcaagtaaccaaaactgatttaacattatttacagaaatgtatacgaaatctttgtataaaaatgtcaatttatatcaattttattagagatgcaacaagcctctttaatcgtagttgtaaccacagcgcaggcatatacagagtaactgtgtacactttttgatatattttagtgatgttggccattgcaacttttgcatgtttcatgaatacttgtgtgctattatctccttgtgaattttcttgatgcacagcacataacggcaaaaaacgaaatactttgcgtattaattattggttcatggcggcaagtggcaaccaataggttttgttattgtcttaagctgactacatttccctgaggatattttgatattgttgacacaaacaagttggaaaagttaaaaaaaatatattggtattagtggtgattttccctagtgcaggctcatattttgcatattttggtagtatatatgtcgcatgattaggtccacaacaatgaaactgacctgatgaagttcatgttagcgagaaccactatcatgttgtccaccatgaaatatgatttagtgtgttatttgtccagtttataaatttggggtaaaaaacaactagtttcttagttcagggcatatgcttcaagaaagcactatgagcctaggcccaaacacattacattaaaaaatattgaaaaaaattacactaaaacagcaacagaacaccacccaaggtagttcatctgcctaatgcaccatgtataatgcccagttcaaagttcagggtgaaaaatggactacaaggaaatttcaaatgccaaaaaatagacttttacctttttataatttatagtcaattacagttaccaagttgaaatttgaatgactaatgttcatgccttgtaccttttgaaccatctagtcgtattatttggttcctaatcctgaatatagttaaggcaaacgaagagaaatagttacgtaattttgaatatgtttgtatatgtactttattttaccaagtaaacttgtattcgatgtgattgcaaactgttctaccttctttcagttcatctgttataattaatttttctctaaaccattcttttttgtcatttctttgccaccaatgatatcattgtactacatgatcatattatcaatatatgcactttattttaccaagtaagcttgtattcgatgtgattgcaaactgttctaccttctttcagttcatctgttataattaaattttatctaaaccattcttttttgtcatttctttgccaccaatgatatcattgtactacatgaccatattatcaatatatgctatttttatgtttcattttctgacatttttcactatctgatataatggttctaatgtcattcaggtgcccaatgtggaggtccttgcgcgtgtttcatatattcttaaggaattcgggttttgccctaacgaagaatacattgacaccatgatcctgtactgctctttttgtattcaatataatattttttttctatgcaaatgtttgttgtttattaattatttcttaaacttgttattgaagctgtccatataacaagatttcttacagcgacatagttcacaaaggtgtgtgtttattatttaagtaactgtttctgaatttctcagaaagagcctttattaaattttttatggtcatatagatgtaaccaaggctgttgcacaaatgtctacttctctgcctgctgcagaaaaaaaggtaattgtattccgatgttaccaatgatgatttcttatattcaccttgttaattattgtgcaacaatgcgtggggagtatgatgtaccaaagcatgcagggagcagcagcagctaatgatcagttacttaggttccaagttaggtttgctattagttgccatcttactggctggtgcatataagccagagtgcctgccagatcattatcttgtagttgggattctagaaaagtagaaactctatgtctggtctcttctctatcctggtaaaaggttgctcggcagtttttacagcagtgcgtcattctagattatagtactgtcaacaatctgaaaataattgattttctccaatgagatagaatgttttgctttaagtattgtgtttagatttgatctgcctccctttctgtgtgtgtgtggtcttgcgatagatttttggtgtgcaatggtttgttttgatatttgatcatgacctagttaagatgttagaatgaacgaactcagtatgattagtcctattgtagttggatggtaataaatcaagctgatagatgtctgttatgcttctggttgttatgtttctgccgtgcagctgcttactggttcagctgcttttgcttaagcaattcagtttgttgacatcacttgaatataaccagaaaacaatttattctgttgctcaagtaaaacacctctcccaggatatatgaaaatattgtgaatcaagtgctctttggttgatcaagctggaatttaacaatttttttttgggtttcacaaagcttaatcttcatttaattatgggacaggctgcgagaaaaaaggcacttaaaggatgggatccaacattcataaagagaaattttttcccctactggagatcagtattaggggcccagctgtctgtatccaatggagcagcagatgagaagtcaatgcttcatcgtccacagttccgtaattcagtagtgagtaacgagtcttcgagtctgaaccataatattagtttcttgggaagaattcagcaactgagtggtactcatgaatcgagaaggtacagtactgctgcattcagaatgctcacgaaggtgctaaagacatgagcaaaaaggtatgtcgtgagttttgtttcagtctacagttactgaacatgtggaaatcattgctgtgacgcctatattattaattgagcaatatatcgtaatgtcaagttgttagggtacctcaatagaatttcacttgtttaaatttacagtaatattttcttgtttttcttcgtgcaggtgcctagtggcatgttgctgttgataaccataggtctgcaaagtattatgctgcgcacgtcttttgcggacaccttaagaaggttgcgaatatacatgtgaccaccaaaaccttgttcaaagtgatgctaagtactttaaattatgatgaaatgcaacatgccgtgtgttgtattcggcttgaaccctcgacccgcgagatgtggacatgcgtgccagcatgttgtacttgtaccaggttcaacgttagcttgaacactgaacaagttaaatgtgttgcaaaatgccatttttctttatcagcaatctcttctacctatatcagggtcatgattctagaatgttattgggccacgtggcagcctgaaaaattagctaaacatcaccaaaatttttgccacgtgtcaatcagatataagctcttgtgatgtcccttgcacatcagaatctctagaaaacccattactttacctatctctttgcactaatgcagttgataagtatcgaccaataaaataataaagagagttaataagtgcttcacttttgccaaccgatagccggaatcagcttttttgtgatgttttgatggatgcaaaagatatagttatatttaacatgtaaaatctataactaatataaatattcgtgtttttccggtcgtcacatctaattttcgtccatacacaatccgattcggttagca

SEQ ID NO: 59104 - DNA, 18209 bp, Oryza sativa
atgacaggtgggccccacaattttttttaaaatagagtgctaactggactgccacgcgtacgccacgtggaccaaaaccaccgtggattaggtcgaggggggtaatttgtccggtttgtatagttgagggtgaagaatgcccggttttgtggttcggggagataattcagacgaccgcaatagttcggggggtaattcgtacttttcctttatttttattttgtgatggtttgttttatcaatgtattctaagtctgacttatactttttacatttacactaatacttttagataagacaatttgttagtggtatgtaaaaaatgaacgacgttaacagagggattaatttagctaatacactctaaaataaaaacagatgtggcatattctaatacaatgagtttaagcaagagtctgatcagcatcgttggattaggatctgtctaatccagtcttaggttatcatatttcaggaatgagagaatactactatgtattccgcacgtagtactgttgagatgaaaatgatgtcgtcgtcgtcttcgtttgctcgcaaattaacgaatgatagaggtaaatccgtagtacaatatcgtctactctcgctatcccaagatagatgtagtttaagattcaaagttcaaaaagaacttatcattttggagtataattcaatttaaaattttcttcattctacctccaaggctccaactacctttccacactaaaccatacatcatttaaagaagacactattgttattttttcataaaacttacttcatccgtttcacaatgtaagtcattctaacatttctcacattcatattgatttaatgaatctagatagatatatatgtctagattcattaacattaatatgaatgtggaaaatgttagaatgatttacattgtaaaacggagggagtattaatctttactgagtaacctaaaaagataactattttgaaacagaggtactactgtactagtaatgtactacttgtattttagtattttcttcttgttttagtatcaaaccaaaccagtagtacactctcttgttttctcaatacattaataagaaacatggtatagtataactttctgcttaatttgtctttgactaaggtcttatttagttccaaactttttctttaaactttcaatttttccatcacatcaaaacttttctacacacataaacttccaacttttccatcacatcgttgcaatttcaaccaaactttcaattttagcgtgaactaaacacaccctacataaaacataccctcctgggaatggaaatttgttgatactagcttactagaatggctattactgttaggccggctgtcctcggaccaccagagggcagcattgtatcaccggcggtggtgtcagtagttttaaaacagattgtcgtgtatgaattttggcaaaattaactcaatcaacaaccgcaattttccaggtttttttttgacagcctcgatcctccggtttatgggcaatggtcggcatgaaaatcatcacacaccaatacgatttacaacttgcccacctaaatatcacggcaggtaagactcccataaatatttaatgtttaagacatgattcgttcaaacttttaaaattctccaccatcaataacttccaaatatttagcttacacaaaaaatgtattcatatatttatcttgaaaaatacaatatcataaattcgctggatattatgaaattattttaatataaaccctatggtccaaatcttatcctaagcatagaatatttacgacgggagggagtaactactggttagctccattaattttaccagtatctaagtatattcatgattgaattattttttgtggaattcataattgaattctacttgaattatattaaacttgaacaacaggacaaaattatcaatacttcatcactcattaagagtaaaaaaaacatgactactacatagtagtccctccgtaagaaaaacaaatccactattgagtgtgacttaatctaattttagatttatttttttataggatggagggagtatacttttaggttagttaaaatattgttcccatttccaggccatactatgcatcagtccatcctcgatcttgtactgggccaagtttttagatcccctaattccattcatttggacgcatacgtaattccataagtacgcaaaaactatgaatatttctcgtctaaattaaattagtccaaataattcctaaatccttatggttttgtttttatctctttaactgtacgtaaaaggacatgaaaatttgttgggaatgcatgcatgcatatgttcccacagatcgagggtgtatatgtacgtaagtacagtacaggcgtatgtacgtataatatacagcacaggagtatactacggcctagcctggtttagttactaacttttttttatttgaacttccaactttttaatcacatccaaacttttctacatactacgtgaacttctaacttttttttcttcaaactagtaaaattctattctagttttagcgtggtactaaaacacaccctgcgttcatttggtgtttacgtgaaggcgttgcgttgcgttgcgtgccgtcccggccagccgccggtcgacgtgatcgcccggggtcacctcaactcctctccatcgatcatctgaattttactccgtcagataggagtactctgctggtgtacaagatttgacgggacagactacaggtgctccttctattaaaaaaacctactacctccgtctcgtctcaaaataagtgcagccatgagtttccccgtctaactttgatcatctattttatttaaaaattttttataattaacattttttgttgctatgagatgataaaacatgaatagtacttttactcgtgacttatgttttcaatttttttttgaaaaattttaaataagacgaacggtcaaagttgggcgcggaaaaccatggctacacttattttgcgacggagatagtaccttcctccaatctcataatataacggattattttattttgagaaagattaaggatgaagacaaaataccacagtacccctattaaatgtatttttggttatggtgagtgggtagttggaggttaaaataggtagagattcaaattagagttgatggatgtgtatattgtatgacttgtagaagggataaaatatcttactccatattattgaacagagggagtaggttatttaggccgagtttagttctaattttttttaaactttcaactttttcatcacatcaaaattttcctatacacaatcttccaacttccgtcacatcttttcaatccaaacaaactttcaattttggcgtgaactaaacacaccttttagcataaattaatgtttgaaaagtaaaactacattaccccttatttgattggaagcaagagaatagtagtgaggatagaataggtagaaattgaatcggaggtaactgatgtgataagtagtactccatccattctataaaaacgaatttagaatcggatatgacccatcctagtactataaatctggatagatatatatctaaatttgtagtacaaggatatgtcacatctgttactaggttggttttttatggacaaagggagtactctcaagcaagggtggagacaggagtagggcagctagggctgcagccctactctggatcctaaaaattcattgaaattccgtttctaaatttcaaaaactagaagataaaggcaaaatcatataaattcaactaattgagctctaggtttagaaaatttctagctcctccactgctctcaagtaacaagtattgtggaacaaaatttgaagtccagatagacaactattttgggacggagagagtaatctaggtggagatttaacaccatagaggacaacaaatttggacaagaattgtctatattcattgttccagatggtgtctaattctcacttaggtttttttgttttgacgaaaagagcacttcactttatttgtagtttacttctttataaagggtttggtgattcggagataattctttattctccaccaatctattttttataatttgtttatccatctattcattttcattttgtatcagtttaatcctcatgtatcataatcgtattttttagataatggaaatggattacatctccggcttctatcataagacacacagtcataaatttaatagtaataaaaaggtaagataaaagtaaatcaaaataagaaataaggtgatgggacaaatccccaactcccctttattattgactagtgttaaaccacataaaatttttttagctagcaattctaatgtatcataatcgtataagttctgaagggcgagtagggaatttgggttagtagtagagagacatggctagacagcccaggataccacatcttccaaaatactccctctattcaaaataactaatatggacataaacatgtctaaattcattgtcataagcttatgtctatatttgttgtactaggttatattttattcttgcttaggttggtttattttttagtatggaggaagtaaaaccgggtaggattgccaccggtcatggtttagttagagctttgttaagagattgcttatactatgtagctacttaaatacttttctgaaacatttttttataatttattttgaaaacaaaccttcattatcctcataatagggataagaaaatgttatcacatcattcactatggtgtggtcaaaatatctatatattttgtagtacttaaaatattagtagtggtggtgtccgttctgtcagaacacccgtccatctttccaaatttcaaaatcaccaacttgtttaataaggaaaatcatataagtattatttggactaaatatatgcttaattgacttttctagaaactcaatttgttttccgttgcaacgcatggatttttggctaggataaatctaaattttcgttgaaagggttggaaaattaactccttttttcatgcagtttttgcgatgcttgtattatatgcgttcaactcactttgtccgaatctaaggcacacgctcgtgttctgcattagcaatcgctgttgagaatataaaggcacagatgctcattatgcttcaactaaataaactaatttttactttttacaagtctaagaataagatttagttcatttatccgaagtaaaatggatccactattacccacggatccacgtacgtctaatttattctacatagtactatataaaactacgctactctcgcccaagtcctgaaaaaagataagtcattaacgtatgattaattaagtattaattattttaaatttgaaaatgaatcaatatgatttttttaaatttttttaaaaaacactggtttaggaagcttatatgcagagaacgaaaagaaatgtcactctttatgcatggctcaaacgcagaatactagtactagaactcatatactccactctctctgctgcttttgcttggtcccttatccagtcgtgtcagcatatatagtgacatggcagtgcgtgtcagcatcacgtttttcacgctagccgggtgtagtgtcatcgcaagatctggtcccttcaattccatcaccgccacgtggcgatctaggatcgagtcgatgatcagtggattagagcaagttttttagtatagcccactgctaactttaaatcatctatagtcaatgtaatagccaattcatacaatagttgcttactatactattaatacctggtcccacatatcatacacacattacgtcttgaagtccgtgctgcagctggctatagatctgtagcccgctgctcttctctcattttctttatctctttaaaatatgcttatagctatcttataggctgctattgtacctactcttagcaagcaagagagggtacagattgaaggacagtcggcacggagcaacggtatttaggctatactcctatgtaaaaaaaaactaatccttagaatgaatctggatatactgttttcctctattttattttaaatgaaatagcatattctcgtgctaattctcttaaaaaaagtttggatatgctataagtttggactcatctttagaattgaattttctttggatggagaaagtatgtgtaaacccttttggttttttagtttttgattgatcatacttagaatatactctacttttatacgcatagttttacgtttttatattatgaaaagtagaatacatttcaaggtaacaactaatcacttctccaatgttcttttccacctataattagctaatagattattgcggacacgcttcataaaccactaaaaaatacaacttttttataaaaagaaaacctttctacataaaagtcactaaaaaattcaaacaaatccatttttaatatttttaatagttaatatttaattaatcatgccttaatcagatttcttctcttgcaagccaatcgttcctattccatccgtctcaaaatataagcatttttagcatagtatcaagttaaacatttttaactctggctattaatagcaaaaaatttaaaaatatcgatcatgtaaaattgacattactagattcatcattaagcaaactatcataatatataacttttttttatttaaaacatcttatttttatagatattattggttaaaataacatcttgaaaaccgtgtccaagtaaaaaatgtttatattttaggactgagtgagtaatgagtacctctaagagcaggtacaatagtaggctataagccaactgcaaacatattttaagaagataaatgaggagagagaagagtagcaggctacatatttgtagccagctgtggcatggactccaagacgcagtgtgtttatgacatgtgggactaggtattaatagtgtagtatgtaactattgtatgaataagctattaaattgactatagataaattaaagctagtagttgactatactattaaacttgctctaataccataccctgtcctgacaaagtgaatgccattggaccaattggactacctctaatagaatctaatattctatgatctctatttggttgattgttgtaataataaaattactgttgtttctgaaagtattatactacaagtagaactaatctgaaccgtttattcttaagggtacaatagtaaagtactaagacagattaggggtaaatttgacatcacggcaacgtcggttacgtcgttgtgttcgatcgtcggtggcggcggcggtggagatcatcttgagggcggagccgccggtggtgaaggccttcttgcggacggccttgtaccccggccacgtgacggcgcggtaggcggcgctccggccgggcgacacggcgtccgtcaacggcgccaccttgacgtccggcaggcgggccgaggaagtatccgagcgatatcctgtcacggtcgcggttgacgacggcgcggtggtatacgctgtggaagcggccgttggtgagtatgcatgtggaagagaggtcgccgacgttgaggacgaagttgcccggaacgatcgccggcaccgccacccaccggtctagtcctcgccggaatagctacagccctgacacaatgctctggagcataagccggagtcggtgtgtgcgatgagtcccagagctcgccgcaggtccgggcacctctggtaccagtgcatcgtcgccgtcatcgtcttggcgatcctcctctccgcctcaacgccagtgagacctagcgcccaccctgaggaacaactccagcagctcgtcggctagccgccgcatctccttgtggaactcctccatgacgtcaccgcgtatattatacgtgcatcagtacacttatacgtgtacacgtagtagtagacgagcagctcgagagagggtgtgtgcatggcggcgacgggtgtacgtgagaataccagaagaggagccgaggaggtagtcgtcgccggacttgggccagagacggcggagcttttgcttatccaattgcaaatgcgtgccggatcagaacgagagacgagtgagtgtagctaggtttagaaagtgaaaaggacaaatacctctccacaaataatttttctgggacaaaaatatccctccacaattctactaccattaaatgtggtgggagtagaaatagatctgagccgttcaatcatatacaattaacggttcaaattattttctactcctagtagaaagcaccggagtgggactcatgattgtttgggaccgatggctgttacgcgaggtacaaaatcattaaaactgatgttaattcgcgggtgcagacatgctccctctcttggtctcaattggtcagccacacagtctcacctgtctcatacctgttcgatttttttttccttttaattcctcatccaacccgtgccaaaattcactactgaattattatacaatattgaagagaaatgatcggtagaaaatgagtaatgttctgagtaaatttcaagagctaagtttagctatgtgatgaagaggcaaactgaaagtctgaaagcaattacatttctgaatcctgaaggtacgaagaactgacggagtgatgcaattgccagaaatgcatgtcgcgatgagcacctctctctctgtctctctgtctctgtctctgcagcatgtgagctctgaatatgcaaatcagagctgcaatttttgggaccatggcgtgcctgattgcttgcctgcttgccgtgttggattcatctcccagccaagaatttcaccaggacaagataacatgactcatcagctagccttgaagaattcacacgtctgctgctctagaattcacagtgtaggtagctgctgcactgtcgactgttcttcggtcatcacacacagcgtcataaaagtataaaacagagattttatgagagtttagcttctttttctttgttttttgtcttagcacatcttcattcttcctgcactgatgcagcttcctcttcatcaggttcagaggcagtgatttggtctgatcgtttgaacagggctatgtttttctatcaatatattcagctgcttcacagctcttttgttcccaacatgtactcaaattcagcaccattagttgatccattcagactgattcagcaccattaggagcagaacgctagggtcttcgactctgacctctcttctgtctcagtggttctggattccatccattcggagggccgtctgtggtcgttagctggcgttgccgcttttggggacctgttgggagtatagcgcggctcagccccttcccgctgttttagagtttttgtttagcctccgtagttttctttttctaagcctcagttttttttattttgctttttctcctttcccctggcataggccggtctggccgattgcgtggtgtaataactcttttcttctaatatattgacgtgcaatccttttgcgcgttcgcgaaaaaagactgattcagtgatgaaagttcattcagatatcacccatcagtcattcgacagtgagatggagcatggactacaaacttgttgatcatcgtgtttctcatgtaatctggattaaggatgtttctccctttgtgcatatgtttgcattaatgtctgctcattgagctaatgcatcatacagttgttctttccttttcttttccttcaaatcctgaatctacttcatgtgttaccttgaaactttggttgtctggcactagtaagcagtagtataatagttttggagcataatagggaatattgtccccaagatcacaggatatgaagttggaatatatgcttgaattagaaaggacaatctaaaatagatgaacaagaaaaaaaaattgcagtgataaaccatagtgttcagtgcagcatagaggatcaacatcatctatttgcctgcactgcaaccgcatagtgctagtcagaattcatgtttttctggagcatgtttgagtatcagagacttcagtcgtaagaaaaaatgtactcctagctcgaacttcagcccaaaaagaagtagcagaaaaatgcaaaaatactatgcatacgatgtttggttacgatatttgtagttcttgcagaaaatgtcctgaaaaaggtcctgtttgattgaaccagcaacgatgcaatctacaataagaaggtggtagatgttaaactcgaaacacaacatcaaaagtagaatccaaaataatcacgacatggtttcagatatatatatatatactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgatttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttatttttttaccgcgtcacatataattcctttttctttatcggaaagttttttttcgcctttttttaccgcgtcgatggagtcagattcttttcagctttttccttttcttttattggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttctccacgatacatataattcatttttctttggaataggacagttttctttttatttttttaaactctttttaccgcatcgatgtagtcggattcgtttcggtattttttccttttttttccttttttttgtcggacatatttgttttttttccgcccggtttttttcgccaggttttttttatcagacttttctttttttttcgctcggtttttttctcccgttttttgacagacgacagaagcacatagagaagtgtttttttttcttttctccaatccaatacagatcggatctcttccagggaaatcagattttttttctccaggatcggactctttttttttcgctttttttattcattaaacggtttgtctctcggacttttttttccctttttaagggatcgggtgtttttttgccagggacgggtgtttttttcgcccggttttttttttcactttttttttggatcggacttttttttcgtccggttttttttatcggacaaacttggttttttctgcccggttttttttcacccggtttttttgacggacgatggaagcacctcttattttttaaaagtagtagtagaagtagaagtagatatacacactccctccttcccgttttatttgacgccgcaagtcaaaaaaattagtgtcacaatgtttgacgccgtaagccaaatcaattgaagcattccgtctttgcccttgtcctccaacaccgtgatgccgctgccgcgccagtgggaggcggcagggcgaactgatgccactgccgcgccaggagatcgagcatggagctgggatgcgcttccctacggctgcatccacaactccctcatgccgtcccccccgctactgcttgctatcgaagaggtgatgatgtcgctgctcgccgacgatggcctcgtcctctgcctcggtgccgtaagccatcgccggcggcggcggcggcatggcggacgtcgaggccggtgcccgacgacgaacaccatatggtgcttgtgtagaattcgatatgcacgagagaggtaagcaactcagattgagtgttaattctattgatgaatttgtgtttgaggaatcaaaagaatcgatttctgagccgtaattggaattcaatccttggttgcagttgtggatttcgatttctgagccgtaattggaatacagtcattggttgtagttgtgggttttttatctctaccctgccaatggtttatggttcacattttcatgtgaggaccgacttttttcaagattaggagaagctgatttctgaatatttcagaccagcacccagcagcatcaagttcagatcagaacgcagcaacagcagcacgagcaccatttcagaccagcaacaacagcaatgctgtgggttcctgctcttgtgtggcggcgacggcgtggggagacgacatgcaagacaaaatcgagacgacgagctggaggcctcgtgcggcatcaaggcggcgaggcagacggccgcctcgtcgccgagccggcggagacagcagtatgtacgagacatgaacaaataagggcaaaatcgtaacttcattgcttccttaatcctgtcgaactggtcggaaacgtcaaataaaacaggaaggagggagtatatttttgcaactgaagtcctgaattcagaagaaaaactggcaagatggactctctaatacagaagtatatactgaatttattaagattctgatgccgcaacatattcttgaatgtctgcagagtaaagttgatgtgtccaacagtccaagctgtgttttgagtataaaactacgtttggatgccatgtctttggctctgaaataaacaaaagagcaagagagacaacattctttcaaaagttcagattggtcttagctgatactacggatgatggctgggttcagaatgggccatgttctgttttttcgatgggccggccaaggaatgctgagaaacgtcagggcaacaattaaggcccttttcagaagagctaattgagtttagctactcctcgttttctatttgtatgttttttaaaaccactaagactgtatatttcatatgaaaactttctatatagatgatttaaaaaataaaataaattcatttttaaatttttaataattaatattaatcatatgctaatcatgtttctcgttttgcgtgcaaatcatatgtcgaaaataacgtatcctaagtatttatttttttttcagaatatttatccgattattgaaacggattatttgctccacacttcacaaaagacatttctttcagaaaactttcttctattctgttacttggaccaattgttttaagctattcttttagtttatttatcaaaatatttaatttatccttatagtcaagtagattatccacaacaacaatccataaaaaaatttgtttcaaacttggccttaagtttgttgaagcaccatcctcaggctgtgtctgttcccttgtgttgggaactaatttccttcacacagaaaacgagataccttattagcgcatgattaactaagcattagcttgaaaaacttgaaaaatgaattgatatgatttttaaaacaactttaatatagaaacttttaaaaaaatcctaggcaacaacggaaaatcattgagagcgtcaaagggttgcttggtaatacaggatatctccagaatctgtggggtttcagtgatggggatatatggaatttgcatcactgaagaggaagagcacacgctatggttgtaatttattcaggtttgaaggcaatggtgagttttctctttgggcttgttcagattgatgtcatttcaaatcataccttttttttggtaaagttgccaaatatgtgcatccatttagtttcttaccaaactctagtaaaaaaaagaaatcctgccaaaacttggcaatattgctaaattgataaaaatttggcaataccaaaaattggtaaggtttattttggctacaatctgaacaaacccaaagtatcataggatcagtctatggcaccgtgtacgtgaaaaaatgaggaagtgaagttagaaatgttatccaaagaacacagcctaataaaccagtctacactatgacgcacaaggaaaaacacccaagggatgatctgagcatttcgttcctttcaaagtagccgtatttggcaattgacacatttgcagctgaagaagaagagatgaatggcagattccttgtttgagatagattatcgattggattatcaacttcattatagggataagttaaatgatttaaaaaataaaattaagtctaaacaatgcaacaaaagaatgttcttttatgagaactatctgtagagacgtagagtaaataatctgtgacaaacaatacacattcagaaaagtatagtacaatggacatggccaaagaagaatatcttgtagctaggccgctgaagttgaacatagcccatccaccaaagatgaccagcagatttcaccaggacccctcaattgcagttgtaccccggacgattttattgccatgttcagaggattcttggtccgctcatctacatcaaagatatgatagaatatttttcaaccatttaataaattcttaaaaattaactcggccaactttccacgtatagcagtattgagtgtatatgtattgactattggtcactaccttcgtgtttactatttggagttctgcctataatatattcatgtttaggcgggagtcatgaatatagttgtaatgtaaataaatacatcgtttttatattaaccgataacccaaatgtaatatatcctacaataatagattacaatatataagcttctttaaaatctagggaacattaaaaaaaacacttaggaacattcatgcattataaaatcatgtacttccttcatttcatattataagatttcttatatatatatctagattcattaacatatatataaatgtgagcaatgctaggaagtcttataatatgaaatagaggaagtagatttcaaaacgctagagtactatagttgatatgtctatatggttcaaagcaaataaatataaacaattctctactctaattgcgattatggatttggtttattacttatattttctcggatgagtgtgacattgcctttgactatttttctagctatggtatgccatgttcaatatctataattgcatatattgcataaatggaaaacccacgggtactcaaacggcatgtgcatgtgttctatttacagttgataagtgtattgtgtataggccaaacaagtaattttaggtctcaaattaagcatattcttgctccgcagaggttgatccaattcatcgccaacatcagatatggttcaaatcatagctaccaacacccaacagataccccatttccatattaagtgcatcaatattacttatagccattggatagttatcataaggtagcaactgtttaagttagatttattatttatttaagttattttcactttggaacactttcaatcccgttttggacaactctttaattaatattttcattctagaccaaacaattttacatgatgacactttgaccaccctcaacacttttatctatctatatgttcttttaatacatcaaagaaatattctagatatagttatgggagtttagagacgaataactgacgtaatcaaaatcatttatatgcttgataagagcattggtgtggttaaaagaaaagcaagattagccggctaaaaacttaagttagaccaaaataaaattacgagttgtcagtgctgtgcctatatgtgcacgcgtgctattatcttaaaaagaaatgtgcacgcgtgtgggagccattttaatcattttaataaggaaaaaaaaaggagagaagaaagtaacaatcccgctattattacgtcatatttccgcccaaccatgagcccatttcattttcctcctcctcgcctcggtctcctctcctctcctctcccaaatcgaagccgcctcctcctccgcctccgccgccctcctcgccgccgcgtggatccatctcatcccctcgccgccgaaaccctagacccgcgcttccatggtggtatgaccggttggcctcgcgattggggggtgggaagccggtgcggtggtggtggtggttagggtagcagaggcattcggcgggcgatcgccgtgaagcgggtgtgtgtgggggccagcggtggcgccgggcatggcggcagcggcgaattcctcggcctccgcggcgggggccggcggcggctccgcggcggcggccgggctcaagacctacttcaagacccccgaggggaggtacaagctgcagtacgagaagacgcactccgccgccgtgcttcactacaaccacggcgggaagaccgtctcgcaggtgagctcgctcgtctccgggaggggatctagattggggtggcgtcggactcgcgtcgagggtttccgcggtttttgcagtgtgttagtgggatctcgattggcttcgaggcgggttctagaggaacatttttttaggtagtccaagtttttaggtcgctggtgcagattttagatggcgctaatttatttcatgaacaacttacgtcgctgctagccttatagagatcttattcgttagattttagcgattcgttgagttgataaggttgcaagttcaatcggtagatctctctcgatcatgtggtagtagtgtctcagcttgtgtaatgcttagttgtgctgtgtggcctatatgtgttattcctgaaaatagtttttgtggcgttgtaagtgctgttgttgatggttctagttattgcagttgacggtagcgtatctcaaggagaagcctgccggacagggctccacgccttccacgccaagctccagcagcgggatgcgttctgcagcagcgaggcttcttggctctgggaatggtaaccggacgcttagctttgttgggggaaatggtgtaagccgggctgtgtctgggagcagccgcattgggggtggccttggtacatccggaggcattggtagttcacaagctgtggcaaattacgatggcaagggtacatacatcattttcaacaccgctgatacactattcatcagtgacctcaattctcaagacaaggtctgtaccttttataatggtttagtgtgaaatgtagtttctagtgtttattgtctgctgataagcctgataactgcaccaggatccaataaagtccatccatttcagcaactcgaacccactatgccatgcattcgacccagaggccaaggagggacatgacctgatcattggtatggggtcaggggatggttagtatcgttattagcttgaatcactccattttttgaagtgtattttgtataatcacgagttttatatttgcccattctgcagtctattcaatgtcactgaggcaacaattgcaagattctggaaggaagcctgttgcggcccaacattacaacaagggtgataaagatggaacaagcactggcaggcatgtttaaatttttcacttttcatttaggtgtcagatatgattgcttgactttgtttgcacttactccctccatcccaaaatataagaacctaggaccagatgg

SEQ ID NO: 59105 - DNA, 2840 bp, Oryza sativa
agaacgtgtgagcaaggaaggtgatgaagcttcggcgtcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccggcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtgcccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttagccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccccggacgctgcggaggcggcctcgcggagggcg

SEQ ID NO: 59106 - DNA, 7562 bp, Oryza sativa
cttgcatgtttgtggagtgttatatcacatattaatacatcttcttaaatttttttaatttttttcataatcatttgaatgacatgcaaacaacgaggggatatcccctcgagggatatcaaaattctcttccttaactaagccacttcttgaatctttgatagcagacatgtattatccaaatccaaaactgagtgttccttttgcttctagttgcagctttcattttattctgaaataataaataagtaatcttgcatgtcatgatgtcaatgaacttcatcttgaattaatttctagagtcaaaactcgaaacgaaatctacatgatctgaaactatctgttaggaattttgcgtgtctatcagccgtgtttatcatcaataagaacaagtataatagcaggctacaagctagctatcactgcacataaaacatgatggatggagtattagcgatattgacttttttgctgcacatgattggcattgtagcgcccgttccgtcgtggcgcctagcgggaaaactatctcttaaaaaccctatttgcgaaatttgtttcttttcttgtcgtctagtgtccgtgccatctcagatctcaaatccccgatctatcgtcgaattcaatcccgaatccaaatccttccaaatcaatccctccgcaaaagtctatttcgcctcccccgggtttgatgggccgaatctctctcggcccatctccctccctctctctctttctctctctctccgctctggccgcgcgccgcgcgcgcgtgcgcgtgagccgcgccgagcgtccccccctccctcgctctctctctccccgcctccatccctggcgagctcctcgcccgcggaatcggcccccgcgcgccgttgttcgcgcgcgcgcgcccgcgtggtcgccgcccgtgccgcgcctgcgccgtctgcgccgcccggccccgctgccctgccacgcagccgctcggccccgcaagccagcacgcgtgcccgagccgtgccgctcaaatcgccacgccgcccgttgcttcccgcgcgcgcgtgccgtggtggccgaccgcctggtcgccgccgccgtcagcgcctgccgcgcctgcccgcgcctgccgcccgtgtcgtcgctccgctccaaatcgccccgccgtcatcgccgtcgtcatcgactcggccccgcctctccccgcgcgtgcttccaaggaaagaaggcagggctcctcctcatcgccttctctccctcctccttttcccaaagaagcaaggaggcaagccccctttccctcttcctttcttctttttcctcccatcgccggcgtcacctcctgtcgtcgttttggccgctagccgggcgccagcccaccggcttgaccgtccaaagtcggttcccctctcccaaaccgacattgtcgcccctttaaacccaagctcctccctcctccaatcttcctcgttttcgtctctcgccgccacgccactgtcgcccctgttcgccgtcgccgatcgtcgttgcgcgtgtcggaggagccggcacgagcgaggacgtggaaggggactccgggcgcgccctccccttcctcttcctcggcccgaggccgaaacgatcacgtttcgcgccgtcggctctcgtcactgcgcccgcccgcacggtagtgcatccctccattctccctcctcgttccatctcctccctttagactcgggtagtagcacgagtagcctccccgtagctagctggcgccgccccgacctttgccgtcgctcgccgtgtgctcgccgctgtcgccgcccgaactcggaaacgcctctcgtcgccagcctccctcgatgcgtttcctcctaatccggcgcaagggacggattcccgtagccgcgtagatgctctcgccgccgggaatcggcccctcgtgacctcgtcaccgttttccccttttctctccgccggtggccgccgccacaatccgccgccgtcgagctccctccggcgaatccgagccgttggctcgtctcccctcatctcgtgcaaccacccggtgtgctcgctttcgcctgtatcgccgtgattcgctccgccgctcgccgccgccgcccgccgtccattcgcggccggcgtcttcgtcttcctccagccggcccgcgaggcagccacgtaggtgccacgtcggtgccacctcggcacaaccgagtcggctgacccggtcagccactccctccgttccaccctccccgtgcgcgcggtccatcgcgagccgtgaggctgcgcgtgggcccgccgcacccgcatcccccgcgagccgcgcgcgtgcgccgcccaaaccctagcgccgcatcgcgtgctccctccgcacggtgaaccgtgccaccgacaagcgggtcccacccgggaccacgcaaggtggacccggcccaccggctccctctctcctctccgcccgcgcgcgcgctttgggccgccttcttgggccggccggaccatttagctcggccgagccgccccttcctctcgggccgcgccctagccgcccgaggaaagtctgatttccctccctccttcttttcttttctttttctttttcaaaaaggatttaaataaatcatttttcctttagaccaaaaatctaataatcttagaaattcaatatcttccaaccgtaaatccgtttgactccgttcaacttccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcgaggcaagccacccttgaacatcttgagcctatatttgaacttaattatgttgcttgaaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcgaaaatcgtgcactctgcacgagtatcgacggtcgccttcaaacttaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccacctctgcagaggttaacaaactgttcgaacagccgtgcccacggtcatgggcggatgtgaggtgattcctagcgtagttttgtttgactactgccttgtgaaatttgctgttgtggaaaggggatcgatgtttggaaaatctgcagctgatgggatcagctaggcccgggtggccgtttgaaggttgttggcccgggtggccgtttaaaagttgttggcccgggtggccgtttgaaagttgttggccgggtgccaaccttgaatcaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctacattaaacacttatttcccgtggcttgctgagtactcccgtactcacccttgctctatataaataatcccccccagttgctgaagaagatgaagcggatcccgctgacgaggagttcttccaggagcaagccggctacgatgagttttagggttttggcctaattcccaagtcgcgcctgtgatgtttggtccaagtcttggcttccgcttcccttttgtaatgcagttgtgagctcgggatctgtccgcagcccaacatgactgtactcctactctataataaagagacctctgttactgtgatattctgtcttcctgtgataccagcactgtttcctgggactggtatcgattaacaggttaatttggagcgtcacgggctagttccggtcgggactagtccggggcgtgacaggcatattaccgaatatatgcatatggtactattggctggtttggtggaattccaattctgagccttttttatccacagctcatgttctctgtttttattaagacggatgttctctgtgattagaatatttggagaattatgatcaaacatggactatactatatcctgactagatgtgaattatatttgtataaatcaggatttgttatgtgaactagcacattgccaatgccaggtcaaacagtaagtttttttttcttcactaaatatgagcgcatggatctgaaatatattaattcatcggtcaacatggagcaaaaaaaaacaagcatagcacaactgatctaaaaacaatgtctgacgaattccagtccattaattgcagaaacaaatgtgcaaattctttagttgctataacaaagggaattccagtccattagtgccgcaagccagagcagcttgagtggccaaaatcgagctggtgaagcagtcttctctgttcatgatctgtgtcctctgttctggaactggtaagccgaaaatgtttgcgtccatcagtacgtttatgtgccatttgtttggcacaagatggtaccaatatatagtcacagcaggctgctgtcattagcagataaagagatcctgaatatttttattttacaaacacgcaaaatgattgcacgtcggtatattagaaaaaaaagtatttgtttacctaacacaatcagcccagtccaacttataccaagggaagggagaaaagacaaaacaagaaaaaaaaacaaggaaaaaagggaagaggcctgaaattttctttttaagaaaaaaatttggaacttttattcatgtagcattgtcaaaaaaaagggccatacagagtacatgcattaacgttcaaccaacattatttaaccatggattattcgtctctggaaatccttatttgcaccggcatggcatgctcagctgctagttcggaggaaacgtaatcgggtagaccggcgtcttgtcagggtagaagagcccaaaatgcctctcggtctcatccccgggcttctggttctcgttgaacatggcgaacacgtacgtctccagctgcccgggccgcttcggcgtcccgttcttgacgttgtcgatcacgccctggttgtgattcctcgcgttctccacgttcgccgcgaaccctcccgccgacggccacccgctctccgacacgacgacgcggacgccgggcgcgccggccttctccagcgcggcgtacacggcgtccaccatggcgttgaagaggttggtgtaggtgaggccgctgtcgttgtccctcaccgtggtgcccggctggaacgtggcgtagttgagcgggatgtcccgcgggttgtccctgtaggcgaagtaggggtacacgttggcgagcagcggcgacatggtgttggcgaggaactgcgcgatgggcaccatgaactgctgcaggtccgggcggaacacgccgtgcgacggaggggacgaggcggtgatcacgtccatcctcaccgccgtcgacaccttgatgctgttcgagaggccggcggacacgagcgcgtcgtacacgttctgcatggccgggaggatggtccccatgtcgccggggccgagctcgttgccgacggcgatgtaccggatgatgacgttcggccagtaggcctggacgttgtcacgcacccagtcggcggcggcggaggggttgttggcgaggttggccaccgcgctgctgccgccgacgtcgatgatgacggcgacgccgctgccgcgaagcgcgtcgagggcctgctggtccgggctgtagatgcgcatagcaccgataccattggacttgtacagctgcacgacctcgctctgcgacgggaggttgtcgccgttcatgccgtagcaaacaccgtggacacctgcaaaaacataggagtgcatgtttatgccaaatcagacgatttaattgatgtgtaggaaaataaaatatatatatagagagagagatatcgaatctggatttttcacattttgatacttttgaaaaacttatttcacaaatagacccctaaaaaaacttatcctagaaatggtcttttttggggcgccagagtggctggcgccgtcatccaacgggatggcgccagcctctctggcgctgtcctcctgccaccgtggcgtacgcgaaccgacgtggctccattcctgtttctctgtatggagttgcaacggtgttatttttattttattttttcggatgttttttcacactcaggatcacgatacaaccaaccacaaaaaaaatttaaactcgaactaccacttagctaagtctgaaaatatctagcataccacttagtctactttacaccttcactaaaattagaccataactcatttagtaaaaccctttgatcagcatgttaaacataatgcactctaccactatatgaaattacttaatctaattcaaaatataaccacatgaaatgacatatataagttaaacagtatatagagatgcaatttttttatttttattttatttttttgatattttttcacacttatgagaacataggaaccaaccgtataaaaaataaactcaaacggacaaaatatgtgacatgtagaattttccaaaattctaccgaaacggacaaaatatgccatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtccatttgagttcaatttttttatggttggttcttgtgtgtccctaagcgtgaaaaaaatatcaaacaaataaaacaaaaataaaaaatttccggggggggggggggggg

SEQ ID NO: 59107 - DNA, 16738 bp, Oryza sativa
agagggcaaggggcggcagcttaatggcgacgcgacggcagcgcacagggctcggagcggcgatgcgacgggtggcggtgcggggctcggggcggcgcggggctcggcgtgcggtggcaggcggtgatggcgacacgcgcgcggcgacgggacgggcggcggcgcgcggcgatgggacggcgacgcggcggcgcgcggcgatgggacggcgacgcggcggcgacgggcgacgcgacgggttggagacggtgcggcgacggcgacggtgcgcggcgggataggacgcgaggaggcgtggcagcggcgcgcgcagggcgatggcgacggcgaacggcgcggcagggcgatggcgatggcgactagacggcgcgcggtggcgcggggcgcaaggcagcagcaggctagggtgctggctagagagggggtagttaggggacaacatcgaacacctagaggcctatgaacagtactagccgatttctttggattttattagatgttttccaatttagagaatggactattgccacctattttgtcacaacgtatttcacacaaaatctgagttattcaaatgtaaatttgtattcacacttaatattgcccacattttatttttattatatatttttctaccttttcctattttcctacttttagggcttttggttgaattataaattgagaaaaattgcaaaataaatttgtatttactcctaagcatttgagtgaccatattatgtgttcaaatgtgaattttcccaaagtttaatattgtccaatatttatcctagatttttataatttcccatatttggggatttcggtatttatttattttgatgcatattggtttatctttttaaattggttttaccacaacatggatttctataatttaatatttgtgattcaatacaaattatataatatcgaattaattattgcaagtaaaactattttatagatagagttccttctaattaaatggtcatcatttcatgtgcatttatattatcgcacccacctacattattcaaatattttaatatttgataaaatagattaatgataacttttattttattttactatcttgtgcataaatatttgtagggctaaacataaataatatactctcgtaaattatatctattgcttgaatgcagctcttttctttactttctttgtgatcatttacggtttggcaagcaatagcgatcataacaaccagcatgacgcaaaagttttaaaaagttcgaaatttttagtgatttttattgttgggaattttcaggatgttacactcttcctagactatacctctctttctcctcaatttgtatccctaaacacttgtattcttcagtggattgcaatatatcggtggcatttgtgtgagagatttggtgtgattgtgacagtatccaggtaacataggttcatatagacacacacgttttagtttctctgtagcttcgtagtaaaggctagtagtagctagcagaagtgcagaaaacaaatgtaatttgatcaatttcactctcatccagctgagaaccaaacgtctccgacaaattaaggagacagttaaagtcaaaaggagggaggaaattagggcaaaagttgatgctagtgaatctgacatccacaaagagaaatgattggtttttggatccatctacagtgatctgatcccgttgccatcaaacgcatcagatcagccatcacctgtttgcaatttgctctggtgcctctttgaggtgaacgttttgtttctctccttctataaataaagtatcctgttattaatacgactgaatcatatgactcacatccgactctaccacatccaccaatcaccatgcttagcttctttatcatgcggagttgttaaggaaggatgcgagcaggaggcgtggtggtctagggcttcgagagagatacataaatgggtctcaaggagcccgcaatcacattctgccccaatatatatgggccgccctgaggtcccaatatagttctggcccaacgaaaaggaccgtcgtggaggaggccccataaactttcctatccagcacatacttttcggcccattgtatgggcctcatggagtccgcatcaacgttctgggccaacttaaatgggccgcaggtaagccgcggcgatcccttcatggccagtaggcctaatgtgaaactaagcgggcccaattttgagggtttttctttttggaaaaagtacaccgaaggttggggactgctaattcacgcatacacgccgttacagtaactcgcgcgcactctcacatgttaggctgcagcccgctcctatcacactaatcatggtgattagcgttaattactgtgattagagttaattacacgctacagtaaattagagaaaactaattcgtgcgcgacgtagagcggttaggtcttttttttttgcgcggtttctttttttttcttttcgggtttttttttgaagacgcgtaactaatccgattagtgtaagattcgtagatttgtctttttttcaaagatttttttaactaacagattaaaaagagatctatatgtgaaattaaaatttgaaaactttcaacccatatttgagtactttcaactcgaaatttatttttttttaagtcaaactttgaaaactttcaacttttcatctcaaatctgaaaaactttcaactcagatttaaaactttcaacccagaattgaaaaatttcaacccaaaatttgaaaactttcaagtcaagatttgaaatctttcatgtcaaaggaataaaagaagaagaaataaaaataaggatacgaggatgacctagactcggataaattagcaaccgttccccggcaacggcgccagaaatgcttgttggtatttcttacgtccacagataaatctgcaagcgcacagaatagcactgtagcacttcaccttcgggtgatcctaaaaggatatcgaactcagggaacgtgtgtaatctacctaaggctaagacaatccaagaacaacaactataggtaggctaggcaggctagagaggactttctatgtgttttagttatctaagctaagcaaaggtaattttctatctgttgcttcgggcaccgacccttgctggtctgccagcgtggttccgactatagctctatgatttatccgaacgtggaggattactaggacgggattcagggctgtcaccacctgccgcctacctctgacaaatccatgggatacacaacaaacaaaggtaatctctaacctagacaccacgtctaagttattaattactactctaatacttgcgcgggaactttcttctttatccagagtcctagtactagagcacttagtatgaatactaaacaatgaacccgcaaagatgaaaatatatcttactcagacaaaattaattaaataacataagaaaggaaaacaaatgcttactttatagaagaagttctccgaacccggattcctcctacgaagctacactcgtcgaggtagaagtttgatggagcgtggggctcctcaccgggagaccgcgcaggcccccctttgctggttcggccgggggccctgggtgagattctaagctcctggtctgtggaaagttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgttttctcccccaaaatctcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacaaagtcggatgagcgccaaacttccgggcactcctccagagcttcccctcactctctaccttattctaatgtacaaaagatacaatagagcctcttgtaattcagctcaaagttgtgtgttggaaatgagagtgagctcctccttttataggcaggtatgacggttacagcctatgcgaaatgaccaaactaccctggaaccgccattaggatgtgatcagggccgtccatgcaaaatttgacgatcaacggccagcaaaacggttcgtccgaactggaggttcgaccgaacccgggacggctccgttcggcccttttttcgtcatggacactatttttgaggccctcggcccattggcatgatacttgggcccatttggagttgtttaattgacttatgggacctccaattcgtgtaaatgtgtcctgaaagcgcgggggtgcagtttgtcgcttgacggatgtgttttcttctcaaaatacctgcatacacatatttcacaaatactagtgaaaatgattagtaataatacctaccactaagttggataccatatttaattttattatatgcaggtattgacggttagatattaagatttaaggactgtcaacacatatgtgtccttttacaagctctacaaaccttgtcataaacttagtctcgcagttgggctaggccaccaggtcgacagcaacctagaaatgatttgcacattaatttaagttatagaaatgattaactaaataattttaaatcccaaaaaaaaaatctcatggcctaactcgtcatcgcacgacaatgatatattaagttataaaacacgcctatgcgaaaaatcggaatatacttgcgacacaaaaaagtttagcttaatttgttaaaacatgatacattattttcgttgggcccactatcaaaaggtaaaaaattgttgtggtgaaacatttgtgttgaattgacttagtatggtgttattctttgaggaagaaaagcattgtttcaatcttgcacttggaaactatatttttcaaacctgaaacatcgatattatgttcgtgaaacaacattactaggatttgatcgaaacaacacactcgtgcaacatgtcaaggaagttattgaaacatatgtcgcacgctagaaaaacatgtataatatcgtcattgaggctactggttgcagcaattcagaagcaacatgccttgggattggagaaatagactcatttgcaatcgctcagcgtggccgcacgtattctctttgtctctctcggagcggtaggaatagaaatagatgtatgtgtatcatggtgccgtggtggttgcgttttccgctggcgcatgatcacacgacgtgcgtcggatgcgtgtgggcggaggcaataactacatctatatgttaacattacacgcactctacttacttggatacggaatcatagattaatgagtggtaaaagccaaagcacagccggatatatttaatcaaataaagataacaattgtttctggtaacattggtaagaacaacatatcacatcaaccacatagagttataaacaccaaataatgaagcaaccgaagatgaaaagggaacaacaggacaaatgtgatacaaggacggtccccaggtgagaaccatttatggggattgtcactcgatcatggaagaaggatcagatgtgcagctgctacgcgatcatgcacccgcgggagcaccaatagtgccacctttcgcaaagtattccttggcttccttagacatgacgatgcaggtgtctacacacttcttgctgatggcaggatcctccttaaattccttactacaaccctcatcgcacaaggcgttgaatctttccacggggggatccgtggctcccttataggccctaaaaatctgcttggtcgagatgacgcagaagtctgggcaatgcttgttgtagatggggtctttttgttgctcctctctacacgcatcggcgcaccaaccttgtaataaatccggcggtccggtggctgctactgccgcaaccaccaccacaagggtggaaaggagcagagccaccgaaatggtcttgttttgggccattagcaccgtttatgctgagcagaattggtgtggagctaagatgactttccttaccctaatgctcatgttatatactacgtacgtgatagtacaagagctatatatatatggggccgagagagcttcatggaccaccaatgagactaaatataggcatttatatcatcttcggttgctagagcggagactcattccttccttatgaccagagagtgatgaggttatcttgccatggatgcatgcgtttaaaaattttaaataaaatggctgtcgttcgttgtatgcgttgatcacttgctttttttagatgatggatttgaaaaatatagtttcttatttgtcacatcctgattttttcaggatttataaattatttaataaattattattagaatttatattaaatgttctttaatttacaagtgaagttaaatgtgggaaataaaatttcctaaatttaaagcatggatggatttaatttttattaaattctccatggttaattacactctctgaaattttctcggatttttcagagctcaatttctaaatgatacaaagaacagttcagtaattatttgatcaataatgatctaattataattgttaagagcttttcttgtttaaaaatccttaaattataaattgttgtttaaaaggaattattagaaatgatcttaaaagcctaaaagagaagatctaattttaattaataaattccaatataaaatggggccagataaaatttcattaaatacttctcttgattctatagttcctagatttttctgggatttatttgagccaagaaagtatttttaataaatggaattgcatttcatgaataatttaaattgaaaaaggtttttaaaagtctcttttggctttgggccgaaagtcggcccaaaaacctctctctttctctctcctccccggcccaagtcgacccagtccgccgcgcccctccctcctctctctcagccgctgacaggcgggacccacttgtcggggtcgtcgttctcctcgcgccggccgccgctcgaaaccctagccgagccgcttcgccgccgccgctttccaatccggtcgatcctttctcgatccggtgaaatctttagaggggaaataatcttctcgatctcctcttccttttctcttttggaatcatcgcctaattcggtttggaaactcgtggattcgaggtcgaatcggattcgtttctctctctcgaaccctaacctttccttctcgccgccggttgccgtgggccttcgccgccgcctccttgcccctataaaaggacccccgagctctcctctacccgccgccaccctcgccttcgcctctcgtcgcctgtagcgtcctagcgccgtgagacctcgcgccgccgttgtcgccgccgctccagccgtgcgccgccgtcgctccagtcgtcgccgtcgctcggggaggtcaccgtcgtggtcgccgttgcgtcgccatccccgtccaccgcttcgccgccgccgaagaccgccggagcaccgccgtcaccgttgacccgaagaccgccgccgcttcttcctcatcgccggcgccgtccgttgctcttccgccgccgttttggtcaccggtgagttcgcctcgtcgcccgcatcgttttggtgccctccgttcgcgtcctcgcaccgtcgttcgccggcgagcatgcgccgcccgagccgtcgccggtggtgacgtcaccgctgacgtcatcgggaccgtccgccgtggcccggtcgtggatcggttgatctcggccgttcgttttggataggatcgatctcggccgtccgttcccgtgaaccgctgctgtgcacccggtccaccgtgaactcgagcccgctgacgcaataatcctcttttccttttcaaaaataattcattattgcgtcataattcaattaaaatctatataagtgctttaatccgatttaatctttgaaaattcataactaattctttgtaactcagtttaatgtggttcaagttgcaaaagttgtgtaaaataaagatctacataataaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgccagtgcgccggaagtattcaagaggattaattgaagaccgattattgcaaggcaagtcacacagatcctaaacacaatcctttgagcatgttgatcctatatttaaattctctatttatttcaaccgtgtatttattttcgaatgtcattgggtggtgtgaatctattcctttgttatggccaatttgcattgattactttattctttgatatcttgggttattataatttgactagttaagctttatatattggttcagctagatattaggtatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtaggcaacggctttaccttttgtataacatgattcattgcgaagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttatgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcaatgttgattaaaatttctgattaattactccactgttttacttctcctaaatgttttgctaaatgctgattttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttctgggcgtgacattattgcactttctagccataatagaagccatgtcttcaattaagcttagcggcttaaatcttttacctcatttgccgcacacgtatatgttggtatttcttaacgtcattactagaaatatgaattccttgcaatggcgccgaaatacttatggtatactatggttacagatttcatccgcaagcgcacggatataccattgtagtatttcacccgagagtattccaaagtgttgacggaaaacacgaggcctgggagatctgcttaactccagtgcaggtccaaaactcgccttcgggtatgctagcgtgccagttgatttgatcctgcaatcaacaagaaataacgacaaggaaaccgcggttaaacctataaacgatagccgatcggctaagtaccgatgacatatcatttatctttgagccgatgtcatatatatatatatcgatcgacagtcataaataaataagaaagaactaaatctactcgatcagctgtagatattaacgatatatactcctcatatcgatatatatttaaatcaagtgattgggatagatcggtcgccatgccgagacagtataaatcacttagatcgaaatatatattaataataggactatatatgttcatagcatagccaatcagatagatctagcatgtatcggctaatactccgataccgctctatactaagatgttaaagcaagtagaatatatcaaacaaaggcctaatatacttaaatgcaacaagatcttaatataaagggcagatttaacatatcaatgaagcatatagggtgaatatagttaaatcaggtaagatcggctgaaaccccgatactattctaattggcaaccagaaggcaggctagagattgatattctaagcacgacttaatagatcaaactcaactgatgccgcattaagtatgaaaaaaagaacaatatctagacaatcaagccgctggaagtttcatagagtggtagatatcctatataatctaagtcaacatcgatgtttaactataactgccctctaccgacagatgttagccgataataggttaaatagcgataatgccagagattatgtaagatatatgataacttgacgaattacatagacaagattagagtatcataaagatggaagcactaatcccgagaacgcaagccgtcataacaagttttacctcttgttgaggatcgaaaccgatgcagctcaacccgaaagtaagaactcgtcgaaataaaactaaagcaaaagggtggcgatgcgccgagattgtattgaacgtgtgtgttctttgattacatgtggttcggggcctatttatactcgaaaattacaaactatgtccatatcggacacgactcttatctctaacaaactctaagataccataagtcttaacggcagacttttgcccaaacatatatctaaggaaattacataaaatatcataattaatagatacaattgccttcccaggactctatccacgcgtggccatcatcttgaagcatatcaactcaacccgatgtcgtacaccaagtcgtattgtcggaatcggctgtatcaccaaaccaaaagtctgactcgaattcagccgatccaatcgtagccgatcaggactccagccgattcttactctgttctcgcgataatccttatctctgattccacttcgatctaatcttcctttccgatgccgatgttgccaaatttggttgttaacacatgccccccaagtccggaatatttggtaatgtttcagatttgccgtatatcgactccgagcaagtttcgcacttcgctattttccgaccattactcccgtgctttaaatactaatcgtcaccctcgagaaatctcacaccgtcctcttctattttcgccgctgaaacaaactttgccctctctttgcggcgactccaccgacgcaaaaagcgattccaaagcgattccatctccgaccggacctccgcctgcgttgatgtcgtcctccgccagcccgtctaccgcgccatcagccgagtacgctgaggtaaggtctcatcggctagatcccttttcctcgcatgaaatcgatttcccctttcctcatcttgttttcttcttctcgattcttttggatttgcagcacctctccaatctagttgcgattcccagcctgtcgcatgaaaaccattactttcttggtccaatcggcaaccttgaccccactgatttcatcatcggcgaaagcaacagaatcccctttagattagccaaccctaacctaggtcactggaagaaaacttttaagtcttggccatctctcgagaaaaccacccctgagaggagttggaccacatggtacaagcgtgtatcggctagtaagaaagttcactgggatgaaatcgggattggccaagcacttgcccttaccatagccaattcagctaaggatgaacctctgatggccgctgccacttatttctggtccaataccatcaatgcctttctgttcaaccgagggccgatgactcctactctgattgacatcaccatgatcactggactagatgtaacctcatcggccaaccctatgagcatgaataccaagaatcaatttgattttagaaccaaaagcataggtggctggtctggctatgtagctgcatacatgggtaaagggcctgtcactcctcgagagcatgtagctttcttgctaatgtggttagaaaagttcctcttctgtggatccagttgtggtcctacaaccaactggcaatttatagccgaagccctagaatcaaagaaacaatttcctttgggcaaaatcctcctcgactatttataccaaatgttgaacaatgcatcggccaagatagctgtcggatcggtagttggagtaggtagaccatggtggttgctgcagacctggttaaacctgatggtcttgaaagttgtcaatcggccatctgtgacagaagctgaatttccaaggtttaagttgtgatgtaattcaaattattattgataaccaataatttggtaaattattgattttatttctctttgttaaattacatatctttcaagttattattcatgtgagatccattgggtaccggcgcctgccgggcatgggtatgggtacagagttttgcccgctaactctagtgggtagggtttgggcaggcaatgtcgggtatcgggtcgggcatggttttactctacccgcgcccgacccgacccattgccatcatccctaatgatagatgtaattcatggctctttgatatgtagctctagcactctttaaaccgaaagtcattacaacccactcgaacaagccgattgcaccaggacacctaaaagctgtcttatggatatcttcttcggccataaagatttgattgtatcctgcattaccatccataaaactcaaaattttatgccccgaggcagcatcaaccagctgatcggctaccggcattaggtattcgtctttcggggtagctttatttaagtttcggaaatcaatgcacaccctgaccttgccgttcttcttgataataggaactatactagaaacccactcagcatatcggcaagaacaaataaaaccagcatcatataatcgtttaatttcagtcttgacaggttcaagcatatcggctttacatctcctcggaggttgctggtgtggcctaacccctggtttgataggtagccgatgttcaacaatcgatcggctgagtccaggcatctcataatactcctaagcgaagcaatatctgaattctttcaacagctctatcaacttggttctaaattctgcagataaattcttactaataaatgtcggccttggtcgatcacctagacctatatcaatttcttccaaatcatcggccgacgtaaaaccctgtccttgcttgtcattgagatcatctattgtgtccttgttgtagacatctgaaccctccaagacgccctcaaaataatagcttgggttctctatcttcaattggctatatatcagaatcggacacttttagaaaatctccatctcaaactattccagataaataatcaagaccatccatctcccaaagagctaaatcggcactggcaacattgactgacctgtcagctggcacgatttcaatcttgtcgccttgccactgaatcaagcattgatgcatggttgaaggaatacaacaattagcatgaatccaatcccttccaagcaacaattatgccgcgcagaaggggcgtgcgaggagcgacgccacgtcggattttgctatagtgctcgggtgtgtttttgaaaaaaagccctccggttttctttaattacgtataggcccctcacaaacagtgtttgtataggaaaaatcgtggacatgaatgtaaaaagtgaaaagaataggggctttttcgcaaaaaaacgcccacactacgtaaaagcatctccagcagtcttgctatctcactctccgagcaaaaatttagcaagtttggttcaaaattagacagactccaacagacttgctatttggatggccaagctatcagctggccaaaccggctccctgcctagccaaatttggccagtcaaaaccagcttgccatccgtgggacccacgcgtgcttccccctctctctctccgcacactctaaggcgcgcagcagcatcccggcggcgtcgtcatcccgtcgccaagtgtcgacatcatcgtcgcccctccgccggctccgctccttcgcgccgcccctcctcgccgcctcttcgccggcgccgctcctccgcgtcgcccctccaccggtgctgctcctccgcgccaccgctccgcgccgcccctcgccggcgccgctcctccgcgccgcccctccaccggcgctgctcctcctcgctgcctcttccccggcgccgctcctccgcgtcgcccctccaccggtgccgctcctccgcgccactgctctgcgccgcctctcgccgggaggcgccacccgcgatgcaagccttgtcgaccttctccaggtcgcgacgcgacgcggtcctggaacaccgacttgccgcctccgccaccagcttggcgctcgacgccaggtcgccgctcccgcccccgccagaccgcccgccgtcgccgccgccgtcgtaggaggccattcgcgtgagctgggtagctagctagctagctttagctttggatctgaaggataagaagaaagaaggggagagggggggggggggaagaggagtagaggctgacacgtgggtccgtcccatctagtttgactggctaaattacatggagagttggctatatggctatttggagaggccaattcagagagactgttggagatgctctaactcccaaaaccctatccgccgccgcccccttctccctctcgtctctcgctcgccctctccctcccgctctcccgccgccgtcgccgcctccgtctccgcgttcccctcgcgccgccgcctctgcctccgccgccgcggccgcgtccacctccgtggccgtcgcgtcggcgtctccgagcgccgtcgccgtcggcgaggcgagcagccatctccgcctcggtccccaccgtcgccgagcgccgccgctgcgaggcgcctcctccggccgccggcgtccggatccggactccatgttgtcggggacgcggatctgaccgccgtccatgcgctgggcagcgtctcctcctccgccgtcgccgagcatcgccattttcgcctccacctcgctctggcgctgtcgagcgccgccgccgcagcacccgtcctccgctgccgttgccatcgccgagcgcccctgctgggtccttcgccgccatcgccgacggccgctgctccgtcctccgttgccgctgccatcgaagatacgacgttggtgacggagccggcatcaatgaaggcggtggcagcagcgagaagaggagaaccgtatgtcaccaggctctcgagctcgccccagatcagtgccctctgtccttctgctcgtcgtgaggacccgccaaccatgacgacgcctcattcctcctttcttctgtgctcagccacggcaacaccaccaccatcgtcgttcctgtcgttgcagcccggtgagcgttgatgggaccggcgacgttgagtagagaggagaataagggtggaggtggtggcggcggcgacgacgacgtcttggatgtcggtgccggtgggggcgggtgcggcgtccgttgtgggcggggttggagcggcgctggcctgacacagcggagagtgccacggggcttcggttcctgtaacct

SEQ ID NO: 59108 - DNA, 17202 bp, Oryza sativa
catctaaacctctttcaaatccaatctaccatatttttatgtcgagttaatgtcatgttatccttatttttatttaagaatagtaggtatatatgtagttatatgcatttatctgtcaaaaataataagctattatgatttatgagttatgtacatatatttgtccaaaacattaaatttccgtcaaattccgattactcatccgtactccgattaatcgtttagcggtaccctctccgtccgacatccgtattccgtcatccacaacactgagtgggacgggcggccggcgaccgaagcggttgacaggcgggtcgaagcggggcagccggccggcaaggttagctagggggcgggtaggccggcggcggcaatggcttcatctccgccaccgagctcgcgcgctccatggccaacacctcccctggcacgcacggacgcagtcggcgacccctccccgggcgtggtcggcgacacctccccccgcgtgcccgtgctgctcctatcctctccggccgccgcccgtgtacgcacaccgctcctctcctcccgtcggccggcgcccgcgcacacgcgccgctcctctcctcccgccggccggctcccgcgcgctgctcctttctcgtcggccaccccgcccgtcgccgcttcggtcgccggcgaaagtgagggaaaagtaaggtaagagaggccctgccagtacctgtcagtggcagaagggagaaattttttttaaaaaatccatgtcatcgtccacatggcatgccacgtaggcaagaccacagtcaaacgatgctttggactaggatgatacattaaaccaagtttagagatctcgatgctcgttttgcaagttcgtggacctaagtgaaacctcgttacaagtttaaggaccgctagtgtaatttactcttttttattttataagcagagaaaaattcttaccccatatccttgtaacccgagaattaggaaagtgcatgccccacatgctaggacaccggcccagaaagggatgtggagtagcatgttgtaggctaaagcagttcctaaaactgcacaaagaccacagaaagcaccatgaaccttgaagaatttaaatacagaagataaaactgtaaagttctgtaagatttataaaggagaactgtagtgtatagtgcagatcttgtaagcctatgtcaagaaatagattataaaaaatgtgatcaagatagataagttaactggcacacaagaaaataactcccaccagttacataaacatgttatcttggacattgacatggtctccatagtgcaacattagatggtaatttctaatacaatatatttattataaaccagcaatataatactataaggaactttccacaacaaatctatttagaaagaaatatgacaatttaaagttttgaaagtttgacttagcacatgtccaaattgatttatgtgaccagtgggagtatttgattaagaaataaagcaagataaacacatggaaaccctataccgtgagagtaacattctcataaaccacactattggtgtttctatcttcaaaatataattagagttatatgcaataatcatcaatattttagataatggaatattttattatcccggccactgcacccagagatggacaaagccatgatcacttatttacaagttttccatgccaagaagaataaaccaaacataaagcaacatgctacagatgttgatgaaacacaaaatttcagttcgcttacaacctattgctcaaccaccagccgtagttattgaatagctctattaaatttataattcaataaaacaaactctgcacaaggaagttcattcaaaatattaacctaatttatggattacccccatggtttatacatggacaacaaatatgctgtaaaagaggatactatttttccaagtaacaagtaaaaatagtatttcaacttttatagaaagcaaagacaaacaacaaatactgatacatacctcctggtatagtggcagcaataacaccaagctctgctagtaaccataggcagtacttgacatactttggatattcacccatgcacaactcagcgaggtgccttcctacaatatatttatatggtaagtttcatagaacatgtatttttgtcaccagcttgataatatgggtagttagtttcacctgtaatgatacccaaatttgctgccaatgattgtacagtcaacacaaatatgaacccaaataggagtacccatagcaactgaaaattttaaaaatgaatgaaggagaagtgagatggcaaatctacaatcaattgacaaaaatgtataacataatattccacagaaattttgagagctttataccgaatatctgtggctggatccagctaccaaatcagtctgcactgttccaattttcaaagtgaagtagttcaatatattagtactagaaaaagaaaacggtggtatatgagcatgtcctgcctaggaattctagtggtatccatccatgttccttgatcctattgttgaatttaccaaagccatttatgacttaaaaatgtctttttctcaccatgcatggatggatggacacaaactggtgagcagagacaggcatagttctagtccaaggaagattgaaggacaaaggggacttacagttactaggatcaaggtatgcgatggagataacaaatccaggaccaacatgtgcaagaaatctcttccaagtgggtgcctgctctcacagatataaattactaaatggactcaaaaagttctgaaaaaaaaagttgcatgttgcagtatttacaacttaaatattttttccctggtggaataaagttcaattgtcttgtaatagatggttttacactgttttaaacattagtttttccctaaccagttaatcttttatgtaggtaatgcatatatcagagaactacaagtgaaatatttttctaaaatttggaagacatctaattttaaaaattcaagaattgtttgatccttgagctagattgccacattagagccatgttaatcaaagcaactctaaatttgggccaaagttgaaaactgaatgaaatacaagttcaagggtatatacttcatggttttgaagtttacgatcgataattgtttaactctatgaaagatcatgataataaaatggtttttttcttttctttcttttttctcgaaaacgtaggagaattgtgtttcatttcattaaggggaagaaaaaacaaagtagaaaatatttacaaagtaggaggacccgagccctcccaccgagacccacgcacccaagaccacaccgaggagcgctaactgcctaggttagccatcccactgaggagcttttgaagtgccaaagctcctgcggaacaccaaagattactcttgttttctaccacttgcaagaccgagacaccctcgcaatttttgttgaacccatgttatagtaggggtgaactgtacttttgcggcactaaatagagaaaagaacatgtcactgacaaatgacggtataaaaggaaagaaaagccattgtctgatattatattgtgaaattcatgttcgtcgatggtattttgtagaacacaacatttgttgatagcatattgtagaataagtcataatacaaagtcagctacaccaacgtgaaaggaatgacactaaaatctcaactcggcaatacgcgagtgagttgaattggcttactcctaaatttttttttggggaatacggcttactcctaaattgaagcccaagagaaacatgcctaaccgatgtcggttgataatcattattgcaagaaaacatccttgccaactactcgaagaataatcaaaccatggcaaaactaagtaatataccacaaaaagggtctattattttgtaaccagacgaagagatgatacgatctacggtcgagccaacagatttcctatacaaaatattctagcaaagccaaaagtcctcattgttatcagaaattttgattagtgcctgtttctatccccgtttgaggaaaagtctgtgctaattttacaaagcagagtacatagagatcatcaaccgtacatattcatttcagaaatcaatcaaacggatattcctcagatgtctgaattggctgaggcaatcgtgctacacatggtttgcttcctacttgtgcggacagcaggagagaagaagaaattgacagcaggcagcctagcagaggaggaagaaaggaagaagaacaaactaacctggacatcgccgtgcagaccgccgtgttgccgcgacggcgaagcccctgcggctgcggcgacctcaatctcaatctcgtccccgccaccgccgctgccgccaccgacggccgcgaccctcccgctaccgttcaccctcccgtgctgctgctgctgctgctcgtgctccctcccgatcttcgccccctcctccattgctctgtctcagtagcgcaactagtggtggtggtggttgaccattaacctgaacctggcgaggccagcaccagctccggttgccgcaagaaaagcagcagctgcctgcatgcaatacgggtcaactccgcgatccctctgcatatctgtacttctcccaacgtacactcggtgtattcgagatgcgacgcaagcatcgaggacgaaagtcgtcggcttgggggcaggaacagcactcacctaacccattccctctctcaaaaccccctccaacccaaacaaatgcccattgtttaatgcccgccgatggcctctcgcttccgacgtacagctccccttgtacggcatgatgcggaattgcggattactggtgcaatcgacggtacggatcgaggtggtgcgtcaattggacatttggattgcggaggaggctgacagcgaccggatccgcggggtccattgggggcgccggtgggtgcgcggtgtgcgtctctcacagctggacaaggccgcgacagccggccgggcgacgtacggcaggcagtccggatcagcttcttgctctgctgtggatagaatatagatagggatcgcgacaaccagttgaggacaaattgtaaacgccaaaaatttacaaatgccgtcgatgtcttcggtctctctagaaactcgacaagaaagcggcgacgctggccgcaggctccgcaagaaggcggtgtcggcgccgacgaacctcacgaggaggcgatgaagatttggggattttgggacgatgggtgcgctgattggttaggagcgatgacggaggggatcggggtgatgcggctatgaggcgtagacggatggatcgatgaacccgtggacatcgtcccggacggtgcatgaagggtgaggtcctgtagtactgtagcaggctttctgggctgagaatcgtcgaagctgagaatcgtcgattcactgttggtagtgggtcacaaaaactaaagatttaatatgatctcggtgccctatattgataatagttgaaaacaatctgaatcattatctgaagcgttcagatttttttttctaccaccatcccacttaactgtagtagaaatatttaggggcataattgttaaaaaaagttacggaggggtaaaatcatcctttaaagttgactaaacttagcacttcccctcaatcagccgtcgcatccgccaccgatgccgagcatccggtgtctagtgtctcctccccaccaacgcctccaccaccaaaaaattgcttatcgtacccattcatgttaggacgcttgatcaaggcgcatgcccgatctccacttcgtgtaaccaaaccggttaagtcatgtataacttatctggactccacgccatttcacgcaccggatattcgaagtgtttacaaaaaacaaaacagaatttactgcagcaaaacaaaactgcaaaaaggagaccacatctacgtaagggtaaggaaccaattttgacaaaccatctgacaccgtacgttgtgcacgcgcaccgcctcgctaggacaggccaggcgagcgagtgcgcgcgtgtgttccccttgttctctccacctcacatgcctcaagtagctagaagagtatccttccttataaggagatcttcctctcctagaatgagcaaggtggtactaaactccccatgcatgccatcctatgaggtgggcttttctgattttccaatgaattaatcttcgaatgggctaaggcccatctattaattccaacaaccccccaccaaatctaaaaaacccactgaaatttgcctttttcaatgtattgtttatataccagcggttcgatggagaccaattaaggttgaatatccacctaaaactccaagctacacttactcacaacttgaacaatggattacgccttgaagcaaggcttatacaagcaagtttcactcagagtcttatctggtactagaccgtcagtcatagtacaaaaaaccggaccggaccggcggttgaaccaggaataaaccagagccgaccaccttgacggctcagttctgctaaaagaccgcccctgcaatcgaacaagtaaaaaaccgtgaaccggccggtttttgcttgaaccggtgaaccggtggcaggttttaaagtatcgaaccggtttttatttttcctatggcagtatgacatgattaatttattatgttaccataccacatttatttttttatgttgtgaccatgtaataatagatatattggtttatttatgcatattttcaccaatttgtgatggttctatattaaaaataatgaaaatcaaatataatagtaataaataaaaccagtgattcaaccggtgaccggtgaaccgacagcccaagcgggttgtcctccggtccattttttgttactatgatgtcagaagaataccccttgggtggagcgtataagtcatattctctggtctcttagtaagcttactagaagattcacccaaaatctccatcgactgcgaccaacagtcaatctcacaaaggtgcattctttcaagaaagctctgcaggatagcatcttcgttaattaaagccaacaaaactcatcacgacatagccaacctgtcttgcagctcatgagagtacatgcatcttcacttagttaactaatagtctgtttacaaaacctccatgaaatagcaccactacctagtgttaaaacatatccactaggtgccaagtttctcttctcggcaaccttgtgaggcttgcaaggttgctttgattgcacacaataatgacacttagaacctttgacaatggagaacttagaaatttatcacataccgaaaagccgagacatcaagccaaatttaatatgacatgaacgtaagtgccgaacattagcctcatcatccacactgccacaaatatggttcacagacttattgcagaaatcagaaagggaaaatcggaacaggcctccgcactcatagccttttccaataaaatatccaagtttagacacgactactttattagactcaaataccaacttaaatccgtctctacatagacgggagccactaacgacattcctgtcgatagtaggaacatgttgtacgtttttcagctgcacgatctttcccgaagtaaacttcggatctaccatgctaacaccatgaacaaaagcatgtgacccattccccattaggacggcagaatcccgtgcgacctgataagaagaaaacaatgagatgtcagtaaaaacatgtacattagcccttgtatgaacccaccagttagtagactaattaactaaaaaatagtaggtaaaataccataccggcttccatctccagtgttgccaatggtcacattggcagactttgaagtctgccctgcaggtggcatcatccccttgcgttgtggacacgtcttggccagatgaccagacaagctacacacaaagcatgttctctcatcctggtttggattgctattgttattcatctgctgcttgaagttggtggtctgtgaggtttgtatttctttttattcttgttttgggccttgtgcacaacattgacactagactgcccatcatcgcccttagacgcggctatttttttcccaagctttctcctcaacatcaagagatgctatcaacccctcaacggagtattcttgtctcttgtgtttgagtgcagtaccaaaacttctccaagatggaggtagtttcgcaataatttacccggccacaaatttgtcaggtaagacacacttaaggagttcaagttccttaaccatggtctatatttcatgagcctgctcaactacataacggttgtcaaccatcctatagtcataaaactgctccatgacgtacagatcactgctagcatcagtagcaccgaatttgttattcaatgcattatcccacaactccttagcgtcggtcatgtgcatatataccccgaccagacgacactaagaacgctaagaatgcatcctacaaagagagtagtggcctcctcgaattctttctgcttttgagtagtgagaactcattcaggtttgccattactaacccagaagcatttcatagccatcagccacaaagtgccccttgatcagccctctcttaaagtacacaccggtgaatttgtccgacctagtacatcggcaaaaccagctatagtaaaaccacggttcctataataaagtttttggattgttgaatatataagcacataatgatttaatttattctataaataaatcatgacattgtagatgtaaactagcataatcgcatcatacgatctacacgtgtaaactagacggtaaaccatgaatagattgaatatgcgaaacatgctaaatgcgtatcgagggttttggaaaatcggttgcccagcaagaaggactcacggtaccatgcgttgatgacggcgcgcagcacgtgaacgaagaggaaaacgagccgttgtggacgaacaggaagcagtcgtgcgaagcgcttcccaaaatccttattgtcaccttctcccagtgcaagacgtcgaaggctatagttccgaagacctgctctcctgatcgccggtgcatgtcggcgagtgggatggagtagtctacgagcaacggcgcgatgcagaggaggaggcaaaccctagattgattttgcgtgcgttgcatggaggcggggactcaacttatatagagatatcatgtcacttgatcagggcgcctgcacgctctccactccgcgtaactgaaccggataagtcgcacgtaacttatctagactccacgccgtttcaagcaccggattattcggagtgtttcccaaaaaaaaacaaaaaacaatttcatgcatcaaaataaaactgcaaaagaagaccacatctgcgcaagagtaaggaaccaattttgacgaactattcgacgtgtagtcgtgcatgcacctcgcctcgtgtattcctcttgttacctccacctcacatgcctcacgtggctaggagagcatcctcccataaggtggcttttgtgattttccaaagaattaatttttgaataggctaaggcccatctattaattccaacagcctcatgatgtgttgttttgtgcaccttctatcctcaccggtagtatggctctatcattgatggtgacatcttcttacatagatctgtcaatcgaggtcagtttgagcatgtagcagccttgcaggcaattgagcttattaacctgtgttttaactgaaattttatcttttcaggttgtatgggaagataccagggcaaaagtaaatctgcatcccatcttgtagttctatggcttttctgggagaggttaaataacatgtacttgtaatagtacggtttgtgttaagtatttgccagtttattggtccgttgccttctgctcatcgctgttaagtatttactggatattgcatgtattcgaattggataaaaccgcgttattttctcccagaagaacttgcgagctgcaaatctacaactaaagcagatatagagataggcctgttatagaggcgggcccaaggtattcaaaataggaaaaaatccaatttgactcccttaaatatacgtcgaatcttattcatatccttaaaccacaaaaccaaatatgatgacttcttaaactattaaaaccgtctaaaacgactccctcggctgttttaagagtggttttcgctgacgtggtgtacatgtggccgcctagtcatcaaataaattaaaaaaagttaagctggcccacatgtcatcccctccctttaataacctctctctctccctcctttcttcttctcggccccttccgcctcggcactggcgacggcggcgtccggcggcaagtgtacggtgtcgagggcccgacagcgagggcgtcgcttgcggctgctgggcccgacgacgagggcgttgactgcacagtgagatcgacgagatcctcgacctagcggaggcccagcctttccccacggcgtttctggccgctgcccgcctcgacagtgccctccgtgtcgccatgtcgcgcatgacctgcacctcgccgtcgacaagctcacggtcggtgcttccgccaacgccctgtggacacgccttagattgtctccaacagagaaggcaaaacgcaaaacagcctccaacagacaaagcaaacagaggaggcattttgcatatgaggagagagggaacgcaaaattgccgtctctctccaagacgcaatcgtccacacgatgtggcggtgagctcgaagattcgcatcggggcgcggcggccagcggacgatgacatcaaggcgagcccgcggccggcgtttccaggcatgtctacgacggggcgaggaggccgacgacgaatccttgtcggggcgcggcggcgcagcgtggtgagcccgcgggcggtgcttgcacgacggatccacgtcggcgaggcagcaaggtatccacgtcagcgaggtggcgaggcgaggaggatctgtgttgacgcggcaacgaggcgaggcgaatccgcgtcggtgcgaggcgcggcggatgcccgtcgagtgcccctggcgatttggtcggcttcttggacggcgacttcttggaagacctccgctgctccacagcgtcgaagtcccgcgggaagaactcgatggagccgaggcggcggcggtagagcagccaggccgccgccgctccctaccgccgtccccaccaccgtccaccgctcccgaccgccgccgccgccgctccccaccaccgctccgagcaaggtgaaaaaagagacccgggagggagaaagagagataagggggagagagagagggagagagggaggaggaagaagggaaggagagggaggatgacatgtggggcccacatgtcggtgggtcccacttttttttttttgtgtgtgtggatgatatgttggtcctacaaatttttgtttttttgtttttactctaattccacatgagctacatgtcgacgacacgtgggacgaagaccgggtcaacaccgtcacataggcgccacatcagccaaaaccgcttgcaaaaccacctagggagtcaaattgcatcagtttcaatagttcggggagccatcttatccggttttctggttaaggggtacgaattagattcggccaatatttaagggagtcaaagtggactttttccttcgaaatatgaagggataaaaaaatacaatatcaagcctaataaatgatatgtatgtatagtttcgcatagttctaaactatataatatataatggctataagtatattttcataaatttatagaactggtcatgaaatgaattgtatgtattttaacatatagccgaatgggctgagttgtggcccaaactcagtgtgggctgagaggaaaggggaggggagtggggtatttttttcatttttagattttttttaatatttacagaaataatctatcggccaaaaaaaattgcaaaaatagaccctgccgtccagaggtgggcggcaagctgacgtggcagacggcgggtcgaccgcgccgtctgccgccatcggccaaaattgtaattagccccttgccgcccatacagagggcggcaaggggctaattgcaattttggccgcccataaagaggttgcgctcgtactttgtgcatttgggccccttgccgccccagtagagggcggcaagggacccagatgcaaaaagtaccgccaaacgatttttctatgttatgttaataataaataaagaattatttattggtaaaacttgttaatattgttataaaaatgtattgaagttggttgtttcgcaatttcatatgttaagtaaggtattattttgtaacttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaacactgtattgctctgatagttcaagctgcacaacacggctaggtggagttagaacccttatggtgtctatccattctctgtattgacatcttcttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctacatcttggacgggcttcccatggagggagtgccgtagttagcacccgccagtcgctctgttgttcacgacattgtcgttcataagccgttttctctgtaagtattgctcagtactttcggatgcgaaataccagcgaccttcttgtaaacaagtggttaggtcgagaacgggattatctgtatcgacccactcgatgtatgcgcaagccgtagtgcgggtttgccgaatagagtagtgttacgaagaataaaacgattgcccgtacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagttcgaatcctcaacaccccggcgtctagccattgacgaaagccggtaggatttgtaatgaagcaagtagggaagagagtactgaatgtgactgagttctgaaagattgtgaggcctcactcgttaaggcgacttatataggcgcaaaaaatgagtgatatccctgacatgtgaacgtggaggggcatggttggtacgcctgattggggctgaaagttacatgcctgatcggcgccgaaagttacattggttgtatgcggcaaatggcaggcaaatactcgtatcgcacgcgaataaaggaggctacatcggcgtggcagaaagtagtcgtgcatgcgccgaaaggtatcgtgcacatataacaacaacgtattcattacacaagcatacagtactggaaagtgaagcaaataaacaaagagaagaatgctctactggccctaccccgcgccgcgaccacgcttggtcctccgggcctgtgctcgcacgtggtcctaggagtaggtgaaacgatccggtggcacagcacgggtagcacgagtgtctggcggcggagtggcctgcgcctggtcctgcgtctgcaccggcggtgcgcctcccagctgtgaggggccgatgacgtcctccgtcgagcctgaagcgaagtcaaagtcagtgatgtcgaagagcaaggtggaaggcaccaagtggtccgacgaggtcccagcatggtccagtggtggaccctgactcgacgtgccggctacctgtgacgaagtcccggtgtactgccagaactgcactgagtgcgaggtcgacgcagctgcctgagacgctgaccatgcagcctgggagaagtgggcggcctgcgtcatagcgaattgggcgaaacctacacatcgactaagacgctgaccatcgcatttgctgcaacacttcaccctgccagcctccgactcatccatattgttgtggatgcgacgagtcttcctccttacagccttgcctcggagcttcgatgggtcaggaatattgagtacttcatcgttagtctatgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaaaagcaatgacatgtgccgtcagctttgagaacacattcctgcttcactctcttgcggtagatacccctgcatgccttatcttgacatagtatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaaaatacctgcatgtcccatgtaaaatgaacttcactatgccaactagtggcagtccacggacaccgcgcatcacccagttgtaaacttctaccaaatttgttgtcattattccatatctagcaccacctgtgtcatacgccttggcccatttctcttttggttcatgcagaatccactgagaaaatttctgaatctccaatctagttcttctaaccaatgttggactatccgttgggagaggtccaagagcttgaggagggtcagtaacggcagtcaatggagccactgcacgctgatcactgcatttggctgtcaactcatctaatctattccaaagctcattgaatttttttctcctggttctgattgcatagcctcttaaacatgttcatgagctccttattcttgaattgcttgaagaaattagctcccatatgacacatgtaccacctactctgtacatcttcccacacaccagggtatcctcattccatactcccaaactgcaactcttctatcgctcgcagaatgctagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaatcgaggggaatttcttcactgcgtaagagctcccagggtttctttcctcgataacaccaagcaggcgtggcaaattgtcatacgaggcttcgtaagttccaaatctcatctctattattttctgtttggccctccaggccttggcatagctaacagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttggacttggcaacccaaaactctctatgaagtgacattgcaaaatgttttaccgcctccttcatatcttctgctctactataaatcgctccctgaaaaacctcattttctttgtactcccatctcacactatcctctttagagacaaccagccaagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccatagctagaggccacccgcgttacaatgcattttccacataccatctccatacttgagaattttgaactggcattagttcccaataaaaaccctcagttgcccgacttactataacattgattgttatgtcacttgtctgtggatcaactctcaagcctctcattaaccatccttttatagaaggtacactcctctcaacaggtctatcaattcccctttctgatacaataaaatctgacagatctaccccagttggcctgtaacggacgtttcctgggccatggtaaacttggaatatttgtttgttcgacatatctgtcaacgaaataactagatcatattactctttcatgcaataaacatctacaacgtaatatcttcttgtgtatgccaatgcaacggtaaagtattgattccaaactagcagatctacgtagttaccgatatctacaatacgcacttctagattagtaaaactaaaaccctaaaaatataatgcatttattcaaacaaaattttaaaaaatacacactatttaactcaatagtcacatataggatctatgaatattacctgaaatcggcgtctgaatccggcagggcttcgccccttcttctcttctcctcccctttcttctttttcttttcactggatttgaggggggaggaatgagggctgg

SEQ ID NO: 59109 - DNA, 23751 bp, Oryza sativa
ttatgcatctaaagtttatacacttaaagtttatagacccaaagtttataagtcaaaagtttacatacccgattcaaatttgaatttgaattatatccattcaaatttgaatttgaattcaaatattttctatatatggtatttctatgcatctaaagtttatacacctaaagtttatagacccaaagtttataagtcaaaagtttacatacccgattcaaatttgaatttaaattcaaatattagtttatagacccaaagtttataggtcaaaagtttacatacccatttcaaatttgaatttgaatttgaatttgaatttaaatattagtttatagacccaaagtttataagtaaaaaattacatacccatttgaaatttgaattttaatttaaatttgtatggtgtagtagtaagaaaaaaaggggaggtaaattagtaagggggaggggcgggtgatcgcttggaagttgggagggaagggagcgatcacccgctcattaggagtactcatttaccccctccgtcccataaaaacccaacctaatatcagatgtgacatattttagtactacgaatctggacatacacatattcaaattcatcgtactaaaatatatcacatcagattctagattcgtttttaatgagacggcgggagtaggtagcaacatgggtggaagagaccacaacggcaaggaaaagaagacgaaagaggaggcgccaactcatgggtaaatcagttgtatacatttccatcacactcttgtccagaatcagaatgattattctattttcacctattaacattaaatgtttttaatttgtctgttgtttgtttgcaagaagacaatagcataggttgaggtagcctgtgaacatgacaagaaagcttgtggagccaaaaatgtaagcccatttctctgaatttctgagccatggaatgttgtgcatgttgaacaatgtctgaatattgtcttggtgttgatcagtcagtgcagcgcaagttaggcacagggcaagaatgccaaaccttgatcttccgtaacaattgttgttcgcaagcccggtgacgacggcccaggtggcccaggagcaggcagcgctgcagcagtagcagaactacccaattgactgagtgatttgatgtggcatcgatcttagttagagagatccatgcacttatgaataagaactttatataaggattgtcgaaacaagatttcggtaagatttcggtaatactagaagggatggcaattaagttagaaaagtgaatggatcaggagacagagaatttatacaggttcagatcatctcaatgagaagtaatacctactcctgtccggaaaaatattccaccgagtttgttattaatctgatgatctgggagaaacgttatgcccctaagagcatccggacccctccttatataggggaaggagacgagattacaacatacaacctataacccttaattacttgatacacaaattaacataatacccgagtcatttcctaaacataatctatctacatgatatatcccttataaaccaatcggatatccatattatgcgggtatatgatacccataatctccacaagaattggattagttgaattgttaagaagaattggatgtgattttagatttgatgcaaagctacgtactggcctattactagtagtatgaggtatcaatttaatcccttgatatgctcgacatttaatagatcatgtctgaactttctaagggcaacgacaataatatagccgattgcctactataaaaatctccaactcaactagagtaagcactacagacaacgtttttaataattgtctctaccacttactcaaaaatattattattttatctatctttgtgggcctaatttttatctttgttccactgtatttatggtgagcctagggatgaagcatactgctggctgcatgagccttggcgcccgtgcatcatcgtcgattatttagtcgacgacttccttctctctcctgctttctctctcctccacctcatatttctctttctctgacgtatgcaggctaatagacggcttccctagccttattgcacttgccctaagtgaactctctggatgcgttgtggtacttgataattaaggtgtgtgttgatgtgattaattaccaagaaactaatgtaatttactgttaggaatacacacacataaagaaccaagaggtatgtagtgacaattgacaactgacaatgatatgtaactgaataaaatgtaaaagtattatatttggttgagtgccaaattttatttttcatcacttgcggctaggttaacggaagtgagccccatggcactctttattctaactcacctgacccgcttgacttacggtcaacaattcaccaaagtggaccatacttaactatattctttccaacaagggtcccttccaacaaagtatatataatgcggataaaacactctcacttaacactagttttattagaaaaaactccctttcgtttctaaattcttgaaaatagacactattcatatttaaataaccactcgtgctttttgctaaaagaaaaaaaatacaaatatctaaaaagatgatgtactttaaacgtaacttacgtaagaagttatgtttatatcgtagattaaccatttaaaaattattagtggccaaactcgtaatagtagcttgccaacaaaaaagatacttagatagaaagagtaagaatttatccatcggtcgttaaataagtataattttaactagtcaaagacattaaacaaaagatttaaaaaaactatgcactttattaatatggagagaaagtaaggagatggagaaaataataagagagattactattgattcaatggctaaaaacaagattaaaaagatgaattagtagtgttagaagagttctactccacattaaaactacatatttaaggataaatcttgagactaacattatatttattcaggaacatagggagtatattcttaacaatagatagtacacataaatgtattatcacataattaagtacttttcttaatgcaaagatatcatatatacgtacactcaatatatagatgaaacaaaattgacatacacaaccatacatataggcatgtgcatagtactccacgcatgtaagaacacaagtagagacatgcgtgtttacacaatgtccagttataatttactccaagtactatctccatcttaaaatataataactttatacccgatagatttgacacaatctaatattattgaatctagatagatttattcataacatcaatttatgtctaatttcgatactaggttactatgtcttgttgaggatgctgatgcctttccagcgagactccatgcggttggacgggttcgtctgcatgtacacgccgaacttgaagtagtgcgagtcgccacccttgccggcgacgcggagcctctcccggccatcaatgaagacggtgagctgggaggcggcgacgtcgtggatgacattgaggcggaaccagcggtcgtagatgttggtctccaccacctgctggtggtagtaccaaaggtcgccgccatagacgtggagcatgagggtggtggcggtcccgccaccgaacacctgcatgatggacacgccggtggtgccggaggggacgtaaccggtgccctcgaattgccacacccctgacgagtagtcataaccctgcatgcaattaattaatgtattgtccaaatcaaatcacttttagattcctcgttaatttatttggatgtgattatctatagtaccttcatcccagaataattactccctctatcccataatataagacgtgctcacattctaaggtttaactttgaccactaattattgtaatataaattaaattttatttgctaaattaataccattggattgacatttaaatttactttaagatagttataattttgttacaataaaccttatagtatatgagaattataagtcaaaaattagttttgaagattgtgccaaatttgaccatgtcttatattatgggatggagggaatatattttaccatttaaattttatctaaaaatattgtatttgtaataaggtgaaacttatccaattagtttgacggagatatcatgtcttctgccctcccttttttatatccccatgtgtcttacctttagttctatgtatgtagagttattatgatcatttgtgtgtactgataatatgtctgaattttcaaaaaaaaattattattttttgggacaaagggattatggtcttatgcttatatgacgtggttgaagtttgatgtttaaattaatcaaactaaaacaattatgatgaaattaatcagtagttctgctctttttttccctaataatttaccactacacctcataaaaattacttaactcaaatcatacaattttttttctattcaaactttattaagtttgaccaaatttatagaacaatttagcaacgtctaaaacatcaaattcattttattaaatctagcatggaatatatttaatttaataatatatttgttttgtgttgaaaatgctaatatatttttctataaacttgatcaaagttaaataagtttgacacgacttataatattaaaaggatggagtagtataaatggagtggaatagctagtgagtacttcctccgtcccaaagaaaagcaatataggaggggtcacacctcttagtacaatgattctggataaaccccctcctgctacaacgaaacccctcacatctcctcttagattgcctagtcaactagtggtattcatttttccaacgaaacccctcacatcccctcttagattgtctagtcaactagtggtattcatttttccaaaaatataggtagctatcacgtgaagtatacgtatgggcagacttttgaatttgaccaacattatcttttagacacaaattaatgaaaacaatataaattatataattagatttatctccataaatacgtgttttcatgtcccatctcgtcatctctatcgatgtgttcgatgactggactgatttagagcattattattacataaattactgtagcagaaagtagtagactgagtgattattaatcattttattaatttattgaagctaactaattaattaatgaattaatcaagcacgccattatgataatacgcaccgtcatcctgatctccgtccttgggttggttccgctctgcggcttgaagggcttgtcgtcggagaagacccacagccgcctcaccgtgccgtcgaagctgtacctcgagctgctctccacgtcgtacggccactgcagctggaagttgccatcgcccaggctcaccgccgtgaacccgtccctcgggtcggccgccgccgccgccgccaacaccacgcacgccgctacaacccaccaagaagaagcagccatgtttgtagcttgtgtgtgtgtgtgtcggttgctttgggaattggggtgatttggaagaggtttatgtggtttatatagagctcggagggaagcagctcctatgacctggggcattattaaagaagcctcatcgagttcggatgggtggggattagagatcccatcgtttcgccaaataagtcaaagcaaaaaatttaaatttggtattgattttaagatattttctacgtaatttttttattattgatttttaagtcgctacgaaaaaatatatataaaagttttacatataaattattttttaatctctaataagccgttttggtttatcagggaatatgggcaactaatcaggctcttaatatatgacacaccttttttttaattatatggtacaacgcagacactcacaacgcacgcacacttacccctatgaacatacgcacgtaaaccctacctctataagcatctttgaagactaagccggcaaatccttgagattgacgaagtcaccacaggcgctcaccgtcgacgggtatgtcgcctaccactgaaagcacaacgccgttaaatcctacaaaattcgctcccatgaagagtcgaactagagtaattgaaataaataacacagtggagtctacttgttcacactttgatcaataataatttctaaactattttattttatatgttaaaaatcatatcgctatattcattttgtatcatgattttgtaattaatatgtagagtttagaggctatttctagaattctttgttggaaaatagtgataaaagcgtagatgtgcagtttagtcaacattttggattattaaaaccagtagtaatattgttaagtacggagaattccttcttaaaaaagattatggagaattaccacaagtggtaaatatgtttagtccccagtgtccttttcatgacataaaaaagttctataccatattttaagctttaagttgtctatagtaagagaaaaaacatagacgattggttgtttccatcagttttagtgcattcttatactatattggcaatcaaaaccagtcaagcacgaaagtaggtcataattggtgataggttgttaaaatcatcatcctgaatcgaaatgagaaattctaaccatgatcacaattatataatcgtatatataaaaatcataaaattatatattttacttatgtagaatcttacaatcaaagcatcttaattagaatcgtaaaatcgtattaaagaattgagattggctagctaggtttctaattaggacagcttcatttttgctttgttttaccctgtctccatggatttggtctatggtcatgttttttaacacttcgttgtacgcttcgctaagcgcttgcttctgaacatcggaattaccttccgatctgaacatgctcgtcagtgacaacgaaccgtcgatcatctgtaccgtgcggacaacttcttgtttctttttggggtaaaagagctactagtatttttttgaaatctatttggcatggacagcatgtgtgtaactttaaaattaaatattttatttcaaaagtatgtactccctccgtccctaaatatttgacgctgttgacttttttaaatatgtttgaccgttcgtcttatttaaaaaatttaagtaattaataattcttttcttattatctgattcattgttaatactactactactcaagtttttaaataatattcacaaaagttcttgaataagacgaacggtcaaacatactttaaaaagtcaacggcatcaatatttagggacggagggagtatgtgccaacaaagacttttcgggtcaaatatatcggaacaatttatttatttatttatttatgcattagttccatccaaagttcacgggtgtcgcatacagagttgaagatgcaatttcagtgttgtctgaagttcacaagctgatgaaatgacgataataatggaggagaaatctctctgcttgactgcttctgttcggtaaccgacttcatcctacgctgagtttgaaagagagaatagtattgaggtttttctggcaccgaaatcaaggtgagtcattagcatatgattaattaagtattagctattataaatttaaaaatagatttatctattttagaaaataaaatacaccttttaataatttaaaaatcgtgctatcgaaaaaagatagagtagcgcgctccaacttatctttagaagtcaagccaagtaccaagcctctggctgtgttcggacagcttggttcccaatgttaacgcgcggaaaacgaaacggttcattagcgcgtgattaattaagtattaactatttttttaaaaaatagattaatttaatttttttaagcaacttttgtatagaaacttttttttaaaaaatacaccgcctaatagtttgagaagcgtgtgtgtataaaaaaaggaagaggggttgggaagaaggggtgcccaacacagcctagctccaaccaaacataacagtaactgatagctggatgcctggaaacatctgaaactgtgaaacatccacatcttgcatctgcagaatcacgagcacaagtcgccgcaagcttgtgtatgtacacacacacctagataaacttgaatttctaagcgataagacaagatcgcaattcgcaagccatattcaggccctattttgtttaggtttataagccaacttataagccgaaaagtctaagcctaaacaaacaagcagcttatttttgtttagtttttttaagccataagccactctaacactattaaaccaaaagctaggttggagaagcttttttggcttatgtgaggttgatgtatgactccactactaaacttaggacattaaatccaccggcttataaatcatataagccaataaacctaagcctaataaaagagtggcctcagtcagctgtcaattgagaaggatgatacaggtgtgttgaaaaattgtgcaggttggtcaatcatcatcaacccggctgctaacaatattcagcttacaaattagcagtcaatagtctcactagcaggcagagagatggcaaaggctccattttctagggtctatgtttgaactgctgtgtcactttgaagatgagatgagataattcatagatgaagatagtatcatggtattggttcagctaatattcagcttacggattttgcctgtgaagtgaaacggttgaaatttgatagctagtattcttcaagcgtatcatgatattgcttcctttctacgccctgtttgggaaacttggtttgtagcaaccagggtttacaattccgacaggcttttccgtttcgggcactggtggaattcggaatttcgcgaaatccggtggaaaaccggtaaattctgaacaaatttcataaaccaaaatttgaatacaaattccctaagtttaccgacaaattttcgaaaaccgatcagttttggcgaaattccgatcgaaatcatcgaaatttcgatcagtaatttgttttcctttttttaattctttattcttttcttttctgatgtaagtttcagtaaatacacataatacataatgtttttcgaaaatttatatctcaataagttatatgaatatcatagtatttataagattttatttgattttatttttttttatgaattcaaatttgaatttggatgaaacttctcgaaatcttaaacggtttatactttcgagcctcatcgaaacatcaaaatttcgcgaaatcctgtcggaaatgtaaaccctggtagcaacagaatctgaatgaaaatctaagcgtggaggaaaaagcctttcaggaagagcttcctcgttcagaattgctagggcttgcaggttcagaattcagaacgcttgggaagtgtgaactggggaaggaaggttttctttgctgaaattagaatcaggagaggagatgacacgatgacagaacccaagtgcacgcatgttctctataactgtttttttaaaaaattacatattacaacgcagacactcacaacacacacactcatccctataaatgcacgcaagcaaaccctacctctatgagcatcttcgaagactgggctgacaaatcctagagattgacgaagtcaccacagacgtctcactgtcgacaggtacatcgcttaccactgaaagcacaaagccgttaaatcctggaacctaggacctaaggtgtaactgtttttttagtgttaggctgtgtttagttccacaccaaaattgaaagttttgagaaattgaaataatgtgatggaaaagttgaaagtttgtgtggataagaaagttcgatgtgacggaaaagttaaaagtttaaagaaaaaagttgaaatctaaatagggccttacacgtatatgtacaactcatatacagctagagacacgccactatataaatcaatcaaaagagagcatatttatatgcactgcgaccgtttacaaccgttgatccgttgatcaaattcagtcgtacgtaagtaagacaattaagttatatgcatagcactttcctaattttttttatttcaggatgtttttgcgattgcagtcattccttgttttgtaattgtgatttcagaatcttaggacaaatctagcaacagacatggtcaggttctttcttttggaccttgcatttataaaatacaaaaaaaacacaccatcaccatgttgcatcgcacacgaccgttctttgatcgttttaaactcttacaataacgaaccagcacattttttagagcacccgcaatgataaagtaaggtgctatctataaaatatgtacatctcagcaatagactagattaatcgtataccacctcaatagtatatctacacatgggtttctatagctctctaatcaattgtctcgtttttctctatagattatttccaggttaatagatagttttgctctctctcttcatttaatctcttccaagtaggaaaatatgctgacatggatctcttgtagagagcctataaataaccattgtgggtgcccttaaggataaatgcccactgaaccccaaaaagcgcaagcaatataggaataaaatcctatatgtagtaaggatttcccacacttagcaaacaagtaagctgcaattttcttccataacaaaattaactgtgctacagtgaggatacagcaaaactatagtaatattctaagaaattgaaacatcaaaattgatggctgctggtgccagatgttttctggagaacttgtctgctcctttgagccccccttgtgagatgaacacgttttcgaggctttgtgttagcagggcttcctcagcatgcacagggagtttttctggtaagttttacgagccaccgaggtcaacttgtttctcgtgagtttcacaagctaccgaggtcaactttctggaagtgctaatttaaattgatgattcaagacctcttcttcttagactcagatttctctccatcatttcctttcctttttgatttcttcatttctttgcgcttctcttgcttgtcagcctttgtcttgttggatttcacactgataacaccgcttgcggaaatctttcctccgttcagcgccttctcaatctcatcgtcatcggcatcaattgcatacttttgcagaaactttgggtccacatcatcctcatctattgctcttctttgttcctatatttgcccaagataaggttagcaaagaaaccacaactttggcatgcaaatgcaacctttttttttattcgtgtttaaatgtgtcacgatattgtccacatctaataatggtgctcaaataatttaggtgttttctgtacgagacatatggccagttttaatattttaatcggggatcaactgcacttgaactcataaaatatttcaacatcctcattactcctcagtggacgactcaggattttaagtatgcaacgcattactgtatctaaactctaaagaaaacatacctttacttccctggctgcttcatcaaggtcctcatccaatgatttaagaggagctgtatcaatctggaagtagtagtcagacatagcagctattatgagattatggccatgcacaaaattttatctaactacaccatgagcattgcttccatgcccaccaatgaacaatgccaaatctggaagtgcaactattacgtgtcaatactaagttgacaaaaggaaacaaaatatggttgcttacttcctttagtcgtggtaatgttgcttcaatttcttttcctgcaatattatgaaggtaaccgtataacttcttcattgtcttgatgaagtttgatagaacctgttccctctctatccccagttcttcctgtcaacagaaaaaccaaaagaataagacatgccatctcgatgaattttaattccaagtattttgaatttgcttgggatcaacttgagctaacctttgtagcacctatgtctttgtcttgtagtcccatacagaacaaaacagctgcttgggcaccatgtagtgtaacaggaagcttctctgaaaaatactggtgtgcaagaatagggacaaggtccagaatctacaaaaataacagaaaaaggtgaaaattggaagtgtttcaatgtagctttataacacaacttgtattcatataaaggcaaatgacaacatctgaacttctaacctgattgagaaaatgctttcatgagatggaatttaataaacgaaaaggagagaagataaccttctctgatcatagcaacaaaagctacatttgcagaagtgaacggtaataaaatcataaggaggcagtgatttgcagagtagctgtgcaggtattaaatatttccagaaatctgaaagttgctgagtgatctataacaatgtagaaccccaatttgcatccctaccaaacctgggcctagaaattttgccttgaacaagtggaatcaaactaaagatccttcataaatttcttaccagatgataatcgaccaaattgttagaatatgcttccagccgcttcatatcatgtggtgatagcatatctcccaatatctttgaggtaatattggtataatagtctgagggttcgtgatctgaaaaatcaatcttggaagccaatacactgggaatacacagccaataattagaacatcaccaaatttctttcccatgaaaaaaaatttgaaacttcaatatacctcattgcaagcttaaaattgagatgccggaaagatgttcctaagagacgcctgaatctttgtctgaaatctgggcacattgttccaaaatttagctaatgcaccaaaaaaatcaagcaaaaggcaaaatctgaaccgtaaaccttccgtcagatttgctgtgtacagttaagaaatcaagcagcttcagtttgaaatgcattagatgaggaaacagaactcatgattttgtaccttgataaaatggatccaaaaatccacatttgcttgactcattaacttcaatgtcatcgctatttaagggcctcaagaccatacaagtatgctcaccagtcacagcactctgaagaatagatggaggaaacataagaagctactacaaaagaagaactgcagaggtgaagaacaacaaatagatcagattagatcattacaggaatttggcccacatagaatggatagaagttgtgcttccgccaaaaacggaaaagctcttgtgtaagtccaaaagatacaccaagataatggagcttttcaggacgacgttcgcgaagatggacaaggagtggtgggagatttgccctaggctttacggtctcttctagtagagaagcctgcaatagtaatatacaaaactgtaaggtagagacttgtggtcaagcaaaataatattgtttggtcacaatatattaattcaaataatatggtaggcaaacagaggcttgcatcacaatgtacataataaaagctgctgtgctatgtgcagaaataaaaaagaactactatctaaaaatattacaccatgcttattttgttcaaagtttgcaaatttaaaactgttcatacattaaaatatgtagtatgaaaaccatacaatatagttctaattgtagagctatttcaaactgttgcacaataagatatcaaatgggcataataaatagttgttcaaatgaaccttctctgcagcctcagtgatcctgacttcaggctcttcattttcctcctcatcctcagcaaatagagtcatttgcccttcatagtacctttcaaaccaaataaataaatgtcagtaattgagtatgggtaaacaaatccttgtgaaaaaattactaattaaattgccagtaagattagacaagtccgttccctatatctaccatcattaatcatcaaataccagtttcagccaaaaaaaaaacagaagagcatcaacagatactacaatccacagcacccataacccctagttggggtaaagaagagaaatgcataccttgtcaaaaggtccacagcagctgaaccatatccaagctgcattgacaaaggagaatatttagagtgtggagagtgatgttaacacgtgcataacagagttctataaaggcaataaacctcaccctcacagcacttggatggacagcaattcgtacaatccgagctcctgagagacttggaaacacgttgtcttgaaactgttcacaaaatttccatggtatttgatcaccagaaggtgaccgaccctcacttaggcttttcatagctgattttcgagatatttgaccttccaaacagacctgaagatcacaaacaagtatatttacaagaaaggtcaacatcttgaaatgttgtggcggttgtattcagtaggaactaccctttaaattttcagtctagattgttcatatcatctgaagatgggcatcagtggaagtgaagtggagaagttaaattttaacaagagttaagtactgaatttaacaaccacgtgaataaattagttcaatcaaggaaaggttcagcttccagcaaagctaaaaatgtattcagcaaacaatgcatagtaagaacaatgagttgaagctaaagatatgaagtaatagattttttttgtagggaatgggaattagttttaaattaaaagaacttttaaaaaacataaagcctgagccctacagatcagtcgttaaaaagttgaaccagatttgcataatgtggtgtgcacatataatgagttattacaccagggccaacacatgaagcttgagcacattctgatgaggtaaaaaataaacaatgcaaaactcactaaaaggttcacaattgaaagtaaacagtaagctatgaaacattgcagtgtctttacattgtcaactaaaaactgaagttggatgttttccaaaatagcatagcaccggagtgttgccgcagatgacaaatacatatatgatgagataaaaaaataaaaatgcaaaaaaatcccttaaattaaaataagtatacagacgaccacatgagatcatttcaagcgggagcaggtgcagaacatactcactccattcttttttacttgtcatttagggcattggcatggtccaatgcatatcatttattttgccttttctaatgatatatccataaaaacatattgaaaatataactacagaataatatttcattaaaaaaatgctaatatcttatttacatatgaaaccttaatgttttttgtgtatattagtgagttaagattactaggtttgactgcatggatcctaagatgacatctatttctgaatgatgggagtaccatcaaactgaacttcccttttttataacagtatgggcagatatggtgattcctatggcaaattgactcaacaacatcaaatagattgataaacgctgaatagtacaatagcaaattaagatgtatgtaatttttgttactggtgcatggcattaggatgcatttctacaattatgtaagaaactttaatgttgttcggctacaccgcaattagagaatcatatatttcacacttttggctactgtgcaagcaaagaatcagcatatggccatcattaagagaaaatttcaaaataaaatactaagaagatcaagcaggaagcagtttagaacctggactacacatagaatatccgggagctgatttttagactcatcgactgggcctagaaaataaagaacataagttagtacttagtacagcctgacagtgttgccatggtgaacagttgggaatgctgggcaattagtccctaccaagcaatacaaataggtgatgagccggcgcatcagccattagttgcaagtcattgggtgaatttttgtaatgggaagcaacataaagtgccatcatccgctgaaatattaaggaattatgataagcatccattcatgaataaggaaaaaagagcatttctaatccatacctgtaaaaatatctcactctccttatgatatgagaaaagtgtgtctcggttgacataataaagatcacattcttttggatgaggtagcctaaagaaaaccataaattgtttcagacatgcaagtaacttggaagaatacaaaatgcaatttagatgatgctcacctactgatattggggatggagttcgcaagatccaaacaaagtaaatcattaagccagctctcaataggatcaccagatgcatacctaatggactcatttaattcaattttcttaaaaagcctacctacaaaccaaaacaaaacacaaaataagtgtaaaacatccaaaaatccaaggttcttcaaaagaagtgcattaaacataagaacctctgttttagatgaaagtaagaagactcttacttgaattgggtccattatttggagcagatggctggctttgggattccaactgctgtaggagcttcaaagacaaggatcgcccagttccttcgtaccttcaatacaaaaacatccagaatgattacaaccatgattttcagtgttatctcatttcgaaaggaaagcaaacatacccattgacagtggatgataggaaaacaaggtatggaccaagcaaggacttaacaattggcaatggaatagcagcagcttcatcaatgacaaggagctcaacttgagaaagcttcccatgatcatgtggtttcagatactgcaacattaaaaacagttgaactgggttgattgatatcaagcaaaatattgctcaatgtgggaataagctagtaaaaattatgtctgggaaacaacaaactataaatacaattttcaaggtatgaaccttaattgaatttatcaatgatcatcaaacacactttattgaatgatctacaaacaaagaacattatcacgaaaacaataatggtatattatatatatgttttatgaactacagaggatacagctcatgtgaagaagaccacccaacaatctacccagaataacgtaaactttgccattgtgagatttttacataaaatctcaggaaggaccagtatgcattaaaaaagtaccagtcctaattaaattttgtatcatatatgctgcgtttgtgtaccttcacaggcaagtaatagtaataacaaggacataagtttttcaatcttctgcagcatttaatagactggattattgaatgtgatatttatagcagataacaacatcagcctttggtcaaaggtaagttgggactaggctaaggatgaaacctaagtagaaacaaatgagctaaaaggggggaatagctaaaaaggcaaaagattaagctagttaacaaaaagcattccagctcatggttctagcatatgaatagctactttccacaaactcctacccaaagccagttctttcgacaccatgtcttcttttaactggttcctcccatgacagttttacataacccatgcctccttgtatttttgaaatggtttcgagtgcactacagactagttcttcagggggggctccatggtatgccaaaccaccacaagcgatgttggacaagcttctccccaatcagtgccactcctaccctaccatgtttacaataatttctaattcaatccgtccctgtatgaccacaaatccaccatagcatacaaatctctgctacaatcaacttctggatgtgttttcatattataaccagacataaggtaagcaaagaactatggtaagcaaaaatagcataatctcaaagtaccaagtcaactaccataatattggcatggccataagataatgtgcattttaaatccaccaaaagtttagtcctcccaaacaggatactaaaggtttctagggaagctaaaggatccctttgctcatacagtttgaactttgaagcccctttccaccaacatctgataagtgataagtctaaacagaacagaaagaacctttgggtggaagtagtaactgtctacctggatcgtctgacgatgctgcttgtagacatttatttgaatagttgccttcttgagttctggatctgcactcttcaccacatcataatgcaaatgctcctgaaaggggtgaaatgatacatacattaactgcataatacagaattaaactttttaactccaagactagactagacagacaccttgtactccagtgcattcattcccttgcacacaaaatcaaacagtgtttttaggttctctggacttggggctgtgacaaatatgtttgaatacctagaaagacaaaagattagaattaatcacggagaacgcaacagataattaactttaattgagttgagcattacccagcagcaatggctccagcaatagcaagaccaagggcagctgatttcccgcgtccgcgagcagcaagcaaggcaactgtgctcctcagggacttgtccaaaatagagtcaaggaaattgatcacagctttaccctgtacataactcttaagtttcagcatgctgcaaaatgaaagatttcatgtgtaaggtaaactaaaacaggataggcactaaacagtacctgatccatcgtgaagcactttccaattaaaggaccaactggaaagtcttcacggaattgatcttttagatctttcaactctctctccctttctgacagtccctcagaatcctaaacatatgttaaaatatatatgacatagcagaataagatggcctggttgaaacaaccagaatatccaagagattcataaaaaaggggaacaactcagcaggagcattcataagatcaaaaggcaccatcagcatgagtagacaagacgagttatatggaaaaaaaaagagagagagagaaattaagcacacatacctcattgttcgtaactggttgtataaatttcatgtgagaggatataggcaaaatgttgagttcgtcatccatgacgacacatgatttgcaagacgctatggatagcaagaacctctcgttgaacctagcagcagcctgggtatgcgactctgtccggaatctttcatggacatcctgttggagcaggaacaactcaacttagtcaagttatctcagcaccgaagctaagatgtagcatgtaaaccaaaattgtcccaagtttattgatagaaatgggatcatgtatgtatgcatgagagaacaagagaagcagaaggtccaacagagaattgagctcaccatgaccattgtataaagactggtgagagaggaaagggagcggagcagcaggatgatcaaaccaccaccctcaaccgtctcgatggtcctcgcgagtaggttgggcgtgagcgcctcaaaatcctgcggcgccaacaaacaccatatcagtacaggggaattacactacaccacaccacagcagcaccaaaaaggagaaaaaccaagctaagcttgatgttagacagacagacctgcaggatgcacatgccgaatgtgttgccaagaaccctctcggagtccttgtagaggcagtaggtgatgtcagacgtctccaagaagagcgagaaggggtcggccttctcggggtccatgagccccctctgcatgagcttcttgatctgcttggcccgcttcttcttgtggctacacaaagcattccatacaggtaactggaacggcattgctcacacatctccaattcaattcaacaatcaatcaatcggtgcagcaaccaatcgagtactcgaatcgaatcttaagctaagcgaatatggtagagtagggatgggtaaggaacctgctgatctcgagcttgtcgcggtagcaccagaggacggaggggcgggacttgacgcgggacttggcgagcatgtagttgaggttgacgatctggtcgcgcgacttgtcgccgacgatgacgaacatggaccgctgccgctcccgcacgccgttctcgatcagcgtccggatgcgctcgtccaccttcttcctcatcctcgccctcctctcctcttccccgccgccgggccggtctcgtgtggtcacaggagatgagagcgcgcgacggatagcgcggggcggacggcggcggaggcgggctagaggaaggaaggcgccggcggagggtggtgcggcgaggcgcggaggcgcgtacgaggtacgagtgatggagaggaggaggtccggaagcgtggggatttagggtttaagacatagatgggcctttcatgggctcaaacttgaatctacggagataggagatgctgataactttttctataaatttagggtaaatttaattaaatctttattaggactttgactagtaaatttaattaaatctaaatttggctgtgctcttctccctcctttcccaactaacctccctctttttaccgtctgcacgctgctaaacgttgtattttttgcaaaagaatttctgtagaaaaattgttttacaaaatcatattaatccattttttaaaaaaaaattaatacttaattaattatgtttcatgagtcgtacgtgcgcgtgaatgagttcctaacttatggtgccgaactcatgatgaaacggagggagtaataatctaatgcataccgacactgaaaagaagccctaatcgaactcatacaattcttaaccagaacaaacaaactccaataccacaacacagtccatcttgccttgcatgaacgaatttagctgtgcagactaaagttctctgcactctggaactctactgtagtagcatctacacaaaataagcgcagagcttactctattgtagcctctccatagaattggttaggcattaagcagcatacacattttctagttaatgctgattctgtattatcacatttcttcaagacatcagtatgacagatggtcataaagaccgtataatattagcgatataatgtgcattcataccttttttttttcctacaaacatgaatccctaactactgtatacatctctcaactctggagacaaaaagaaattcaaaaaacgcaaaagaaacaaagtgtgttatgacaacaatatcaaactattttcttctgatatccgagcacttcatcttcattgacataccaactaggtacatgtcctgcatttgagttcaagtcatttgattatcgtcaaaagtatagccacaaaaatatcacctcgtagtacgaaagttttatcagactatgttaacaacaaagtgaacattagtatgcaagtcaggatactaaccagtctatcacaattcacaatgcatctgcatttctaccacctctcttactaactagttcacaaagtcggcaaggcagtgtgtcaaggctcatttcacgcgaccttccaaagttacccagggtaccacacctcctccatgcatggtattctgcataggctacgggatcatttgcaacagctttcacatatgatgccaactcacggagtgagctgaattttgaggcatctataatagaattgggaggaatgaagtcccagacattgggtgccccgaagtatattggcactgacccagcctccaaggcatagaacaatttctcggtcacatagctttctgtcttagtattctcaattgcaagaccaaacttgtaatgtgacattgcgcagtgaagatgatcccaccagtgtggttttccattatcattggttgaacaaactggatacatggataatgccatgtcaggaccatcaacattattcaagcatttcccgaaagagtggtgcggaaccaatgacaggaaatcttttgcaaccttgtctctatgaggaagacaccttgaagatgaccagtaaataagtgcatcctgacaccatacaggagatcagacattgagatgattaaataaactttttttaaaaaaaaaaaagtactactacagcagaactgattgtgtctcagagtgtgcaaaaataacaaagcaatagacatccacaatttcatatttacaaaaagcattcaggtataccggtaagtaacaggagcaccttagcccccgctgagttatgttgttaacttgttttgaacactacacacaatcggatcttgttggcagttgaaaattgtatgaagtttaaaataaaaatatgagaaaaaatgaaatccagaaaaaaaaaagtatcgaagggaacagctcgacctaaatgtgtgaggttgtgcagctgtggtgcactggtgcctgctaaagtcttaatattatacttctacagtcaactacgcacacttaatcctatcatgctatgatgagcagtgagctagcagagtcaggaacaatgatgtcatgcgccatgtttacataatatattattggcaatacgcaatgaatggaaagttaagcatcatgttgggcttacatttctcttttcagttgatacatggtaacttcggctagtgtggaatgattttccagcatatgttacttgcacatcatctttagcatggtaacctataaaaatgtcctcgaaaccagttggtttcctagcagcctccagatccagatatacacgaagaggcaggcctttcattctctgcaaaacatgttcaagaatatgttaaacttggaaatcagaaagatgttaacatttactttgtttaaaacagcatccttacataagtaatgaaatacagtatcctcaggaaaaagagaactaaactactaacggaaatggtatgtaatggttagtaaaaaaaccaattgtatttgattccatgattaagttttgtcagaattgtaagcctgtaactcatgccactcaatactggcactatatatgtgaatccacaaatattttcgtggagactcttcatgctgttttcgacaagatgaaactaacaatcattgggtttttttattgtatggtggctatatgtgcctaggcagttgttggcacttccatttgggccaggcaggtcaacggctagagtcttttaggaaatatatgtggtgcattagacatcatttgccatatggctacaaggttcattagcacgacatacaaccatttgctgggtaataaggaagcatcaaaactgagcatgtcttcggaataagatgatctgatctcctgctgaggacattgtgctttttcattcctggaattttggacaggccttcagggagcgaatgtcaaagaagtgatgaaggcaggggctgcaacacagccaacactacaggatgaaccacttcggtggcatgaggctcctaaacaccaagcccaaaacgaaaacagagaggaataccatgctgttgcttctgactttatgagagaagggaacatcaaccaaatgttgctgaattcacgtaacctggataccatacaagattactccgttcatcatgtgtttgagggataactctgggagaatgaacagcaatatgtccatatttcacatagttagcaaccgccatccaagagtacgcaatatttacaaactaagggtgcttttggatcagtgagacgcattgcctagccagcaaaaaataactgcctgcggctatagcccacgcaacaagcgacctgttttaagtctagctgaggatgtatgaccctcttgaaactaccaaggtattacttggcaatgccactcagatacaaaagcaagaaagggggcaagcattctatagaaaataaaaaaaactgcctcaattaattaaggttgtttctctaactgatagtacttccagatatgcattaacactcgaagaatttattaaggccttgttcggtttgaaggggattgaaaaggattggaggggattgagggggaataattccacaccacagtaggtgtggaataaatcctctccaatccctctctcatgg

SEQ ID NO: 59110 - DNA, 45097 bp, Oryza sativa
ccatccggtcctaggttcttatattttgggatggagggagtagatttgtatcaccattgcctgttaaatattttggctgcatgtttccctcccttcctgcagtgaaaaccaagtggcatctttgaatatacatggtcaaactttaactttggtcatcaaaattgtcatgaacattaagataagatgtggaaataacattgggaggtcttcctggaagaccaaaatatttgtacatcctgtagtatatgcgctatgataaaaactggtagtgttgtgtttggggaactgtgttgatgtccaaaacgtaacttatctttaattgttgaggttttgacagtttagcacataagacttttttttgggggtcaagttggcataaatgcaagtacaacacataaatactcatgctcatgtgatatagacgtacattgctttgaagtatcagatggacagcaaaatttgaaaggtagcaaatttatttgcggtcagaaggactcccaaatcattctaaagaagtaccatagagttcttatttgggacattggaataaatcattgcgatgctttgaatctaatgctgagctgattctttcagttgatcaatctatggtagtaacgagcttttgttatttaaatctgctctctgttagttcgtgtgctatcaattctgagctctctctcctgtacgaagccaacatattatggagaaagaaggataaccttatttcattttgttattgccatctgctgttgcatggcacctgtttacatgctatcaattcatagaagcgataaataaaggaaagtaaatcttgcattgctgatgaacttttcttctcttagtctaagaacaatatcattatattttaagtcattaatcgataggatggaactgctacatattaatgattttgtaatacagctacatggatcattgtatgggcagttgtcatcaagatgcctaacttcttcttgttatttaattaacctctagacactattgttcaaaacagaatgctgtttacatagtcatccttgcagatgcttatctttctcttattagtgaattgaattctctaattagggaattgaattctctaattaacttgtgggtactacctttttttggcagccgatgcacttctgttgcatgggtaccggagcgtgaaggaatctttgttgttagccattctgatggaaatctgtatgtgtacgataaagtgagcagatgttggttatcggatttggtattttaaaatctggtttctgtttggtggatgattgaactgatgtatattgatgtactatttatattcagtgcaaagatggaaacactgagtgtacattcccagctataaaggatccggctcagttaatgatttcacatgcaaagtccagcaaggtatgttaagcacttcaagaattattttagttaagtatgctttagtatagaggtatattcccccctttgttaacatggatgtctacagggtagtctagtattctgaaccttgaacatatttcttaaatcaatgaacatacttatttatcgcgccatgtagagcatggaaatagcattgcaaacagtgataactaccaagttctgcacctatattcatgcttaagtgcacttatagaaatgtttaatagtcctttaaaaatgatggtttttgctcatgctcgcttttgatagtttgattatgcagtaattaaatttttaatagaaaaggctatcatggcagttggttccaacaattatgcacttgttctggcctccagttatgtacaatgctaagtttcgtgactggtattttacaacaagaactttactggcaaatgccaaccacccgatagtatattccaaatagcgtacatcatataaagtgaatgttggcaagtaactccattatcctatattttctactatcttagaaatatgtttttttgttgcaaaacatgtggttagaggagttcgtatgaaggtgccataattaactttggattcatctcaaaatcatttcagagcaacccaattgctagatggcatgtttgccaaggttcaatcaacgccatctccttttcaccagatggagcatatttagcaactgttgggcgagatggtacttcctttgtcccaatagtagatggttctttattccttatagaacccactgattctgtattgcttattaaaataacactataaaaccttatttaggttatttgagagtgtttgacttttcgaaggagcaactaatatttggtgggaaaagttattatggtgcactattgtgttgcacatggaggtaattggaatctccacttttacatttgccctatctttgctagttagttctatgatttatctattcccactgtttggctgtcctgtcccaaaatatagcattttttagaggatgacacatgtattaaggataggggtagaaagacttgtttgccttctcaggatgggtgaggtataggcctggtcgcctggactacaatagagacaaggatagtaggggtagtatgggtagtttagtggcaaaagttaccttttacatgtcctaggttgctacatttgggacaaaatgaactcaaaaacttgctacattttgagaccgaagagctttatgaggcaatcctgaaacgtgtttctgttagttttagttttttaactctacacccagcttgggatgaacagcatgccaaacttaataattctgctgatttatgagccattccggaaaaaaatgtttctgtttgtaagtttaggttgaatagcatgccaaccttaactaattttgccggttgcctgcctttctgccaggctgcttgttacatgtgaggaacttttttggtttgcataacattacggtgtactatgcctattcccctgtatttggggtaacaaattaacaacacagtttttggcgccactagtttctagcacggcacacgttgaggcacatctctggcctggtctctaccatgtcatcaggtttctgctccgtggcattttatctgctaattgtttatcactagtttatgcgactttgaattatcagcaactatttgtgtttaccactggattatcttccacaaattagttcctcttaccttattttatcatggtctgtttttacagctcggatggcaaatatctgttgactggtggtgaagatgatcttgtgcaggtatggagcatggatgacagaaagatagtcgcgtggggcgaagggcataattcctgggtacaacttaacttgcctaaaaaattgtcaatgccacgatgtttcctgtcaatagttgtaattgaggacaaggtcaattttatgttgacaggtcagtggagtttcttttgattcgtattggtctcctccgaattctgatggaacaggagaaaataccgtgtatcgttttggttctgttggtcaggtatcacaaatttatatagctggagatatagtatgcagtctgtgcttttatgacatgtccttaatgtttaactcatgtagtatcaaagtttctttttgagaagtgtagtaatcaatgttaataagcaatcataagatgcttatttctccgtccactcttatgctgttgtttggctttaaactgatcaaactatgtatgtagcaggatgtgctaacttcttatcatactcgtgctattttctcgctgtacaatctatgacaatgttttctgtttatgttaatcaacttggttagttattaatatcgattcttgctcatatggttagttatagtgatgagattcatttgggcaagttatttggcaattctttttacatgttctatcgctggcataacttttcactgtttcatgctcctaggacacacaactgcttctgtgggacctggcattggatgagattgctgtcccactacgacatccttccagtggctcaccaacttttagtagcggcagcccttctgcacattgggacaatgcatgtctcccaacaggtgttcttcaaccttctccaagaatgcgagatgtgccaaagctctcaccccttgttgcccaccgagtacatgtggatccactctcaggtctggtgttcactaacgaatcaattctcactatttgtcgtgagggactgatcaaaatctgggtaagacctgatcagaacgaaaacaatcatcagtcaaactcttcggagttagttttaggtaaccctgtttcaaaggatagggtgatcacaacttcaaataaagcaaccggttccagcttcaagcaatcttcagctgttgtcttcacatgacaaaagtgttctggtgggcacattgctctggtaatctggttaattgatcatcggtggtcatgtttcttactaacaccgtgattttgggaagggggtgggaggaactcttgctggtgatggagccgctcattttgcgtggccagatatgccagtgttgccatttgtgtggctcaatggaataatggggtattctcctgtacagagatacatatagtccaagataaaatgtacaatttcaccgtatgtgtttcgtacttttcagcgagccgactagtgatgggaggataatggatgccacttacctggtggtgttttcttgtgttttattagtatctaaaaagtctgtaaattatttattcatattattgttacagagcccttctaattatcgcctggtgtgaactgtgaactgctctctctctctctctctttgatctgttaacaatgtagtatcttcaaataaagcaagcggttcaagcaatcatcatctgttccttggagcaaaatattttggcaataggtacctggctttcgctcgtcattttttatttttcttgcactgagacttatgtggcggaatatgaatgggaagttgctgttgttggaatcgctcatttgtatgctgatatgttcggaaggcgctctcctctgctgctactccggagaaagcggccgggcaagcagacatctcagttctctcctttcgttagttctgggaagatgattatgcggtcttgctctgggctcatctcttatttctccttccttggttgttcttggttggtttgtgcgcttcgtttcttgattggaaagtgggagagagaagaaagatcgcacctttgtgtcactttttgattgtgcaaagaaaaattctctttttggctggtcatgtgacatgttgggcttgtggcaattggaaaggcagaagaatgtcgtgtgcttgcgagttgtatctctccgagtacaatcaaatgaatgtttctgacggaggattatatttgggaatgacgtccctttttcacacatttctgtcagtcagtcctgttcagatgaaactgggtggtactgtagtagatgtgcacattcgggaatgataggatctgaatttgggaaactatttataaatttgaacactgttcgacaatttaaaaatcgtagttgcccactttaagagtcaaatttagacgcatttccagactatgtatcgttttgggcctgggttttcaggttgggtaagtaaaattacctgatctcccccgcccccccacccaccccccctcccccaaaaaaaaaaaaaaagaacagatgcatctgcatggaggatgtgttctaatagtgcatcagccacaggggaaattgtctttcctggatcagcatggaaacgacaggaagtgcaggttgcacatacctgctcctggtggaagcatgaacactactaatctgagttcttctaaattaagatggttttttagacaggttctgtaatgtttggtttacttgatttattgtcggtgttaattagcaaatagttgcaggttcatcagtggccactccagatacctattcagtccatatctcctcagaaacccacaggattgaggcccggttggcatctgatgaagctttagctaggcaattgcaagaggagaatgcgcatgatgtgatcgctacaagagaatttgctatggtgtaacaaacaagcttgcaaggtttcccaacctgtacaatataatctcaactgcatatggcagcagtcaaattatcctccgatatcaatagttggcgttctaataccatatcagtgttccccgcaaaataaaaataaaaataaaatatcagtgttattaatttttttgtacatttaaacccagacacattttgttaagaaagcagttgggcgaaccatgaattgataggactcacatgtaagaatttattgttcttctcgcttattgaatcttttccacaaatgacttgagcgattctcaacgtttacaagttctgtaaaatcatgtattttatacacaatactagtaactccgtacgtgccgcgcgtccacttctagtttacattagtcttatacaatcactgatacatgtataaatcctggtaaaaagatagataaaacaaattgtacaaaaggagacggcgacgcaccccatcgtctagtgattttaaggtccgggtgtttaagtctctgtttactgcgagctccatatataatgcaattaagatttgattaattatctgttgctggcattctgagcagcagcagcgcattggcatatactcctaaatttttagcagcagcaagccaattaattatccggccacgtaatgaaattctctcaagtggggacacgttacgcctatgcatgccactgaacgtgttgcaaatacatgaaaacggaacaaaattaaaaggggatttcacgtacaaacttggacaaaatgacactgttaaagattgtactaattaaataggtgaacacaccccaaactaccagcttatccgttcacacagcataaaagtagaccacaacatgaaatagctccttcaaccaatgtcgagaaacgacagaatcctctccaggaaccatagcatatttagaagaaagcaaaatggtagctgggcaggaagatgtactataagtaggatcgatgaagttgacagatgtgattcattccatattgttcctcgtcctgcaatacataaatcgtgaatttccttgcatacaatatctgaaatgtccaccaacacaaatgatttagatggatggtgttccaattaaacttgcgtccattagcaagataaggctagcatgcaaagatgctttgtaaactactccagttgtgctataattaattttagaaagaattggcaaaaacagccactacttaagaaataagcatacttcacttacaaatgctaaaagtttccaacaatatactccatccgtccctaaatatttgaccccgttgactttttagcacatatttaaccataaatcttattcaaaaaacttttgtgaaatatgtaaaactaatatgtacaaataaaagtatatttaacaataaatcaaatgataggaaaaaattaataattacttaaattttttgaataagacgaacactcaaacatgttttaaaaagtcaatggcgtcaaatatttaggtacggagggagtatatttaaatatttatgtttaaatgtttggaggaagaggctactgacaggaggctaacaattgcaggtacgcagcaatcaacatgcatataagtaggatatggatacataaaaactagcaatatatataccttgagaaagtgatgaacttggagaagtcagatgggaggaaggactgcggaaagcgcgactttgcacgggtcaggccagcgtcctcagtttgaaggtcctccttcccattgatatacagagaagatgactccacgatcttggtgttcatgtcaatggcgacgacccacatcttcttgatgacataccgtaattcaggggcaaggaagtgcactatatgtggcctgtcaatgtccacttgagggaacatgagtaaggtgcgtgggaggcagtcaaggctgttgatagaccagagctcattggaggtgatcttgtagtcctccctccactccatggttctcctgtgtttcttcttcttcttcttatgttctcccaacacgaggctgtagcaggtgacagtaaaaccagcatcacgcctgagagactcaaagccaagtccatcatcgcgggcgacgtcgatgaatttgagcacaccgctggcatcaaggacagacacaccacggtacaaccagaagcattccttgttgcgacgaggagtctcatgatccacagggaacggaaggaaagagacgacaatcgcggcagggtcataaaagaggatgcctcgcatgtagtcaatccagcacagctggttgtcgaaggggatcacagtgtcggtcttccaggagtagagctgatgcacatcatcggggttgccatggacgtggatcggcagacggatggtgcgccaaccgctgctcgctacctttgatatgtgcgaccgcagcaaacagagttgagctaggaccacctggggcctggataggtaaagattcagctctaccacctcgaactgatcttggttgcctaggtacaagaggcccgtggatcggagcatcaccatgcggcgatcattctcaggaggacattgtccagctcggtacaaggagggagcgtctgcaaggtggcagaggcgtcatagatgactaagtcctgcacgtcaatttgatctttgacggtggagatgagggaaaacaggacgaggtgacggtgggtcgccacgacggagaacggcaagacattccttgaatttggaaagcctggcaactgcacgtagatgcgagagatgcctgggggattggagaggcggaaggcgacgtggaagggattctcctgagaggtgaggcctgacgccctgatgacgtcgtcggggaactccttgtcgtcgtccacgcggaagatgaagcgctctagcatcacccagttggggaacgaccgggcggcgcacatggcgacctttaacacactagattggaaattatggcaccaaggggaatcgctcgctgtgagtacgaatcaggggatttgcaggtgagatgccttaccgaggagagagagccggcggccggcgcgtactgaagaagacgaatcggccgagaggacttggcgagaggcgtgcgggtgcggccgagcgattcaggaataaagagagagatttagggtcagggggagcgtatcctatgcacacatgctctcgcgtgtacaccaactaaaaattatcataaaaaattctaggaaaatttatacatatactttcaatagtattacatctacgtgcaaagtcgcatcttcaaattcattctacatagagaataacaaaaaagataaaattctgacaaaattgcaaccttaaaactgttagattttttgtttttttgttacagctaaaatataatgaatttgacgttaagattttaacactaggtataatacaattgaaagtatgtgtatagttttttttagattttttagtgatattttttagttggtgtgcacgtgtgtacacgtgagggcctgtgtgtataggatatgttgccagggttaggagttgataggtaccgcttttatacgaagccatatgcaattgggctcttccgtcacacacgtaagatggacaagttatgaataagtccaccttggtcccccaactatgactcgaattctatttacatctttttaactatactagcaaatatgcccgtgcgttgcaacgggtgaaaaaacgtaatgataatatacgtttttcatgcataaccatgtcgataacaatcagaaaattagaacaacgaaactttattttctagcgcgttttcttttgtgcttttttctgacatttttccctcacgtgtttttttaaaccgtttttattttctcgtgacattttatagttagattagattagattagagataaagaagatatataaatggactaaaaaacgacgaatataaatttgacttttttcctccgcgcttttttccgtctttttaattttttttctcgtacatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccttttattggatcggacagatttttttttgcccggtttatttcacccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggaccgatttgtttttttttcgccccgtttttttatcggacttttatcttttttttcgcctggtttttttattttttttaccgtgtcacatataattcctttttctttatcggaaagttttttttcgcctttttttaccgcatcgatggagtcagattcttttcagctttttccttttcttttatcggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttttgctccacgatacatataattcatttttctttggaataggaccgttttctttttatttttttaaactctttttaccgcgtcgatgtagtcggattcgtttcggtattttttccttttttttcctttttttttgtcggacatatttgttttttttccgcccggttttttttcgccaggtttttttatcggacttttctttttttttcgctcggtttttttctcccgttttttgacggacgatagaagcacctagagaagtgttaagcacctagagaagtgtttttttttcttttctccaatccaatacagatcggatctcttctagggaaatcagattttttttctccagggaatcggactcttttttttcgctttttttattcattaaacggtttgtctctgggactttttttccctttttaagggatcgggtgttttttttgccagggacgggtgtttttttcgcccgttttttttttcactttttttttggatcggactttttttttcgtccggttttttgatcggacaaacttggttttttctgcccggttttttttcacccggttttttttacggacgatagaagcacctcttattttttaagtagtagtagactagcaaaatacctgtgcgtgactgaagttagatattaatgatttaccaaaatatcatagtatgattataaacatcggctatatgtagagtgataaacaaaccatgtttgtttttcacaattaatctaatttatatttgcgtgatgtggatgacgcttctgacgcatgggcctaacgattatagcaagggaggaacaaatgatgaacaattaaagtgattgtttttgcatagaaagtgattgatgaaaatttgagcgatctatagaaaaatcaatatttttaaagtacataatcctaatgaaaaatgaatggaattgaccaaaggacacatctgaatataagtcatgcggaaattatattttcttgtaatccatataatgtaattgtgagaatatactcgattttctatgcattgtacttgtgagagctgaattttgttttaggttaaatatagtgtgcaacagaaatctgtaaaatcatattagtgggagcgctaaaaatagcagaaagaaaagcggggcagacccacactcctggacgaaaagggaaagaaaagctaactgaactcctgtactgcaaaacttttttttgtgtattttggttttctttttgtattttggaataaaaaaatatgaattataaaataaataatattggaagagagtaatattctccaatagaggctatagtccacataaaaaataattaatattatttattttagtccaaatttaaattctatatcatgaaaaatatacaattacattttttgttgactccatttagatataaataatttaacatgaagaaataaaaactatatcaaatctcatcaatttttaatggctcaaaataatgcttatattaagtttgttaatggagaaatagtttaaatcaactcagaatagataaaactcaattaggcccataaggatgggccgaatgtcttccacaacttggcctgttaagtgcacataacccatgtggcccaagtcggcttaaatacgctgagagccgtcggattcaatcgaacggttaggatcgctcgatatatatatatatatatatatatatatatatatatatatatatatatatatataacattccatgttgaaaccctaaccctaaactcattatcctccctctccaaccgcgagtggcgcggcggcggtggcgacgcgtccaaggcgaggcggcggctacctgccctaccacgagcagcgacgacgatggtggcggcgacggcagtggctacctcccaaccacgagctacggcagctacctccctaccgcgagcagcggcagcgacggcggcgtcctcccccgtcgtgagcggccaggatggtgccctcctccattgctagcggcggcggcggcgaccggcgatctcgcggcggaggcggggcggcggctacttgccctaccgcgagcaacggcggcgacggcagcgatagcgatggctacctccctaccgcgatccccatcttcctcagcggcggccggtgatctcgcgactgacgcggggcagcggctaccttcctcatcacgagcagcggtggcgatggcgacgccctcccccatcgtgtgcggccacggcggtgccctctcccaccgctagcgacggcgacgacggccttctccaccgcgagcggccgcggcggcgtcctccgatgggtagatccggtggcagcggtgtcctgcgggtcggcggagcggcctcgacgacggcgcgtctcgaggcgctggcgctcgcctctcctccccatcttccttcgccaccaccgcccatcctctcgtcggatgacgagcttgtcgccatcgtcaaaacgataaatcgaggttgctttgtgattaatttgcttgattccattgatttcaaactttctatcccgttgatcatcccagctgattttattgagttcgattctgagtctgttggtttaatttgtagatgattttgtatcaaactcttgttttttttttctttggccattgtactgacctaactgcgctaggtcggattgacggacccaaaaatactgtgatgattggaaaaatacaaatatttatattagttatagatatactattgcgcgttgtaacagatgaagacaacttttataattgataaaaactcccaccaatttaaacgataaatgtcaaaactagattttggctaatctaaagtgggtagcgaacaagcagaaaagtggatgggttatgatacaaggaaatttttacaggttcaggcattctcgataagaaataataccctactcatgtctggggaaatattccgccgattgtgttatcgatctgatgatcttatgtgtgattatgccccaagaggcatctaacccttctttagatagtctgaagagctagcattacaatgcaagactatcccttacggttcagagtcctgttaatgccaaaatttggtaagccccgaagtcatcatcggcccagagtcagtatcggcttcagagttatggaatcggccgatgggatttgtcaagtcgccagcagtcggattcttgatatatccagttaagaaaatttatctagaagagaccaagttcaaggaggatgcggcatgacagtttatctattaattaggaagagtctgttagtttccttctatctttagaaaagtgtgtttagtatccgataaaaactttatgttttctttttaactttaggaaagtttttcttgtccaagaaggactagtgtctacccatgggtactttaggaaagtttttcttgtccaagaaggactagtgtttacccatgggtataaatatgtacacccggagttattgtaaactatctctatagatcaataaaattcggcgcatctccaccctttttacttttctactttttcgacaagttcctgcttcaagttagggcattggctttgatctccgacgatgagtaaaacttgctatggttgtttacatcggcagagctagggctttgacactttgatcttgtcaatgtatgcacctatttatcatatatcttagtttatctagtttagcatcttaatttgatcatatcggatgagattcgttttagggtttatgctggtatcggctaaattatcttgctagattagattaaataaggtatccaccaccctaaaaaccagttaaaggcttgattgtctacataatatgtttcttttcatactttgcactgcatcagccttagtcgtgcttagaaccataatctctagcatgctttttgattttcaataagggtttcatcggggtttcagccgatgagttatctggacgttgcatcggcttataaggattatatacaagatggatttagccgattgtgacaaagatttcattgtttatctaatcgtttggatttcatgacatcggtcctccagccgatgtatgctttaaccttcggatcattgtttattctatcatattattattagttgattgatttctactggattatattgttatttatcatcatcagtcgattgtctttatatcattatctatattggatatataaccgatagctcaaaacactattgatatcggttggcatcagcatggactgaactactccatcggctccttgctgctcctcgttgacctcctccccggcctcctgaacttgttctctaagttcctcttcctcctccttaacctcttcctcctcaatctcctcttcttcctcctccacaacctcttcctcctcaatatcctcctcttcctcaacttcttcctcctcctcctcctcctcttcctcctcctcgtcgctgtgaagctgctcgtcaagtgataaacaagcaaacttttctgacatgactatgtcttgtgcatcaagtagtgatttagttgtgttccctctgaaggaaatggaaggaaataggggatgactgggtgcggctgcacaactccggtggcgatggtggtagctcggttctaagtacgacattgtgttttgtttcaaagttttctagatctgtttttgtttaggtgataactttgattgatgttgtttgtttcgtggttggagctgatggtgattctaaaatccaaagcaggagctaccaaaatgctcaggtaactttctcttcaacaatccaatgctggcaagcgttgtggttcttgcttagcaattccccataattaaactcatctcactacctttagtttttttccttttaaattctgtggagaaaggtttagtctgcatcaccccatcctccagtacgaccgctgccaccatgcccgaagcgctcttccgcacagtacgacgaacacggggtgctcagcgaaatgtcccgtccgtctcctcacctgcaatgcatcatgaaggtgtgtatctgccgactatcgttgtttcgtcgaactattatgaatgatctttaggtgataaaatattgattgaattgtctactgctatcgctcagaatccatactccagcaatcttacatatatacatatttgttgcgtcaatcctaagcatgcttttcatatatccctgaacaattcagcctcacaactgctcttcatgtatctcattcagaattttttttctcaaattagttggactgatagcaaaatattgcttttcaagattgtaaaataaccaactagcatggacgttcataaatttttcccttctgtttggtgttattttatcagacatatataatgaaggcgtatatagcaaagggaggagctgttgagggaaaggacaatagctcaattttttttttttttgcggggaagacaatagctcaattgactgggaagttgatgtcaaatgtcgggagcaatctgctaaaatgttaaagaggtgcatgagtgaactggaaatatctatcttgtttttgattagtagtttctttggtttcaaagtaactcttgacatgagaattttattagcagaggaatgggacacattcttggaaaaatatatttcaccattgaaagggtcaattaggcctagagggggggtgaataggctaatttaacaaactaaacaaatgcggaagcaggaattttcgaaactttcgaaaataggcagaacagttgaacaatgcagtaaaagtctagatctagagggctaccacaagtaaatcaaggaacatacaacaactagacctatagcggctcaagcaaataaatctagaggatgggaaggaggaatatcacccaaaatgaagctcacgaagtttttaccggagttcaaatccttgagggattctactctccgttgaggagctcaaaaagagccgggtcttagctaactctttcctcaagaggttgcacaaagcactcctctttccactaaggggtatctctttccttgcggaggcgagatccggccttcacaaacttcccacggccaaccacaagtagatcggtggctcgggagtgacacctagctgtctaggagtcctcaatctccaagagtaaaagatgatgcgaagaactcttggagatgatgcaagtgctcacaaatcttcacgaaaaccacaagaagcattcacacaaactcgaatccacactcacacacacgccaaatccgaatcaaacccgggtggagagaggaatcgagaaagcaaggctcaaatgagtagagagagaagcaagccaagggctcaaataattgcaatgtcaccagcaacacttacaagaggggggatgggggctatttatagccacagcctcatatctgcccgttggtgcataataattgcgattttcagaacttctgaaaatcattttcggaacttccaaaaatttccagatctgaaaactcgaagtcaacgcacctttttggaacttccgaaaaatattttcagatatttccgaaaaatatccagaacccaaaacaaccttttgcaaattttcggaactttcgaaaattattttcggaaacttccaaaaatatccagaagtgaaattttagttatgtgaatttttggaacttccgaaaatccttttcgaaatttccgaaaatttccagaacacacggccaaggagaaaatgcttccaaaaattgattgtgagcacacacatcactccttatatgtctatgtctatgcatcatcccccttaatagtacgacattcctaagacgtaaagaaagtaagatatacaatataccatttgctcatgccataaattcatcgtgatgtcacattcaaaggggtatgcatcgcattacaacacatcgaggacgtaacatccttcacatttgctttcatgaaaattgttagtcatctctaatcgtattgtaatcaatcatcaaaacaattaggggcctagatgcactttcaatctccccctttttagtaattggtgacaatacaattagatcacaagagagaatgaatataatagattgatttggtgcaaaggtttagtgaaagctccccctaaaagtgtgcattaaggcaagtggagagctccccctaaatctttgcatccacattgaagctcaaaaagatatgaatcaattcatagtacattcatcacatttcatatctcattcatgacaagcacaattataaagggaataagaacattgcaagatcataatataaagcatataagtcattacatcccaatcatccataataaagcattaaagtctcacaatagtaatagctattacacaaatgacttaaaatcacacatagtctcatacactgaaacaccaacaatgttcgaccacaagctaaaatgaaaaagagatagatattctccccctttggcatcgaagcaccaaaaagagaggatgaagcgaagatggctcacacgaacggggcctgaggtggatcctcgggaggtggaggaggagggtagccatggccaaacccaccaaagaagtcgtactccggaggaagatcaacaaagggatcctcgatgtcatcctcaggcccatcgggctcagcctcatagcctggtggggacggtggagcacccaactgaaaccgagagtagaggtgcgcctgtgtttgctttgctcgccgggatgccttcttgattttgtttcgcgccctgcgattctgtttggcctctgcagagcaaagaccgaacaaacttcgcaagatgcgaaacaaagccgaaggctagcgatgagccacaggagagggttgcgcacgctcaggaggaggctgagtggaggaagacgggatgtcccgagtaggcggccaagaggatgaggtgggtatgtcaggagccgcagagcaagccttgggcactcgcagagtgagataggaatgggactcctcacaaataaactgggtttgagtgacatgctcgatcatccgcatcaggtgaggggcaaaaggaagcgccctcctgtactgaatcgaggccatgcggatctcctccaacacaaagttgtaagcatgaaagggattgccagtaggattaaacccgaggagcacattacgagagtgatggttgatgttgctagcattaccatctttgggagtgagggtccttctcaggatacggttgaggtagacatggaaaggcttgaaaccctcagttgtgcccaacttgccgccatcaagatacaggggatgccgctcatgatgcataggaatggaatagtcatggaggttagcaaagtacctcatccagttttcatcaaaaccccaaagagtggcaagagcctcataggtaatggagtaccactccccctgagtcatccaatgtatgccccgccggctgtcaaagaaaacggtggcataaaattgggcaataacctccttgcaccaaggttgatggagggtcataaaattgtggacacacatctcctcacacatggcaatcatagagttgagggtggggtcatcatgtgcctacaagtcctcccaattgatccattgcataggaacaatgggatcggttatgggaaagataacggtttcatagaaatcttgctgaaaagagtccagaacctgttatcggtagcagagcaacgaagaggtcgaggatcctcattcctctgaggtgccacaacctcagacttttggtgcgagtcacggggaactcggcgaggatcgcacgaggttgccgggtggagccctcaccggcttgagtagaccgccgaggagggagggtggaaccccgaggtacttgcgtcacttggggaccggtccccgcgtacccttccccagaccattcactgtccgagccctccgaggaggatggggaaggagtgggggaacgatcctggaggcgcttgcccctgcgcgagatggacttgcgaggtggcatcctataaacaagaaagggaatggacacaagtaagaggaagccaaagatatgatgtacaagcaaatggatgcaagaattaggcgaaaccaaggttggagggctcaggcagggattttcagaacttttgaaaataattccgaaaattttcggaaacttccgaaaattcctggccgaaccctaaaactcagatcctgtacaaatccaccaaccaaaacttgtgaaactgaatctgcaagtcctagggcactagaggaacatctccaccgaagggaatcgcaagatttaactcgaggaatcactagatttgatttgaagaaatacctcaagaacgcgaagaacgagtgaagaacgcggtgaagatcaacgatgtaagtgcccacaaggtccccaaacgtgctcccacgaggatgaagtggaggagagcgtcggagagtcggcggagaggaggtggtcgccggggaggagtggatgggggagaggaacccgtggggaaaaggatagcaaagagagagaagaagagtccatgggttggaggagagttttatacccccgagaattttcggaagtttccgaaaattttcggatttacagaaccactgagcacgcttctggatattttcggaagttccgaattttttttcggaagtttccgaaaatatacagaaacacagggattgtttgtactaaggcagtaaattttcccctgcgagattatttacagcacagtgattgcgtgtgttcttttattttctggtttcctgctttacttgaaaaccctataaaccccattgaaattgataggttgtaatttttctgtgtgttgcaggttttattttttgacatagttcagctaaaatttcggattcttgcatgaggtaggtctaaggttactgccatcatggaattttgagtaaaacgctattttttttccctaggaaatcatttggaagacatgcataacaattgtcctcttttttttttttgtgacttcatgctttacttgaaagccctatgaatgccattgcctctttctactatcatatctctcgattatatatcaacctaatgaagtgccggttagttatttgatgttaacatgatgtgtggctccagctttcgtttccttcttaggagatggattatcaacctgtcgcatattacaccgttttgcttcaacatgtcaatttttaacttaagaagttaatttcccttttatattgtgtaggcagtgcatggctggccaaaaaaaaatcaactaatcatatgcaaaactatgagtatccatgcaactctgatgatctaaattttgttctgcacataccatgcaaaaataatcggaattgctagaaatatggcgccatatttctttccagtttacagtcgatttttcactgtgcaattagttcagagattcgtgcatgttcgagactctaatgccatcgtaactactattgctgatactaatctcaaatctctaattgttacggagtaaaaaccaagattccatgcacagatggcaggcaaaaggacaagaagggcctcatcattcggcatattggtggaataagccaaacggcatatttgcaaacgaaaattaatttgtaaataaaacttttacatatgtgttcttagcgatctaaaagcaaaggctgaaaataaactttaatgaaaaaaccccaaaatcagcttcaaatttaacgttgaaaattcaaacttaggctgattagcatatgaatatgccaaacgatgggaaccaaaaaggagaagccagggaagatagggagctcaccgtcaatgtttgtttttaattacactgcagttatatatataattagagtgtaattgtactatagttacacgtgtaattcctatgtaactatagtagttacacctcacttatataccacttacatatgtaattagtatgtaattttaggatttacatatgtaattttaggaattacattataaatacactaaaattacatatgtaatttagggacttacaatgtaaatacacgccgactatttttcggtgaaaaatatggcgccataaatatagctactcccaaaataataacccatagctcatgaacgaacagtacatgaccgttacaataaggtgctttaacacgtcataagcagaagttgctgggatgctagataatattgtcctcttttaaacatagcatgggaattatagtagaatcaagatgctttcctttgcttggtaaaaatattttggactgcatttcagaactcagaccatcatctatttcagtgtaattacattattctgcagaaagacacaaaactatcatggaatagatagttctatatttataaggcatgtagttcttaattcttttaatcaagccaagtgctattttgtgtggtccatggatctttgcgttacctgtaaaactgtggtttatatatttctttgggagctggattctcttggtaatataattgactggtagtaatacacatcctgtaaacaaattaatttttcctctttgtttcttttttttaccgtgccatcttcttccttagggtaacagaaagctcctaataacattgctagcaatccctactctataaagtaagcttttttttttttgcggggaacatagatgcattactcagctatagtcattacaaaccaagtgcgaaataaaattacaagaatcatctggccaaaaggccgttaaggattctcgacgacctctgctagctagagcacgactgacgctgttctgattacgattgattttcgtcagtacaacctctctgttcctgaacaagagacacttaatctctcttattataaactcaaattcagatctccctttttcccataagtatccttatgggtcactgcattggacaacataacactggacaacataaacaaattcaatagtatagtgatgtgtaattcgcgtgccttctctgtgtctataatatgccaatttttctattgcttacacccgtttcttattatgttacgggaagttggtgatttttgagaactggaggaagatcgtggattttgattgtaaaagcataaaaaacagccaccactaagatttaccagtcctaagtgcctgactttgcctgtaacaataatgttaggaagatattattttgaaacaatattgttgtttctggtatgttgctgctgccgccttgctcttgacgatttgctgtggatttacttctgctctgcgctgacatcctgctgatgtatgtgctgccatgtactactgctatggccagagaatagaagaatacagagggaacaaggaagaggaggaaagcattagagttctttggtgctcatgaactgctcgatgaaatgtcttgaggtactactaaaatccgagtacgtttctgtgaattatcgttttagtgggtctatatgcagaaacctccttccttggatttgttattatgtttccagtggaaagtaatttagatttaacaaatatttcagtgaatcattcaagtcaatcaactaaatcaataagaacatgcttagtttattcccattaagaggttgtatagaaagtaaaaaaaagcagaacagaagtttggtgcttgtatttacacgatttggtttttattgtgctttatgcaagtctctgaacttattttgcctgtggacatattacaggggctcatcacaagtatctatacgatctcttctattgattcacatgtgatgatttagtacctttctcaggattgcacacacatgagctctatgccaggttagtcaaggttgttaggtttgttaagactatccggaatgcatagtcatacttattataacttctctcactctgcatgaggaatgagcttctatataatcactgattggtgctgctcgcattgttataaacaacattttagtttgttgggatgggaattgagagaccctgtttccaaatgtttttttatggggtcaacaacaagcctgctataataacagcctggtgatacgccaatgttttgtttaggattattttagcaggatgcttactaggcaggcatgattcaggtagtgcacttttatgtagtgcagtatggatgtttgctaggcagacatgattcaggtagtctggggtcatttatagaagcaggttatctgaaacattacaagcaattgacatacatagtatctggtgggttagggcactatgcgacgctgtgatgagtgagctgtggccactgtgctgatcatagagcaacagagcagaaactacaggttaaggtgatgtcctctcttcctaaatcctcacataataaagatttgaattgcagtgtgtgattatggttttgtgattggttagtgcgacatttgatactgatttgctccatgcataaagaggttcgaaattcagattaacctgcaaaacaatttgattaggaattcccaaatttagttaaaacttatttgagtggaaagtttcagtttgttagattagctctttttcatgcctgtgagaaggaattatgtgcattccctaatatcggtggccgcttgcgtccacggtcatcagactatttcctcttccttaacgccatcaactgaatatgcagttgctcgacgtctacgccatgcttatcttctcataagcgcctcccatttcatccctatcggcctctgagattactgaaggctcctgctacatgaagcatgaagtgggtgctggtctccatctgcttctctccctggtaccattttattttattttttgcaagctggccttcattgttaccctggtggttgatccatatgatgaattgactgtgtgatatggcttcggtgttgcttccatgcattctgacctatctcatgttctgtttcatttagtgcctcggttcgattcaacacaaaaaattaagtgctcaattgttaatagtcttttaaagtaattacgcaatcccttttcttttccagacgtgcaggaatttatggttggcttaaaaattatagctgaatgggcacaccattaatgttcactgtgtacaaaaaactgtggtggttttttgaattttgtacatgatccaccaaacaaacaaggtaatctgcattggttatttggtatacttgtggagcttattatagatcaagatatatgtgaactaatagcattttaattaaaattagaatttgtccagagcaccatatttttatgaatatttttttttcttgacctaaggcataactttagtgatctgatcttatgaattgctatactgtctaggttagctacctttattaactagaaaacaatagtccattctagccatattaattaagccacatttgagtcaggtgtataacctgaatcaaggtgaatgaaaacatttaactggagtgctgcgcaataatatatgcagaattgacacaatttagatggttggagtttaggcattctgtgaagtccccaatttcattgaccaggcctatttgaaacataaggggggggggggacatcttatggtacatcaagttggtccattttgttcacacaggataacactgcacttaaaatattttttttcatattatggttcaagtgcagatattgtggattgccataacactcaccttctaagtgcatattataacggagatttttgagttgatgaatcgttgtgagtatggaattttgattctacgttcttctatgattaccaggctctggaaggatctaatatgtggtttaggaaaggatgggagtgcttgaacctggaagcatctcctgctcattatgctcttaggtgttttatttccgatgctgttactattgatacaacagggaaagtcacatattgtttaaaatatttattgtgcttaaaatactatactgtgtaatgtccgaaatttatattcatgcgttagatgtttcactttcacatgcacatgcacttctgttgaatgtgttgttaagttctcctatgaactgtttcgctgagtggtttacattacatttctttcacaggtggtgatcatagcatgatggcaatcgaattccaccgtgttggtagcatgcactatatattttccggttatacatcacagaagacagaaaagccaggtatgtttcttatgagcctgtatatatcactttactaaaagttttctggcctcaaattattgaggaacttagagctaccattgaacaaatgtgccctgtttcttgcagtgctttaatctgggtgcaacaacacatattctaactggttttgggctcaactttctgttattattaatttactagaaaaaatccccgtgcgttgcaacgggtaaaaacgttttttatactatacattatactcccttgtttttagaccgaatgctttcttgtttttggaccgaacgttcattctttccctcattttcagatttagtcctagagcagtccgctgcttctatctgcttggcctctctcttcggctcagcccacaagtggagctgtaggcccagctcgaacagtcctttgcttggcctatctcccttcggctcagcccacaagtgaagctgtaggcccagctcgaacagtcctgtgcctggcctacctctctttggctcagcccgcaagtggagctgtaggcccagctcgaacagtcctgtgcctggccttctcttcggctcagcctgtaacatctcgaacagtctcgtgcccgcatgacggagccgatcctcccaccaaatccggtaattgaccagctcgaacagtcctgtgcctgccctacctctctttggctcagcccgcaagtggagctgtaggcccagctcgaacagtcctgtgcttggcctacctctcttcggctcagcccgtaagtgtagctgtaggcccatctcgaacagtctcgtgcccgtaccgtaggggtgaaaacggtacggaaactttccggattccaggcctgtttttggaaacggaatcagccgatcgaaatttttttcggaatttctcgaaaacggaatcgaaaacggaaatattttctcggaaacggaatcgaatatgataatagcagtttccgtcggaactcggaatcggtcggaaaaattccggaaaatttgtcggaatttccgaagttaaaaaggcccatgaaatcaatagtctataattcgtccccaagtttccagcccaacccaaatcgcggcatctacccaaatagtggctaaccctatagaggagagagacagacacacggcatcgcgagaccgcgagcggtggcagagcatcacgctccacccaccgccagcgccccgcgccacccctggtccgccgtcctcggctcctcgcgacctcgcccccaccatcttcgctgtctcgtaccgccgccatctcgcggcgctgtccagccgtttcgcggcgccgtctcgcggcggcagcgccgtcccgccgtttcgccgccgctaccaccactgacgacgacgccacagccacaccgacgagccgacgacgcctcgcctctgcgactcgacagcagccagcagcccagcggcagcagccaacagcccagcggcagcagccagcagcccagcgacgagccgacgagcctaaaccattgatttgatttcttttgtgctgcagatttatgatggaatcatcaaatgcaagtagctattttgtgattgaactaagtactgtactaatggactgatgtgtgttgctgttttgtgatgactaatgattgatgaactatgtactgatgatggagtgatagctcatagcagattagcagtatagcactgaataatagtgtatactgtataccttataccatggtcttttgctgtattttttttagaatatttgttatgcaaattatatgaagttatagaagaatatattttgctgttgagacgatttcatataattgtgttttatgatgaattgttgactgttgagacttgagaattggacttggcaaaagttttaagctcagtttgaggggtttttgtattccgataaattttcgttaccgtatccgcgccggttcattttcgctccgttttcggtttcaataatattcgtttccgttttcgttttcggggtttccgattccgattccaaaaaaaaaaatgaaaacgaaaacgataaagattgtttccatccgtttccgtaccgttttcacccctacgtgcacgtacgatgacggagtcgatcctctgtcaaaagcggccgaatctttctcgatctccaaaattgttagagattttgattcactcgatctcctttttcgatttttttaatcaaagtcgaagcaatccgcaaaactcggaataaaaaatgacaaactaaagggatgaggaaacgcatggagaggcaaatcgatatagtggcggcgctagggttcggcccgacaaaaaaaaaccaccgaaaaaatagcgtgttggattttgttaaaactggaaaaacggtgaaagaaaaaaaagaaaaaaacaacgtaaagaaaataaaacggaaaaataaaataaaacggacaaaaaaaccaggaaaaacggtgaaaaaatagcgacaagaaaataaaacgaaaaaaaggaaacggataaaaattaatttgtccttttctatattttttcttgccgtgccgggctttttttttacaatcgttttacggacgaaaaaaccgggaaaaacggtgaaaaaaatagcgacaagaaaataaaacgaaaaaaggaaacggataaaaattaatttttgtccttttctatattttttcttgccgtgccgggcatttttttacaatcgttttttttctgcctttttttgtccgcttttttagcacggataggaatcggtcagttttttttttctgcgccttcttttttggggccggactttcttaattacaatcgaactttttttatcgcttttttttattaacggacgaaggaaacatcttatactttttaagtatttttaagtagtagtagtagatagtagatttgtacttgatagattctttgcataggctaagaatctaatctaaccattaatagaagtcatatagatagaacatcttatttcagtttcacacagggatgccacttttgaacagaaaaataaagatatatagttatcaatatgactatttccttttcctcagctagattccatcaaaatgtagctatttgcataagatatctgggatgcttcaggataatgaaggataggttgcagatattcccttatttgcttcagctatacttaaaattttcgcatctggctagaggtttgtcatttgatgttatcgcatttttctaagaggggttatcataccttttccctatatttcactaacaataacatatccatgtacatgcactgtctgttgggcctagaatgtgctaaaaaaattgggatatggcatttcttattgtacagttgcataaagtgaaaatagaaaaaaattgtgaaaaaattagcacaacacctcttcacaaggtaaatgttcccctactctgtttcaagcttaagatgtattttcgttacctatttaggtattcaccctcttgagatgagttctaaaatttgtttgtatattttttccttcgatgttacacatgatgccaatatagtatatatatgtaatcaataaaattatacatgatccaattttttatcttcctaggcatataaaatgattaaggctacatcttgaagatatggcagctttaatgtatatacttctccaaaacaagttttcagccttttgtacttagaatgaagtagcaccattaattttgatgttttgcaaagtaaattatgccttttggtaagcattttttatatggtcaagcaatctttgaaatgtaaagtgcaggtaatgctgcatacctaggacttgaaataaattcagattcaaagtattcacttttaggtccaagattagatttatccagattcaaattatccagtttcttttaatagtcacaggaaacggggtcggtggcagcgatcctcgacccgggaacgccgtccccgtcccgaaaacatggggtcattttcgtccccaccttgtaaaaaactctctcaagtagcgtatcacgttcctcgaccccgtttctcgatcccatcgacccaggaactttgttactatactgctgccataacaattaaaagaaaagagaaaattcaaatgtgttttcatcagttgacctagtgcttgaagaaaacttgttaaaaaagtaaggaaatcttcgggacagtcatctcatttagaaaattgtagtacatgagaaaactaatgttcaagaaacttgaaaaaagttctggagaaaaaagaacttacatacttttagaaaaatgttgtttgtgctgccataacaactaaaagaacagagaaaattcaaatgtattttcatcagttgaccagaagctggtaactttaattagcctaagatttgcaagccacatttcagtagattgggaacgtgaagggcgctctttatttttttttttcaaaaggggatgcctttacttaaaagctttaatacatgattgattaaatattgatgaattgttcgatatgatttattatagtgattcatgttattatgagtaatagttagttttgttctcatttttataggtttattgatttttctttttctttttacttaaatttcttcagttttcttttgaaaaaccgtgatagttgaagtaatttacttatggttgctataaacactaccgtagtacctagaccatagtggtcgacaccgtcaagtggacaagcgctggaaggaaggcctgatgagaagattgtaacgtcccgcctcccccagaccaggcccacttacatctgataatttttataggtcatagactgccctcacagggccaacatatgtcttttctgcacacttttgtcctcactcgtgaacatgtcttttctgcacacttttgtcctcactcgtgtgcacccgggaagaattttccggtcgatcacccatcccaaattgctccaggccaagcacgcttaaccctggagttctttggagattggcttccggaaaagaagttgcaacttgtttatatgagtattctattaatcctattaagccctaggccgggatgttacaaggatataattgctttgttgcagatatgaaagctacatagatgtgtaccattgggccaaaaaaatcccattaacaaaaaggtaagtgttgttctcttccaccttgctactaccaattgctgttgttgaatacaaacatttgctaccacaaaatattttttattcatgtgatctgatgttatggagcccacttgggttgatgctgaattgttgtacatgattttctagccttttctaataactagatatgcttgactataatttgttcttgttaattccatggtatcattcaacttgagttaatgtgtctgtgtctacatattattcaccgcaaaatgatttttagtcatcaaatcatgatttggtagtacatgtgatttgttatattgtacaaatctgcgtggttttgcagtcaattaacgtgttcaatacacgtggcttggaagctgaaactagattccatggcttacaacccagctttcttgccacaccatgtgaagcttgcctttacctctaaccatattgaattatcccagcatttatatcttagggtcaaaaatgcatttcaacatgaagggattatgatttttcacattatttttaatttccattcaatataccatggcataataatataacagttgaagtttttagatagttgtactgctcgaggacccgtgggagttgtttggttgggttcaaataagtacagtgtctaaattgatatgcaaaatcaatagaggggaaattcgtctaaacctttttgaaagtttttggtgtggaaactggattattttttcagggaagatataacatttttttagggaagatgttaggtgacaggttataaatatacgtcactcgaaggaatttcttgtgaatttatgctgttgtttcagattatcatagacgtgttgtgcgtattgtgttgattagttagctccttggctgcatttcagtgttcattccgagtgtttagttccagagcacattgcctgattcaaattaaacagaatgttgcacacctgttcatgaggtttccaaggaacaagtaaagatcttctaatcacgctaagagacttagagataatcatgcagaaatattaagttataattgtgtgatctcagagttaccatattcatgcatgcctttcagggggagtgtaggtattagcataggatatctgggatgcttcaagatggactttacaattgctccttatgaaaagaaaaatgaagtcaatcagtctagcaattaatttggagaaactgactcttttgcaagctatttgagaaggcatctatggaaaatataatgttttgctgaccggttgtcattttacttgtgtttggtcaaatggtcagggacactggctggcatgtagatggagggttcaaaaccgacaccatatgctttatcatcgatactcagggttttgtatctatatgattttggtttagcacacatttctgattattgcacgttattaaaccatgtaaacaatggattacaaaatttgtgtgcaggcccatcatctagaatatagtcattggtgagcagacacttacacttaggaaggaattaggataggtggatcacacacagacacagggacacgatgcatggatcttgcagcacaacacagacaggttgctacttgtgctcctcgtcgaacgcatagccatgtttgaggtactggtcgatgaggttctgctcgtaggcgttcatcttttcatcgatgaactttctgagtttgaggcagaacgttgggccagctcctcctcggtgtaggcgtactccgggtaggtgtaggggtagctcatcatttgtttgataacaacattaggcatcttgtacttgaccaccttcttcccagactcctccaaccagcactccatggaccccgggacattcctcgacacccagagaggcctccttcttgaggacctcactaccctcacacgggatcgaagaagacttcctccttgttcctggccgccatcgcccgcgcgcgatggaggcagttctcttcaagaagaagaaaacaggcaggcaacaatggcggcaagcggatcggaaggaacggccaacgacccaactcgtgtcagcccacaaccgttttcaagccttttcagcccatcccaccaatcttaaagcaaccggaaaagaattacaaatatactcccatgcaggcccttaatggcttaatccttgggggttttttttatcaataagccatataaacaatcaaatatatcgccttgatttcacacgactaaatgctgctattgcttcttcttgttggctgcgctgcttcaattccttcacagccgcatcatagaaagacaatcatagcaaattcatatgcagacttgtagcaagctcatgttagcaaatcatcagactcagttcaatttgtgctcgatcgtatcagagaatcagcatggcacacttgcttattctgtataatcatttatggtaatattaattatattcatgacttgacatgtgtgcatgtacaaaccatcccagcagttaagcttggtggtccaatagaaggatgcttaacagtaagcctaaattcatctcatttccccttggaagagatttcaaggtataataacgattactgagtggcacaattgccaactagtatattatgatgcttctcaactgaagattgcaagcatcatcggacacgacgtaagtactgttaccacaatacacgatataagtaagcactgttaccacaatacaatgtatagacaggaaaatagtaagcgcctcatctttagctgctatcgttcatgttgttaatagtttcaagggcttttggaggcaccatagaaaagggatatgaaattgaagcaatgaaactatgaaaagagttaagagtaaaactcagcaattgtacaaatgcactaggaatacaaagatgaatcaccatgcttgtttcagacaagtattttcactctaaaaaaaatcaacagcctattagtcaagttcttatgctccacaactaagaaatacagtatcttacagcacaaaaagcttaatcctctatagcttcaaattcacagctcatagtttttatacgcatatagtcagctaaagaacacaggaaaataatattcattcaacagttgacagctaaagagcacccagagaaaacatgtattgtgatacaggcatatagcttcataggcattcagaacagttaacaaaagatacaggcatatatagcttaaatgtgttataactaccatgtaaagagaaaaaaaaaataacagcaataatggagttgcgtcccataaacatgaaataaaactgtcaactgcagtcagatgtagcttttttctgctgacagaaattcaagcatgtgtagttttacagcgacaaaaaacacaggggatacatacaccctgggacatcatcaacctctaggggttcaggaaggaaactagaacagaagcaaaattaaccaaaagttaggccctagccagccaatcttcttgcattgaagttgcatcatgtccagcaatggcttgataaggacttccgctgcaaaatagagacgattttctgtatatcattccatgaaattaaatatactagacttttaggttccatagatgcggcaatgaacttacaaccagcaaaaatgcatctaaaaagtaggtgatagataaaaacagtaataacatagagacgattttgtgtatatcatttcatgaaactagactttagcgttccatagatgcggcaacgaacatataatcagcaaaaatgcaattaaaaagtaggtgattgataaaaacagtaatatacctcataaattgaggaacttggatagcttagaagttagaataaatgtcccaactgaagtgcctgcagttgacccctgttatacagctccaactgcagatacgggacaaccaatgggaaccggacatgacatgcatactctgagtccacagcattatagcccaaaatcaggctcctccatggatccatcctgtgagatgtcctatttctcagaaaatcaaagaagaacagagtttcaattaaggcgatctgatcaggggtaagcgatttctgtcctcgaataggagttagacccagtgcatgtaagaattccctctgacgtttgttgaggcatgtctgagatggtttgtcagctggtacaatacggccgtcagggttgaaatcataaggctttttgaggatacggttggtcttgactttactctcccaaacatcggcatatggaaggtttgttaggatagccctaagatcatctggtggcatcacaaatctgatatggtcatacattgacttgaaaaacagtgacacattagctagggataccaatgacccatgaaaatgaaatatctctctcttgtcaaactcatgaaggatcaagtttagcaggtgctgtatatcttcaggcacacttccgtcttcagatagaaagagattcctgataatctgatgagcacacaaatagttgtttcttagaaggtccatctctaactatacacgtgaaatgttcttgaacttaacttttcccgtgggactcacaaagatgtttgaaatgtttaaatccaaaaaacacaaatttctcaactcatttgtccttagtcctttcagcatagttctgattactttcttacatgactctgttgcaaccagataagtcacacttggattagtttccccaaatgaacgaaactgatacgaatcagaagtcaccattggtctaatattcagataagactccaatgggatgcaatcatcaaaatacacttcagaggtatctaacacatatctatcatatgacacgtaggataaggcagctgtgaaaaagaaaagaaagcaaacattacttcaatgttttgacaacctaaaaggacagggaaaatgcaaaggcaattaccattatgaatggggttgtccatgtcttcaggtgaaaaacctggaaccaagtcaaggggacctggattgtttgcagtggccatggaaaagctcaataatggcagaaaacctacaagcctgaaaagaaagcatggacatgaaaacaacagcactaaaatgcaacctagttgctacctatgaccgtccccatattttatgaaccaatagaagtgaaatgggaaaatcacagatagagaatatacactacagatattagctatctgtcactaaacaatccaacatgacttgcataggttatcttcttcctatcaacattagtcatgaatctattattaaaaaagcctaccgaaaggataaatcatgtattacctacaaaaacaactgctacttttaatagaagggataatttgtactatgtggtcatcagctacaaaaggctcacatatataagaaatcagctatcatgtagtatccagataaaccaacctgttgtaggccagtaagcagatgtcaaagcatagatacacaaattcaagatcaacacaaggaaaaaaaaactgaggcaacatcccaaggctcagccacttgatgactacatgatggggaagaaagcaaaacacataggaggctgggttaacttaaccaaacaactcagaacatagtgggagataagtccataaatgataaatctctgaaacgaaatgaagctttagatgtagaagaatgcaagttagaaacaaactaggggatcaatccaaatgcgttttgaaaacaatatgcttcagatgcagaagagctcagagacatgcagggagttatgttagttaaccaaataacagatacgaagtgatcagtactaacggatcagtccatgcatctctcaaacaaaatgcagcattgagatagagttgcaacagcgatttcctttctctattcaattcacaccagaatcccagcataaaaattatctgcagcttgccttccaaaatcagtctcagattgtaagaatcgtgcgtgtcaaatgaatttgtgcaattctctgttcccaaaattcagaaataatgccagttcaaacagatttacaattgtgcagaaattaataaggaacgcacaaagacagaacaggataaagcaacaggtgcaaccaacagcccataatttctcaaagcaacagccaacaggagccaagttcaggtattggtttgttgctaactcattaggatcaacactgaagaattcataacacgcacagagattttataaaccaaacaagacggcaggataccatcagcatgatccagaagaaaacataacgtgcagggaatcgggtttaattgaaccaaacatctcagaacgcactgggagaacagttcatacatctgtgaagcgaaatacttcagatgtgaaaagaaggtatatcagaaatacaaggaggatcagtcaacatgcatatatgagatgaaatgcttcaaatccaaaatatttcagccacatgcaggaagttcggcaattaatcaaccaaactacagacagcataccatgggatcagattcaaactaacatatcagcccattcatctctgaaatgaaatggagcattcaaataaagttacagacaccagaatcaaagcaaaatgcccaccgcaatgttgtcatgttcagggaggaagcaccatcgctacaacgggtgcttcgactctgttgaggacgctacgctctgggcagagagaatgaaaacacaggaacgacaggtggttacggtctggaaaagctgtttctctaatcccctttctatgatgtaatgatattatgttcgttgcatctgctccatccaatacaaattcatgaacaggaaaacatcccctatcgatcaagcactgaagtgttgcaaatctgcaaccgaatcccaccaatgaaccacatgccgagtaaagaacgccgcaatacacacatctgaacccgcggattctaaattcgtacgagaactcaaatcaccacaaaaaggctcatgcccatgctactgtacagattcatctttgctactctattgatccacgacactaggtgctccgttgccaaaaatcaacatataaaatgacaaaaaccaacatataaaatgagacagcacagtacacaccgagggattcaaaatagtgacataaaaaagcatgggaaaaaacctcgctcaaatggacgaagtggctccagaaaaagtgcggtggcgagtgagtggaatcagggcgacggagacggcgagtggaatccagcgatgacgacagaaatcgccctcctctccgcctggcacagacaaaacgagaaaatgaaaaaaaaaaaagaggaagatgtgggagggagggagggatgtttacctacacaggtaggtttggggatctcgatctacgaggaaggcttgtcgccggaccagggaaatggctgcgtaggcatcgggtcgacgaggtgaagataataaatctggaacgagaggttttgggaagtgacggcggaagcaggaccctaagctacggtttcccatcgtcgaatttatagacagggcgctagacgggccaggccgtgatgagtggtcacaggttgggccagcccggaaacttgctagggcagatataaatgtcgagtaagttcactttaggtccctcatcttgatgctgaggccctgtttagatgctggcaaaaattttacagcatgtcacattgaacgtttgaacacatgtatgaaatattaaatatagataaaaaataactaatacacagtttacgtgtaaattgcgagacgaattttttaagcctaattatttcatgatttgacaatgtggtgctacagtaaatatttgctaatgacggattaattagacttgataaattcgtctcatagtttaccggcggattttgtaatttgctttattattattagtatatgttttatactttaaatatgtgtccgtatatctgatacggcacgctaaaactttacacccttgatctaaacaccccatgagtttaaattacatcctaaatcgtaaaaccgagtatttcaaaacggatgctaatatagttctaaggcaggattgaatacggctttgactgatatggagctgacgtgacacaataatgaaaaaaaaacattggaagccacacgtaagtgaaattaaatagcatagcgagagaaaaatactgcataacgtgatactgtattgagccttaggtagggatgaaagcggagcggataaatactgcataacgtgatactgtattgagccttaggtagggatgaaagcggagcggataaatactgcataacgtgatactgtattgagccttaggtagggatgaaggccctttttgtttcaacttatgattattataatctagattaataagccagattactataagctggcatggaataagctgtgagttgtttatttgtctggattattgaagacatggattattgggtttgaatggctaaagtctataatgtcctcagctatctgttcggttgatggcataggtgggtaatttttctcaagtatttaggggtagtgggtctttagccacttaataatctgaaaaaagctcctctagagcagcttatcagattataataatctggcttatagattataataatctactataataatatacttgtttgtttcagcttactcctaataagctatattataataatcctaagctgaatcaaacagggccgaaagcggagcggatacgaacagataatgctcgtaccatattcatttcatgtttttttaccggataaaaaacaaatacggattatctcaaatacgaataagtatcgaatataatcggacatgaatacggaaacaagttttttttaatacgaaaactaactcaacttctaatagaaacaaatatgaacatatataattagcttattttatataaatgccgtataatttataaatattttttttaaaatttaaataatattaatcgtgtggactagtgttaagagataaactactattaaaatcaaaaaaaatatatattgaaggttatagagttataaagaaatagggtatgtctcatggcttctgcggatatccgaatagcactgctcatcgcatatccaaattattatccgtatcaatcgacatttgatatcgcgactacggtatttgcatagtatagggatcgttagtaccagatatatgcgagattgaggtaaaaagatagagacaaggatttttgtacaggttcggacctcttatcttatagttaatagccctactcctgttggccgaagtcagtgttactcttattcatcgtaatcacataagtacaatgtatggggataaactatgtagctgtcgtcgaactggcggcctgtaaaccaccactagtcagcggcggacaaacccctgaatgttaatgttaactttaatcgaatatcacgttaacatccaaatgaatatcttttactgtgattccaaacaaacaattaacttatatttctaagacatatattccaacgcaacatgtttaagtcgtaaattttgataccgagcaacttttataagataatggggtaggaacaatttgcacatgcctgcagcgaagttagggtctggcattcgttcctgccgcggcggaagaggacgttgcgcttgtggtccatggagtctcgcacggcgaccacgccgtagacgccgagcggccaccggaggccgccggtgatctgggtcaccttcaccgtgaagacctgcattgtttccataggctgcgcagaagggggcagcactggaatgtctgtgtttggcataggagggagatccgctgcccaatttttccccccacaaaacaaacaaaaaatcaatcaatttgctccacggttgaactaatcgcatcaagttttttttggaactaatcgcatcaagtcgccaagaaattcaattcaagcagagaattcaagaagaggcatactctcgtcctcgaaggtggcgccattggtgccgtaggaacgggcccagctctggcggtaggcgtccaagggattcggaaggggttcgtcgtagtactcgtcgtcgtcgtcgtcattctccatcgccatggcgcggcggcgggcactgtcgtggtgatcctccgacggcgtcttggcggcgtcgccgccgccgttagaagctctctcctcctccgtgggcttctccagatccgccctcttgtggccgagctcgccgctcgcaccctccgtttccatatccacctccattaccgccgccgccgcacgccgccggcgggtttagggtttgtctcgtcctcactcctcactctgcttccttgttttctctttctttttcttttttgggcctcctaaagttgacgggctttggcttaagcccacccagccgaagccgaatcaaagatttttggaacaagtttattttgcctccctctcttttgctccttgtcgaatcgcatccctcgaccacagaaccgggtataacgtctccctctcgtatatcaaaaccggtgaaaattgtctcatttattggattgggaagcggtttcgtccgacgtggcaaattgatacgctgaacccacttatgagcggcctctacctcatcccatcttctctcacacctctcccccctctctcatctctttcgtcctctctctcaccttccatcagcaatagaccgggcggcggcgacggtaccaagctttgcggcgcgagggagaggagcttgccagacagccgcacatggaaggaggagctcgtcggccggtcgtgcccgtggagaggacctggccggcaggggtgcacatgaggaggagatcgcaaccgtacgttcgcacacatgaaggagctcccagcgagtcgtgcgtggggagaagagtcgtcggctggccatgcgcagggaaggagcttgccatccagcaccgcgcggggagagaagctcccggccggccgtgcatatggagaggagtcgttgaccggttgcgcgcggcggagttgctcgcccgccggccacacgggggtggggaggggggggagctcgccgaccggccgtgtgctgaggaggaggtcccggccggccacgcgcgggagaggagctcgctggccagccgtgcacggggagatagttgttggccaaccatgcgtggggggagcagctcgattgccggtcacgcccggggagaggtgtcgtcggccggccacgcggcggggaaggagctcgccaactggcgccgcgcagggagatgatttcccagctagccgcgcacgcgaagaggagtcgtcggccggccaccgtgatccccctcggccgtggtaccgtttgcagcgcccaagcacgtggctgtccaccccagacctaccagagaaagagataaggaagaagagaaggttaagatggttgacaggtagggcctactgttttttatttctaccattatcacttacatgtgggaccgttttctattttcaactcctttaatgactaggtgccacgtcagcacacttagatcaaatcaacttgccacatcagcaaaagccggttcaaaaaccactaaaggagttaatttgtaccagtttttaaagttgggggacatgttatacccggttttgaggttgagggatgtgattcaaccaagagcaagagttgagggaggaaaaatagacttatttcaagatttttacaaaatttattaaggaataagttcattggaggtccctcaacaaaatttaattttttttacaaattttacaaattaggattttttgagtttacttaaccataaaacgagaaatgtatacctctaaactcatacaaaccgtacaatcaaggtcctatagcagtatatataggtggcttgactgacgtggcattctagtcgagaaaaaaaagtccacatgtaagtgtgatgaaaaaaaaaaagagatccacatatcttatttcttctcgttttttcccttttcttttctatcttctcttctcttttcctctccaatcttctcgacgctgaaccgcagccggcggctggcggcagatggcccggccactgcccactccactccgccggccacacgctcacccgccgccgtccgccacgtgctcgcccgcttgctccagccgcacgccgccgctccgctccgccgaccgcgcgctcgcccgccgcttgctcttgtttcagagtacagtctacatgtacttactgaatatccatgccagagtgttggctcatcatcgtttttcgtttcttgaaaacctgtgcagatggagaatcgatggcgatgacattccgatggaaacacatagtagcttaaagccttgtcttcagatggtgatccttgacccttcactttgaggtcaatctcaaataaggggttatccaatagaagaattgcacggctaggacctgtgagttccaatgctgtagttcatatgagtttgatcagtaaaatccaaaatgcaatgttaattaacacgtggataggaggaaatgggtaaatttgcttgcaatcgaatcactacacaattaggattagaacaccttgcagatgtgcgagtgcgagcaagatagagagtacttgagcattgaaatgttcattgcctgatgtttctgctttcaaatccgagtactcgagctcgtcggtcagcaggttcgcgtaagcgacccgccgatcgagtagacggccaagtggcaacccctctggttccaagcaacccaggaaaagagctgcaccgaggagcccgcaaactaggcaacccaagctgcaacaggcggccataacttactcggatactccttctgtcaaaaaaaaaaaaacttaacctctgtctagatttgttgtagattatgtctcatccacgtattaggttaagtttttttggacggggggattagtaggcaaccccaagctacgcaacccaacccaaccttggatgggaagcggcctctgtcccttgggattagggggtgtttggatccagggactgaactttagtccttgtcatatcggatgtttggacactaaccacaagcaatgggagtcctcaccgcacattgtacgcctacatgtatgcaaacaaaattagtggaggaaaacgatcatacgccccacccacctaacaaaaccattcctttagaaaaccggtgaaaattaggaaaaaataaaaaccaaaactttgtctaccaaaaaaaacatggctttaactttcatttttaatcccatatctccctccatttcaagatgtatggcgccgctgacttcttgcgtaacattcgaccattcgtcttattaaaaatatataaatattatttattttgttgttatcaaataaactataatcttaacttatacttttatatatttgtattcaatttttaaattaaacaaatgattaaacattatgaaaaaagtcaacgacatcatacatttaaaaaatgaggtagtatcatgactttgcggtttttctatagaacactgcacaagggaaatgcactttgtaaatcagctcatgaacactacacctatcctaatattcatttatgattgaatagtagagagaaaccgtgtgaaagttcggaaatacccctagactcacatgtcaagtctctcatctctctatttctctcgagttctatttctttgctcttctcgctatcgcaggaggccggcggggcgagtcggggtgtgatgagcttaaaggcggtgggctgtggttggcggtgattggggaaggaaatggggaggcttcgcctcgcctcgcttcccaaatctcacaaactaaaagctaacggcactaactcatggaccgaaaaggaagaaattaacgcgggtttgtgccgtgtagatgtttagtaccaaaaagactgagtggaggtcttctgcagtactgcactactcactgacatgtgggtcccatagaccgagcaatgctgcacttagtaagttcttgatcggttaatccccatgagggagggactaaaggagatttattcaacacctattatggtgtgaaattattccctcttaattccttccaatccttttcaattccctccaaaccgaaccagcctaaatgacggtattaagtatacattgaattttttttctaataaggaaaaagtatgcattgaattttctctatttttgaaacggaggaaataattgatataggagaaggtgaagaagcagatcctcggacacctcactccccttcccaaccggcaaaccctactttttctgcggcggccgcggtgatggattccggcccatcttgtgacggtgctagccacggccacaccagttctgc

SEQ ID NO: 59111 - DNA, 2546 bp, Oryza sativa
gataatgcgatggcatatgacaatgctgtttctgctcttgggaaaatatgtcagtttcatcgtgatggcattgatgcatctcaggtgtcttacaagccatatgaattaatatacttactctgaagtgtattcttactcatttgaaatcatggtgttgctacctgtcctgctgattaattaaactcttgtctacagagacaaagaataccaagtttcttcagttgcccttgataaattttgacatcaacgtcaataacataaagcatgtaacagcctaaagagcctcagccgcatacagtatgctacatgcaaaaacattgaatgaacgggttgaaagccttaagtgactgctcagtactattgaattaattttctactaaaacatacagttaaatgacatgagaactcttctttactagagtagtgtccattttggacttacattaggtctgccaagtcgtcgtagatttattatactatgtgtagtatttccttaaccatgcaatgcttctaagttctaaccgtgtatcattttttaaatattaacaggttgttcctgcttggttaagttgtttgccaataaaaaatgacttaatcgaggccaagatagttcatgaacaactctgtacgatgcttgagaagtaagtaatgatctcagtatttttgtacagttacgcagcttggcttatatatggtgtagaaacatcaatcttgttcattgcttccttattataatgtttatttttcatttcattgaagatctcatttcaatttttgcaggtcagatagggagcttttgggtcataacaaccagtatcttccaaagattgtctctatttttgcggaggtacctatttatttttttccttaatttttccttttttgttctgattaactatatagaaagaactgcaacacaactagttgcagagcagtattggaatgtttatgttgaaatggggttgagttgattgtgtttggctggtcagttggaattcatcaccaactgaggccattaggttaactaccttttgatcctgaactgggttgctacaagcttaacatagctttataggggctaaataattttcagtagaggagtacatagcaccagggtactgccaatttagatctcaaacgaatatgaataaacaagacattttatggcttatctggtctataatgtagccccccccccccccccacacacacacacacacaaaaaaaaaaggaacatatttcaccactgatttttcacaatgcaatgtctttatctttaatttagataatttaaaaagatagcatttgcttgtctcatgtactgctgtgtagtatcgttggtagaagcccctgaaataagatatttgggagacattccaaaatggtgatttgttttctctgagttttgagaaagaaagtagttatactttaatgagagtatgagacttaggcgattaaccaccatggcttttagaacattgtttggtttgtaacaccacatctatttccttatggatgcagatattatgtgcgggtaaggatctggcaacagaacaaacttttagtaagatggttaatttgctaagacagcttcagactacattgcctccttcagtactggcgtcaacatggtcttctttgcagccgcagcaacagcttgccctacagtctgtgttgtcatcatagctgaacagtaacctcagcaatgttgagcatgtggccttcacatattgccttcttttttgggttttcatgtggttttgtgcttgggttcctggagtttgtgcagcatacaaatgccctgagcttttgtatgaagggcatggtttgcatcagaagtgtatactgtcacagaacatcatggatgtgtatggggctgagcaatctctgcttcacagcaagtgaagttgtaaagcaatatgttcattttactaggaattagttgggttgaagaaaatgtaaattaacaattttgatcgttgatgttttgatatcatattatttcaaacctctctgcgcaccttatgtccttacctattgaatttaggttgcttgtctgagacttgtgtagaatgaccatcttgctgatttgagtttgctttactgacttttgagaacatgtatggcatttgcatacttctactgtcaagtgctcaagcggcatctgtccttgatcaccctggtgctaatcttggagcgggaggtatgtcctgataccgcacaagctgtagactgtcgctgtacttgtggtttgatgctgattgcatctattcctgcaggttgaagtcgaacagatttgacagctccatggcgattgtcgtcaggggaaggttgaggttagattctgtgggccactgggaaaacctcaaaaaggaaccagtatttactttctgaaaataatatctgctgtgtcccagttgagcttggggtgcttgatttctagggttgcattgttagaactttctgactattaattgctaagacgaaatgaaagcatcagttttctgagaaatcgcgattccccttctgcacgtagggcctgtttg

SEQ ID NO: 59112 - DNA, 14840 bp, Oryza sativa
gaagatctgcacgccctgttgacgtgccgcctaatttagcctgtaatatggttcatctgcaaaatatatattaaatttgcctatctctcattttatattatttgtcattgtagcaaaatttcacatcaaactaggagatgtgcaaattacactgctatgcttattaactacattatagttttcaaaagcaatattaactttgattaacagttatacatggcattgataaaatgtgaagatagaataccgcgatctaaaataataatttcaaatgtgagaatgaccagtaatattttgaaacatacagagtaatatattaatggaatttaattttatgtttccttagaattatgagaaaaaccaaattaagattgtaattaatgatgaccaatagtttggcaaatagttagatatttccatattggaaagtacgaattaccccccgaactattgcggtagtacgatttacccccaaactataataccagacatttaacaccccaaactctcaaaactggataaattataaccctaaatcgattcgaactggttttcagcctacgtggcacactcgtagcaatacagtcagcaaaaacaacggtagggcccacctttcagcgcttgttgtttctctccttctctgcccctctctctcttggtgaacagaaggcggctgcgagcggcgggtaaggagccgaggccggcggtgggcgggggtggaggcggctgtgggcggcgggtgaggagccgaggacgcggcgtactagacgtcagggtagcgctcggtcagctctgatggcagcggcggcggagagggcgagggcggcgggacgtggagcgagacggtggcaggatcctccttcccaccgtccaggcgctcaagcttcaagcttcagttgctagcagggttgcatttaccgcggtaaaccgcgcggttaccgcggttaccgcgcttaccgcgggggtacggtaaggggtaaaccgcggtaaccgcgtcaaattcaaataaatttaaaaaataatttgaatttttgataaattttgtacggtttgtcgcggtttgtcacggttaccgcggttactgtgcggtaaccgtgcttaccgccggggcgcggtaaccgcggccccggcggtaaatgaaaccctggttgctagctagcctgttacattgctcctcgttgcaaattgcaaacaggcgatggctgatctgatgcgtatgatggcaacgggatcatatcactgtagatgatccgaaaaccaatagtttctctttgtggattttgttggcaactttttgtgacaagtcgacaagcacgatcgcaacacctaaacgccttgcggtgatatggagtcgccaaccacctcgatctagccaaagggccaaatcaagatgggttttgtagaaaagcaactaaaccggctagcagagccgatttagagatcaaaatcagcctctaggccgatttagatcgatatgaggataactacccgtctcgtgggcaaaatggaaggttttcaggacaaacctaaaaagaggtgtcgcactctcgcagcggcggcggacggtttacggcgcaaaccgacaaagatagactaaactagagtaaaatagaaaaacatagtaaaagaacgattcaagtagattgtatttggggggttttacaatgaaccggccttgtcgcttaaataggggttggtcttgccctctacaggcccttctccatgtccaactcgggatagaaaccaaaggaaacacgaaacatgccttcccgagcaaggaaacccgagacccgacgaaaacagactcggactcggaccctgccggtctgaccgcccacatacctgcggtcagaccggccctactagccggtcagaccgcccacacacctgtggtctgaccggccctgtgaaggaaacccgtcactttccaaactttggcaattttcccctatttcgtctataggtgtcaaatttgggtgtaaacagatttcagattcactagcatcaacttttgccctaatttcctcgctccttttgacttgaactgtcttcttaatttatcggagacgttcggttctcagctggatgagagtgaaactgatcaaattacatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagtaaagtggaggaggggattagctaacagttgcttgcacaagcaggtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatgatagaaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtttttaagtaaagttagggattagagactagatctgttcccttttgtgattaggaatttagattgtttatttacttttttagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatatttaaataaatcaacggcgtcaaatatttacctcgccaactgccccgaggcttcctccattgtcacggttcaaatcaatagcagccacaaccttccaatttagcgaatgacgagtgaaacgacggccaacaggcaatgtaacagacagagcggccaccggtcgactccaccacaccagcacacgctctcgtgaaaccctaggctcctctcccgcaggccgcagccatgtcacagcactctgttgtctccatgctcatggccacgagtggccttccctgagaccatgccttcacacgacggtggaagagatgacctggccactacttaggggaggatgtgaggcgcatcatggtccggtgttattgctcggtgcgtggggatagcgcggcgcacatccgctcggctggatggggaatcggtgatttcactgtcgcattgttatcacaaagatatctacatccgtttctagccgttggatgaatagatcgaatggctgataaaagagataggaagttttgtgtaggttctcctaggtgcatctagcaaagagaataactcctcctttttatatatattagtaaagatgagtatgtaggtttattagactaacatcataccacttaatatcactgctagacaaatgatctttagtcccgagttgcaaaccgacaccacaaatctaggatatctttagtctccgttggtgttactaaccgagactaaatattatttttttttccttttttcattgttttttttgctgcttgcatattgatcacagatccagaaatcatcacaaaaacagatccacaaaaatcatcgctaatccacaaatcatcagtgatccagatccccaaaaatcatcacaaattatactaccatcacaaatcaaaacagatccgcggacttcgagcactacgactcccacctcagcctcctcctccaccacaacaactgctgccacacccaattccacccgtcaccacacctcggcagctggatcgtcgccgtcggcgctcctctcccgcgaggcagaggcggatcccagcgacgactgtccgcgcgcctaggtcgtcacgcaccgcgacggcgagtgccgccgcctaccccttgtgccaccaccaccccgctcttgccgccgccgctgcagcctcccccctcgtgccaccgtcaccgccttcccccttgtgctgccgccgccgcctccccctccgccggatccagtggaggggagggctctgccaacgcctatcggtcccggctacgatcggagaggaggtgtaggagatcggagagaggaggaaaaggagagatagaaagagagaaagagaaagggttagtggatgagggggagaaagaaataaggacgacgacgcgcgctgctctctccctccccatgtggctcgactgtttttttaatttttcgtcctggttggtttagacaaccgggactaaagatagtgggaggcttgacaatttttgaaccgggacataaaaaatgatctctagtcctgtttgatgttaccaactggaactaaatatcaaaaaattctgttgggcttttgaaccgggactaaacatattctttagtctcggttcctattcgaatcggggctaatgtgatttttgtcatccggacaaatatcaattctccggtagtgtatattgatgtattaaaatggaaggggttggatattggctaccagaaattatttttctagctaggagaaaaagagctgcgatatctaatccattttttcgaccactaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctagagttggttcgatttggagaaggggattgaaaaaaaaaagagtaaattgcatcgccgtacatgaacttgttaggtggtagcaatctagtgtacgaacttataaaacgcttgttctagtgcatgaacttgtcaggtgcgtgtggaggaaggcgaaaagaacactacatggataatcttattgattttgtgattgtagaaaaagattaaaaaaaagagcaatgatataagggtgggaaagatatgaaatatcatcacttccttgatgaaggataaagtagtgatcaaatttataaataattgcagtcttatgcaaacgcactatacatatgcacgtcacaccctaatcaatatcagcttcgtaagattaatattgccaagctattttggctctcgtttgcacgaaactatacaagttcgtgtaccgaaacgagcattttacaagtgatgaggcatcactagattgtctgtacgcatggtttggtataacacacatgcacgtatgcatgtgcctggcagtaggggtgaaaacagtatggaaatttcctagaattctggctaccgtgtccggtttgcaccgaccatttcagtcggtattggtaattgtcggtattggaaatataaacggtaatctcttccggaaatggtagcggaaatgagatgggttttttccgaccgttttgttggtaaccttttttgatcggtaatttccgtcaaatttccgacaaaattccgaagaaggaagcttgggcggctgagcctggctaccaggagcagcccattaggccggaagaaaaaccctagggaatgggcgtcaaccagcgtgtcgcttctcatcctctccctgtctcgtgactctcgtatagctctccgccgcctctacctccgccgaccgccgaccgcccatcgtcgcaaccacttgtcctcgccgccacgccgccgcttgctagtcctagccgtcgcatcctcgcgcctcactgtgtcccttgccggagaagcatgatggcacctgccgaacaaaaatgccgcacccatctgctgtcgtctatcatatccatggcatgtggccgttattaaactatagtctcgtcaacttatcgatattgaagtatcgttgaactttgtttatattgtttgttgaccttattgtcaactcattaatcatcatataacagtgttatgtggcagcgtgatgatgcaagggtgaaattataaggtcatcttcatgcatagttaaatgtgggatgatgtcacagttcgctgtttacgacatgacttttcgacttccgactgatatcggtagattcccgttccggcggttctgtttccaatttacaatattgtgcaatgtcaatctggaatggatatcaaactgtcccaatttcaagaattacatagtagttttagacggtgcataatcacatcacacatatttttagagaaggtaaatctggacagtacatattatcaaaaaaattcgaacgattgttacaacaatctctaactcattcgcagtagtcggcaatgaaaataaacgacaaaccaaggttacaaatcagagcacggagacaagcaatttcttaccccacgactaactcatgccagttacaatctatcgattccaccttgttcctatctcatatcggggacgacggcatccggaggctgccctcggcgtcagcgagaaggggtgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacagtagcccctgagaccttcgcagtcgaaaagataatcttctctcgaaccatattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctaaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggttggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactaatcatagccaccaagcactgggagtcggcctaagcacttcccaaacatgcatatgagtgtcatgagttcgtcattaatggaacaaagtttcacggatcggagtttactactcgggtacttttgcaattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtagacggaggcaccaatcggcggcgacggaggcaggccggcggtgaagttgtagacgcccaacacggcggcataataggccagccgtgtaggcggaggcaccactcggcggcgacggaggcaggccggcggtgaagtcgtagacgcccaacagcggcggcataataataggccagctgtgtaggcggaggcaccactcggcggcgacggaggcaggccggtggtgaagtcgtagacgcctaacagcggcggcataataggccagccgtgtaggcggaggcaccactcggcggcgacggaggcaggccggcggtgaagtcgtagacgcccaacagcggcggcataataggccagccgtgtaggcagagacaccagtcggcggcggcggaggcaagccggtcggtgaagacgtagacgcccaacaacggcggcttgatatgccagctgtatgttgatctgctgaatcaactcatgcatgcatgaaatttctccgagcaagctataggcggctgctcccatgtgcccgtggtggcgtggtggccgcaacgcatccgtcggcgctgctcccgactgaagatttgagccatcgagattaatctcgccgtttcttctgtagtcgattccatcacacttttcgatgggtaattcgacgcagcccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacaaggggactgcagcagcggcggcggggggtggaacggcgatggcagcaccgccgtgagctatagctgggtgagggcgagagggggatcgcgacaggtggaatggcgatgctgacaagatcgatctagggcaccgccgtgagcaagagccggcgcatctcgatcccctttgtctcactgatctaaagaatgacccaggggcacattggtcacaacactcgcgattcggtgtgttaatccggtgaaattggaaaaacggcgaagcagcgtgttgtgcgagcgtggcgatagcattttagcgaaacaacttggcggaatggcattacagcgaaacccatccttacatgtggctaaatgtcaattttctcggacaatgcaccatgaaaaaagaaaagaaaagccattggttcattcactcgctgtttgttgatgctttttctcttggccaacaaaaatcacctaacgatttgcggtgtaatcgacggtgttgtcaatatcgatagatcaaaa

SEQ ID NO: 59113 - DNA, 15534 bp, Oryza sativa
cccatgtaagctgtagtagttctcctgttaattgatataggccataattgtcctggcccaagtattaaggaggtgataaaattccccgcaaaaaaaaaaaggaggtgataaaattgagaatgcttactaggaatttagttctgttatgtaccatctcatgattgtttttggaggatgagggaatacttagtagtttgtatgggttttaacgaaagctgcatactgaggaaagataataagcaggggcatggttgggaagctcattccatcgacatgcaggcattataaaatcagaaaatatctcaaatatataccttaaattttcaattgaggactgattatcatatcagattatcagctatgatcataagcattgcaagctagaaattgtagtatggtaagacggtaatgtattactgttctggcctactagttctgtgaacaatttccattcagtaggattctgtagagtttaactgggtatttccttccactaagcacataccttagataaagaattggattcttgaattaaaaatatcagcctgttccattgctctattgtggtatacttgtttttgctaatgtcccatttatttcgactttatgattccataactgttgttgtcatgttatttattatagattctaatattacgctaaaaatggttatcctttcagggataaggcctactttgtggatctcttcgtaagagcatctaacatgccagcaataaggatgtatgaaaaggtaagcttcatacaaatttcatgatcatctagcactctaactcactgatttatatgattacacatttatatatgaatactgaataacaaacgcttgatctttcaaactagtttcttctactgcccctaaacagaattgttttagtgaaaaaaaaaatcatgtatgaaggtttcagcatagagtttattcttgaaaatttgaatccaaaatgacattatttctagtgagcttatcaaattatgttcctggtttccatagcttggctatgtggtttatcgaagggtgctccgctattactcaggggaagaagatggccttggtaagcacttccacagtgccaaatcatcactttgtgtcatattcaaattcattgttctaatggcgttgctcacttctgtccttgtttttgcttagatatgaggaaagctttgtcacaagacgttgaaaagaagtccatcataccactgaagagaccaataacaccggatgaacttgaatatgattgaagttaacttctagttacttccagtgttttgtttgctgttaacttctatggtgatttgccaagtgtcttttgtctccagtagtatcatctagtgatcgtgctgttttcttttctgcatcctgataagattcaacataactctgaaggtgattctatcgttttggaatggaatgcagcacttagtaagtagtctatcttggaatgaggtgctatcttgtaaccataccgttattttcttgtatcgaggagttccacgtctgtatcattagcctccacacgattagaaaccagatgagaccttagtatagataaaatgtgaatgggccaagtctgatattctgcagatgtggagttttgaccttggtagcgggcgtaacgcgagatcacaacttcacatacgttagcactgcagagaggagtaagaaaattcatcaaacatttaatataaaattgccaaatttcttaagatttcttctcaaagttacatcaacccttggaatactgataaacatacgtgaagaacttgcactcgtgtttgtttgagctatgaacgtcgataggaaaaatcatcgatgtatgtaagtcgtcctctaattggccttaaatatgactgtagccggtagctcccatatccggctctcattttatcgtgctcaaaattccactaatatattgacaatagctagaaaaagaatatccattggacagcagcggggaccgtatttaatcttgttagggcaaaaaaagattttggaattcctacaccctccaggcctttatacagtccaatcaaccagtgtctttcttattagggaataacaaaattggtattgccctaaacaacgaatttgataggatacgtgcttcctgaagtccccctatttgtatatgagagcatcacgccctggtcctacgccgatgtaatggactgggataccaaccagctcttctatcctctccacgtacaaacgagcagtctctgggagatcgctgtagtttcgtacagaggaaatgtcgtcctcccacccaggtagaacctcatatttgacctataccaacagagagaacataagaattttcatcaattaccaagagtcacattgagtgatttagtgctctcatatgctgcctgtaaaattatggcatggaatatgagtaaatggaacaggatcaactgctcttcctcaccttaattttctccagaagatcaaggtctgcagggaatgattcaatttctttaccatcttcagtacaatatgcaattcccagctttacttccttgaggccagttaacacgtcgagtttggtcagatttaaagatgagaaaccgtttatttggcagcagtacttgagtgcaactatatcaagccagccacagcgcctcggtcgacctgtcgttgtcccaaactccattccagaagcgcggagcaaatcaccagtcttacccaacagctctgttgggaatgggccagaacctaccctggttgtgtaagcttttacctgcacatggaaatattaagttttgtagggagaggaaaagtatggattgttaagaagtttaaagatagctgtaccgaccactccaatgagatcaccgatacttctaggagcaataccaaggccagtgcaaataccaccagctgagggactcgaggaagtaacaaatgggtaagtaccaaagtcaatgtctaacatggtggcttgaccaccttcaaccaatattttcttattctgcaagattgattgattcatgaagtgcacggtatcagtaatataaggtcctagacgctcggcaaacttttcgtacttctcaacctcctctttaagggtcttggtactgtattcaaatccttcaaagcgcagagctgcatctctcagcaaggtattgagtttagcaccaaatgtatccatatgccgcagatcactgactctaagtccattccttataactttgtttgaatagcatggcccaattcccctctttgttgttcctataagggaatttccaagctctacctctctgagcccgtcaacagtttgatgaaagtcaaacaaaagatgggcacgatctgatactaaaattcttccttcacaggaaattccatttgattctaacccatcaatttctttgaagaacccaggaagatgaactactgctccattaccaactacacacattgtcttctcattgaggatacctgatggaacaagatgtaatgaaaacttctttccctctgaattatatatagtatgcccagcattagctccaccctaataacataaaacattctacaagttaaaacaatatatatatatatatatatatatatatatgatcaaatcctattggacaaaactaagtctagtcttattgccaccttaagaaaactgaacttcataaaggtgtgcaaaaacctataaaaattagtcaatacaacaagtgcagagagaacagtaggagaaatgagcactatgtaatcaaggttttccatgaagcaggataatcattttttttaacccataagaactgcttgtgtaaagtgaaaaggcaatatccttgccataaaggaaatgcaccattagttatcaatactgcattactgcctcgactagataaccggaagggttatcggtattttaagatgttttataattctattttgttagtacgaaggattcgacattaaaaaaatgaacatatagaaggaatatccattgtggttatgggtttagaaaaattgggaatagacaaaatgctttctgcagatatattaaactgatgcttagaatagttcagctatccttattcgttaatgatgatacagccataaaaattatcatcataaaaattaaagatatattcaagaatgagaaaacagcaaggctctcgagtctcatcaagaatacgttgagatcggaagggcttcacacaattcaagaaaactggggaccaatggtacaagtacaacccatgctgatatcagtacttatcatcaaaaccaagcaagaaccaaaatggaagggagccttggactactaagcttccttcgtaacacggaatttctcctgttctgctagagttgaatttcccatgtataaaacgactttctgtgatagtgttgcgatcaaaggagtacaaagtagcagtagcttacagtagtacggtaaaggcagtctgcgtggatggcgccggaagataaacacccttcaagtaacgatcataaagcaaactaacgcaaattactactcccctctgtcagaaaaaaaccaacctagtacggaacgtgagacatcctactatgttggtttttttggacagagggagtacatctcagctaaaggatcgcctctggaaactcaccagcgccaacgtgagaactcgtactatcctaccacaaggaaccaattaatcgaacaccttccggacaaactgacaaagcaaagaggagcagagagcgggtgtgtttggttgcaagccacactttgccacagtttgccacgcctaaggttaggcagatttgacaggtgtttggttgtagcaacagttgtggcaagattcccctctaacaaattgggtcccacgtgtcaatggctcaaaaaagtgtggcaagattcagattcccttagacttagtaagttgtggctaacaatttgatcacctcaccttagacaaggtgtgacaacttttattagcaagtaatggtaaagtgtggctgggaaccaaacagccccacccagcaaaagaagcgcgcgcgacggcgcgagacggaccgacctggcagcgtgcgacgatgtcgaagcgctgcgcgaggatgtcgacgagctttcccttcccctcgtcgccccactgcgtgcccagcaccccggccacctggctcagcgactccagccgcccctgcgcggccgccgactccggggccgtggccacggatgccgccaccctcagcgcccggcgcgagcgcggcgccaccgcgcatggcgccggtggcctcgcggcggcggcggggaggaaggagagggaggcggcggcggcggcggcggggtccaggcacggaggggagaatggcatggcggcgacggtggagggaaatcgaggagagaatggcggctggtggtgggccctccccgcctgctgctgggtttggaggcgacggtcgtggatgtgcccgttcgttatcttctctgttcgattctcccgtcgcgagatcggacggctcggatgtttcagaaatgattttcttcaattgtgtgttccaaatcttcaaaaattcgttttggtcgagttttgggggaaagtaagttgttgaatttcaggagatttggtgaaattcgtcatatcgcccgggctcgcatttcaaacaatgactttcagaacgcgtggtttgcttatttgcgttgtactttgggagcaacagtttgaacacagatttaaatttctcgtttaaatgtgaatcgcgctgcttgtaaattttcttaattttgatttgctttcattctagccgttaaatttctggagctaagatcgccatctactcatcatgttgcattttgcagcatcaccaaccggccaacagatatcaggccctaaactcctgattaagaattatgtagctagatgagcacttgagcagcaaccgcgtcaaaatttggaagagtaatagctactaatcatcagggaacacactttggacactaggtaaatagctcaaaattttctactgaggtatctgggcatattcttaaagcccatgtaaaacacctaaacatcaaaatggagctgcttatcatgcataagaatacgtaggtgtgcagatcatggcagcaactccacagaagcagcgaccgatgaacaatttgtcaaaacagatacagcatggagcaaatgaagttcgagcctcagcgacctttggccgaagcactggaatcagcattctttttccttttcttcagcaagttcaccttgtcctttttcctttcctggttaatctgtagttgcaaagggtaacagattagtttagctcaaagccacttaaatttacgctgaaacagggaaatgcttgtggcatctacaaggcatatgttataaaatttggcaatgtggctaaaatttcaatggatgacatggctgcaacaatgaacggatgtgaaacagcaagcaagcagaaagtgacaaatacatgcaaggcataagagcgcagacctcaattgcttgaagaaggcctctctgcttgcgagacataagggtcttggaaatgtcagcagcatccttctcggcttgtttatgagagtcctccatatgatcgtcagcttctttagtatcacttttgtccacaacatctggttggttatctgccgtcctatttgagaaggtctttccttcgtattccatcctcagctcatcgtggtactgcttctctagcatctccaactttagaagagaaaaaggcaaaatgagacaacagagaatgctttctgtacaagaagcaaataagatgacagcagaaaggactaatgttttgtactacatggtgttgaatttaccttcctcttcttgtcagcaatttcattagactctgatcgatcaataattgcctctaccagtgaattttccatatcttcgtcccctaaacttggcagaggcaacacctggctttgagcagcagcttgcagcctcttaatggtctctgcatactcaggaatgtaaccctctgcatcattgtccacaaagggagataaatgtggtggaggcaccctgagaccaaaaaaaaaaggaatattgatggcaaaaattaggacaaacataagtataaaaaattagatcaacttttatgcatctttatagttcatttttgcaaactgtgcaagtacagacagtaaaaaaaggctgtcaatttaactaaatgttaaattatacatgaactatatttcagtaaagttgtttccacctaagaaccatcaatatgtgcaaccaaaatgtgaaaacagcatgcgacaaattaaggtattgcagtacagtgatttttaattaagttggaagtgggacaaacattgggctctcaactacaggagtgcaaatattatataatcagcacttaacaactattaaagggatatctccatatgatgttaacagcaagcaattgtcattagtgaaggctgcccccaactaaggttggaaataaacacaaatatccacccacaaattttagcaaacatatgtagaagcaacacacaaggccacacaaataatcaataaaaattacatatataatacatgtgccatgaggtatacctcccgacaatataaccttctgtcggcaatatgatgcgagcattcacgcaatcatatatccactgtggttgaacatactccctagagaggaaaacgtggctttgggtcggtctatcaacaatctgcaaaataatgagtgatatcagtaatctgcaaaataccgtaactacaagataaaactacattagagataaattggaaacaaatggctgagctaattgttatatatgattatttgatatttaaacagtattttatatttaacaaaagggtaacaataattttatccatcaatttgggcaacctctggtgtaatcttacagaaagataaatatacctgatgagtgatgtcttcatctgtctcatcaaaaggagctccttctccttcccatgaaacggtaccaccaaatgctggaatgataaataagagagattccctaggcacctgaaagtggaaaacaagacagataataagataagtatattgaagatgatctaattgaacaaacatacccccagggatatccccagggtacataagtttccactggcctacctcacgacttaggtagaacttcaggtttttgaataaactcctgcattctttggcatcagcgtcgtctgcatcagcagcagtagattcttgtacaagatgcatcagcgctccaggttcattagttgggagctggtgttgaagttgtgccaatctgagttcagactcatctgtttttgagctctctttattgtcttcaccctctttgtcttcaattagtccagcaggttctgaatttccaggtactcttccagaagacatgtaccggcacaacgcatagagctctaataggagaaaaacagtgttgtcaaccaaaaagatcccgaaaaagaagaaattaaaaaataaagggaaattattagctatttgagaaggataaaacgtaggttcaccaacaaaactacaataagcaccaacacttaccagaagctaaagcttccaaacgaggatccagaacaggaggataatttacatttatcgaatggtaaagcttgaagtttataaatcccagaagtgtctgcaggtagtatagaacagtcaaaaaattgaaagaaccattgtaccaaacactgttgagatcggcattttttttatatatactaagtgatcaatcttgaaaagttattgctaggtatcgtaacattatatctgaacattttcagcatgatcataggtctgtcaggtgtacatggttatagccagactgcaacataatttatttacaatagtcatatcttccatgcaacagaatattaaatattaaacagagattccaaaacaaaacaagcatatatggcttcagacctacaattgaaacaatagcagcaatcatagaagattgtagcctgcaaattcttgcaagacagaacacacaagagccaagattgttgcactcaaagaaatgtgcttgcatttacccccatgatatttccttttattttaccgcgtgcaatcgcattttattgtggatcaaattttcgtaacagttccagtactatttggatagaagtggtgctatattgctgaataaagcaggaaatacatagtaattaggaaattaggacagatcatcgtcattgtcacctcatagaattccaaaaaggtaagcatcacattgaagtcaacgtcatcagttaaaacttgctgaagagcatgtggagttagccaggtgatcttttgaccttgaacttcagcctgcaaaaagtagttatattatataaatatatatactatagcatgcacagttacagtgattttaaaggcaaggactgcaagtagacataactacacaagcttacttgataatatatgcccttgacggatataaatgtctttcgcagggaatgagttcgagatatatatgcttgccattcatggctcaacctacaaagtacaaacatgtcccccaaattaataaaaggtattagcaacgccaaacaaagtcaggtacagcaattcattatagcagcaataaagatggggcaaatgtcatagacttgtagcatgatgaacaaatgaactaggaaactacaagagccccttggctgggagtgttgtgtgtgaatttgagggaggggattcatttacaacagagcatacctgcggcaattatgaatccgctgaacttgcacacgttcaccttcaacagcaggcaacgcagcaaaaagatgcaccattgttaggcaatcatccaagtcacgaagagcatcaacaaaagttggatatctgtaaagcaaaaatatggggatgatttatagaaacaaatacggtatggatgtcatcagcaaatcactttaaacctggtacctttcaagaataagcctgtcaagtttgtaagttggtggtcggttcaataatctgtctgcaagatctttatttttcttagcaaacgcctttttgaccttcttcctgtggaccttgatttctctgaagtcaaacaacaatgaaatgtcattaagagtggagacatcacaaaccaagaatagcatggtcttataactcacactttttaatgcaaagacaacatgcaccacactgtatcaactaaagttctaatgaaactctagattatatataaagcatgaattatgattcccttgtcaacgatcaagtaattgtgagcaactagtctatctgccattctgccaaccatcaaaatatcattgatgaagcaccgaggagaataattcacatggcctagctaatggctctctgaaaacctacattataattatttcctcaattgtattcagtaataaaatacaagtttctatcttgcttgccattttctccgctgcataaactgtgacagaaacaaattgcacaattgcagcaaacaaatcaaataacaagaacacaacacaaaccgatcactagcacaattaagatattttcatattgcctatctcagtggcctaataacaaataagaaaattgaaagcattgttatctcattaaaaattaaatatgtctgcagctaaattttgtgatagtgatacattatatgcccttaattgcacagagaaatgtgcaatcaaccaaaaaggcatgcaattcaaatgctcagtgagtgaatactgaatacttctgtagccgccaaaaaaaaacacagatggtagaccttttgcaagaaaacttaagtacctaaacttctcaatcaagggatcatgggccaggaaggcaatatccttcatgtggtagtaggtcttgtggttcccttccaccttcttctttggatcccggggaaagacgcccttgagaatgcatagcttcctgcaacggattgcaaaattttaagcagtcagaaaaaaaaaatcctacatcgcttgcagtataaaagctatacgtaacgcagagaatagtgaaggtaatcctaatggccaataggcgtatcgaacaaattaattagcttaatggagtgtacagcttaaagcttcagcgtaaaatgtgtaaaatttcccagacagctttgttagctccaacaaaaccaataaaaatagccacaactacactcgttaatagctccaaaatgacccaacatatcattagtcagtactcagtagtagcagctgggagattagaggatgacctgaaggttgcgaggctaatctgcaggtacttcaccgccttggtcctggtgatgtacttcgccgcgttcccctccttcttcttgccctagagcatccacgaaagcagcggtgagaggctccgcgtacaacaaggagaggggtattcggggggaggaggcgggaggaagacggggtgaattaccgcaggccggtagtgcttcggcatggcggcggcggcggcggcggcgtggctcctcggggaaggggagcgggggaaaggagaggccgaagaggggaggtgggtttttagggttttggtttatattgcggcggatggctttggggccttgggttgggctgaaaggctggaacccggcgcggcgctcactgagaagaggtgaagactggagacttgggaggtgggagccggcctgtcagcgtctgcttaacgcttagtacatattcttctcgtaaaaggggattgttcagtcgattttagagagagatgtactccctccgtctctataaaaaaacagacacgctaaaaaagttacgacagttttcccttaaaaatatatcggtttgtggtgcattgaattgacgttaagattagtgctaaaataatagtatgctaaggccgggagtccagcatagcaaacatcttttcttgaaaaaaaaagagacacttctcatatatttatacaaatttacatagtagttacatcccacttacacaccacttacatatataattttagaatttacatatgtaattttaggacttacatatgtaattttgagacttacattgtaaatacactaaaatttcatatgcaattttagggacttataatgtaaacacataccgactattttttcatgaaaaatatggcgccataaatatagctactctcaaaaaaaaaaacctataactatatgtaacatcctacctccgtcccaaaatgtaagcatatagaatctggacacatatgtgtccagattgctatattttggggcggatggagtattctagtatgaatatatgcatacctttgtctatattcattgtactggaatatggcagatctaattctaagtttatttttgtgggacaaagatagtaagagtttgtatcactattttgcaggtaacgtggagtagattttcggtcattcagaagtacattttctctaagcttgtagatttcggtcatctaactcttttataccatgaaggtgacgtgatataccaacaagatcagtgtactttaataccatatcgccgttttcttgaatttgcccttgaagtaatccttacatgagctttttaaaaccatatatgcatatttttgtctatctcgaaccgctagtaacaactagaaaccaaattacgataatatagtcactgctttaaccagttgctacttgtttgttgcaacgaatgaaccagtcacattatgcgggcaactctgtaacgagcaactaacaaccccataagaaacaaacacaaacacctccttgttcgagtaatagactgctttgttatctccgaaattacgtgagaaaaagaacctcggatttattctatgttatagtttttttactcggagttatcaagctccgaccagtaatatattatatacgatctagtatcaataattaacaataaaaaaccataaactgggcatattcggctgcaaggtacagcgttgccttgcagccaaaccgcggcatattctttgtttgttgtatggtgtaacagatggctagttatatagtagcactgtacttggcagccgaacaagtgttggtcgaccaacttctgttggtcaaaaccaacaagtgtttatagaccgaggagtcaccacagcaaagaatggcttacgtcaaaatacgtactctatccgggtgtttttaatacatgacgtcattgacttttagttttatatttgatcatctgtcgtattcaatatatttcaaataggataaaatacaaagtcatgaatataatacacaatacatctaataacaaaataatcacaaaaaaaaaacgataacacagtttttttagaaacatggtatgaacgcagcactcacgacattcacccactcactcgtatgagcaccttctaaacgttggacgacatatattgagattaaccaagtcaccacaaacgtttttaccatcgatgataaaaaaaagcaatatatatttcaataatacgaatctcatatgtacaccaaaaaaaatggtgtcataaaaaaactgaagaaggtacatctttttacatgctatctactcaagaaggtacatctttttgacatgctatttactccctctgttttcaggtcataagtcaaactgtttcaaatttaactaaatttatagacaaaatagtaatatttactataggtgtgtttagttcacgctaaaattggaagtttggttgaaattagaacgatgtgatggaaaagttggaagtttgtgtatgtagaaaagttttgatatgatggaaaagttggaagtttaaagaaaaagtttgaaactaaacccagcctatactaaattagtttcatcaaatcaataattaaatatattttcataataaatttgtcttgtgttgaaaattttactattactttttttctacaaacttaattaactttaaagtagtttaactttttctaaagttaaaatgtcttataacctgaaacggagggagtagtacatttgtattcaaggtaatacaatacgaaggtaatattaaaaggtttgaaaatgataaagaaaagaagggggaaaaaaggtttctcttgggttggacaaggccttatcaaacccggcctgaactatactaccgcacaacacacaaaacgtcgacgactaatgacgtcatcatccgggaccccacctgccagcgagctaactaaaaatccaaggaagcaaaacgaaaccgcgcgccgccaaccttttcgcggcttcactttgtttttcttttgtcttcgtttttttcccgcggcgcgattacgaaaagagctcttcccgccggcgccaccgcccgccgaccaaaactcctccataaacccctctctccccgccattccccacctctctctcccctcccctcccctcccttcgcgcctcctcatccgcctctctctctcctccccctccgatggcgacgcggccgcggtcctccccgtcgttcttcggcggcctccgggcacgcgagctcggcggcggcagggtgccactgccacgcgcctccgcggcgcggctcccctacctcgcggacctctcctcctaccccggcggccgcgggagcggggtcatcgccgtcgagcacgccggcgaccccgccatacctttcgccatctccttctgcaaggtgagcgagcctgggatcttttgtccccccttcgttttcatgcgttttttttcccgattccgacatcgaaagggttaagatttgatgggaactgattgttcgatgaaccctcgcatttttttttcatttcaggcggagcagatctctcaccttctggcggtagctgatgaggacgggtatgttggcatctacgacacccgccggcgcctcccatccagctcatcgtcattggggaaatcaggttcgattggatcccccctctttgatctagttttcgcactgttcgattcagttcgtggatgtctggggccacgcactgggtgtcatgttcgattcgttccggtctgaaaccgtgacattctcgcagctgaaacgaagatgtccgattgggttgcccacaacaatgccatctttgatgtgtgctggatcaaggtaacacctgttactctcaatcattgaaacatgttagagttagtggtataaaagccaatcctcactcacttgtatcatcttctttttggcgttgtttatttaggacggttcccaattactgactgcatcaggcgatcagactgtaagtatcgcaataagatcatttttcagaagtagaatagaattgtttgtttgttctgcattacaattcatattaatgtgatggtggactgccttttgatcattgggattgtttgttctgtatcaggtgaaaatatggtctgtggaaaacaagaaatgccttggtgttctgtcagggcacaccgggagtgtgaagtcgctgtcatgccattcttcaaacccaggttggtgttatgttgggaaacaaaaaatcaattcttcgtatatttgtgcctgtaaaatttgccaggaacttgtattcaagaacttattcactgcagagctcattgttactggatcaagggatggttcttttgctctttgggatctaagaatcgacccaaaaacccctaatggtcaccgtg

SEQ ID NO: 59114 - DNA, 16284 bp, Oryza sativa
ccctttcccgaccactgccggcgtcaccacctctgcgccgcttgaccgaccgcgccagcccgcgctccagcggttcgatttccgccgctcgatccaccgccttcgccactcaacgcatccacgccgtcgccgctttcgcaccgcccacgaaaccgccactaccgccagccgagcacttgaccgccaaggtcagttctcccctccccaaaccgacctcgtctccgctataaaaccaagccaccccaaaccccttcctctctcgttttcactcgcctcagtcctcacacccgccgcgccattgccgccgaaccaccgtcgccgccttgttgctgctcgtcccgctctcgccgttgccgtccgttgccgaagcaccggaggagccggtgcgtgggtgacgaggagctccgggcaccacctctccctcccttcttccccggccgcgccctctcggtgccgtgccgcctcggcgtcgcgaacacctcgccgcgacaccgaccgcgccgccaatgctgcctcctcttcgattggtgagctccccaccataatcctcctcctgccgcgcgatgcgccgcgcccgccgccgctcgccatagctcgccacgcgctcttgctctgtcccggaggccgcctctcgtcgccagccaatctcggtgccgctccgtccaatccgacgccggaaacggattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgccggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcctctatttattttaaggattgctatgattcatatttgtcaccatgggtaccagcactatgtcctgggactggtaccgagatcgcggtttcgtaggaagcggttcgcgccgttttccctacgacacgctcctgtcaggtgccgttgtacggcggtatcagattggggtgtgacaggatcgggactaaactcagggaggagttgaggtccagacagtcaaggataccgggtgacgaagttggatacgagatggcacacagtgaatggatatcgtgtgggagagatcttcgcaacgggcttcacgagatatgcgtgcaagtaccggtgttggcgaaggagattggagtgagaaattgaggaagagtatatggtgatatagtacacgtggtactgtagcatgcatatgtgtggtattgatcgatgcatgcaagtgtactgtagtggttggcagtacatggatgcatgtatgcatatacatgtgtgttggctcggtgagtccaaggcaggagcggcgctaaggcaggagaccgaggccgaccgggacttcgtatgagacggacatgtgtccatgtcgggtttgctatgacacggattgactgtagtcggttgtgaggctgcaggctttaggagactaatttggatagagtcatagtttgacgagtggtactcctatttcgagtaggagaattttcatgtataaatagagaggaagcgtgaggcttcccggtatcggttttaggaagctgagtttgagagattagatagggtttcgtgagaaacttttgaggggtgctgtggctgcaccttgtgaacaatatacttaagcaataaagatcatattcaatcatcaaggcattaacgatctattccggtttcgtaagttttacgtttatatttggttttggtattaacttgtgattgttcattttgctgcgattttgttcaagttaattcatccaaaacttttctaatacttcaaagatcagatctggaaagtttcgttgattggttctatttgatgatattttgtcacgtgcaaggaaaaattgcagtggccaaagcaagcaaataatgtgatccctatatgggatgttcagattgcatgcagagcagtacgagctgtgagcagcaaaccacaagagatcggccgggcagctggttgtatccatgcatgcaagcccgcacatacgcacgcatgggcttcaattacacctgcgtacactcgcatacgtgaccgtattttctagcaatacggccgcgtatatacatggaaaaacaaggagatgcgaagctacggtgtattttacgctatacggttaagttagctcatgcttgcccggatcaacaaattaaatttatgaagagataaaatttatctgaatgaattcaacacaatccttgcaagccacgcgcatacgaaagacggccttccgccggactctcaccggcccagcaacggaagagtggcaaggaatatcggaaaccgccatgacgcgctccggcggatgcgcacacgtacgagagttaaattctatcctgtaggcccatcagaaattaacagaaccaatatttgacgtcaggcggatcgaagagataagattaacaaaccgatcgattgatcaagtatatccgcacttctccaccgacctcaggcccctatataaggcgtcgacgtactctcggcagcctggaggccatggacgccgatcaatccataaacacccatcgacacacatgatcatccatctgtccatctcctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgccgtggatgtctgctggccatcttcgacgatgctgccaccttcctcacactcatcgtcaaggcgctcgaggagaaggccggtcggagtgccgctacccggcactgcgacaccaccaacacccatctgccggagaagaccatcgtgatgccactccgcccgacgcgacgcgccggagatcgtcggagcagccgcggatgctgcctagtcacgctgatccagaagctcttgttgagaacaacacaacaacacggacgccgctgagctgcccgcgtccgtgaacaacatatcgtcatcacgccggtggccgcccacgccgtcctgatagagcagcgggaggccatctcgtccaccttattggcaacgcacagacgctcgccatccccgtcaagctgctggtgacactgtccgccgagtgccaccctgtcaaaggctgtcgttgtaccgacgccaagctctaaggacgccgccattgtgatctctactgtgtgaggacgtctcaccgagactcaggcgacgccttcacgctcgtcgcggtttcttcggtcaccatcaacgtctactcaatcatcttcgacggtgctaccaccttcctcacgctcatcatgaagccactcgaggagatcgccattcggagtgctgctgcccggtgcctgcacgccgtcttgccggagcgtaccacggatcgtcggagcacccgcggatcgacgttgccgagctgtcctgatccaggaggtctggacggagccgtcggggacgcccgccgagctgctcttgcacttaagctcgttacaattatcatgcaactgaggcactgccatgtagtgttcgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaacataatatcacaacacagtagcgtgtaatccattctctttcacatttgtccttagccaggatcagatgcgcttttttaaacctatcaggaagatgattgcgaaaacagtgatgagaatgaattttgacagcaacagctccagttatttatacattccaaatctaaagttacaatagtttcagcaatttttcatccccaaaagtccctgcataaccaattctgaatgtccaagttagttattcaacactactgcagaagtgcagaattgagtcaccctaaagtgaggttgaagcccttaaattcctttattgaaaggggaataaaaaacacgccaaggcaataaatatgaagtaattctcacatagacgtcacaacaatccccatccagccatccttgaattctccatttgcagatagactagaacagctagcgcatgagagtatgtgttcaatggttatggttttgtgggtaaatacaaacatataggcaaagggataaatatgctgttctaaatttgtaaattagagtatcatcaacaaaaaaagcaatgcaatgatctccagggctaacaaacttcatcagacagaggacaagagaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagagggacgtccgatgccgctacactgctcgatcgccatccaacggaggtaaacaagcatcctcttctgtgagcacggcagccgcacccgagcagcaccaccgctgcgcgcctgcgcccacgccgaggatgccacactcgtgccgcctccacacggcctcaccccgggcgccccatgcgccccatgcgcccccgcacggctgtcgccccgtacggcgatgtgccgtgtgtcgccgcacaatagccgtcagccgcgtcccgcacggcgctgcacggccgtagggccgcaccgcccgaacagccgccgcatcggccacccacgtcgtcgcgctcacgccgcaccgcctgcttcgacccgaccgctgccacgccgcgccgccctggccgcgcgccgccatggccgcgcgccgccatggccgcctccgcgccctgaccgtcctggccacagcagagaagagtgagattcagcagtgctccatctgagcgtgagctcaaggaggcagctaggctgccatggcccatggctccgccagaagcgctggccccaacgacaggaggtcggtgcaggcgaaccacacactcaatgcggacggcaccgccgcaggatgctgcgctgcgggcctgcgacaccgttggtgaagaactcggcggcatatgacgagagaagcggccggccgggagcgagccttccattttcgtgggttgattttggtcggcgtgggctgaaaagaagccagtaggtccgctgtgcttgtttacctccgttggatggcgatcgagcggcatagtggcatcggacgtccctctgacgtagattgctctacgtcagaggatcctattccgtaaggctatgtacatcctttaggtgcagaggccggtttaatccattatctaaaaaaaaccaaacaaccactagcagttttcacattgagtacagaggtaaaggaatgcagagccctgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctcctagggtttcttcaccgccggcgagtgctccagctcccagccctgcgcgtcctcctcgccggacgctgccggtgacgtctgggccaagctaggtgcggccaccctcctcctccccccttcctttttcttgggtttcttccgcctcacgggttcttgattcttgaccttttcgttggtcttgggcccttggccattgcttgcacagcaggtctgtagtgccctccgattccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgattgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggggtggagggaactgtgttgcaaccttccgttaatccttttatcaaattctcgctgatgttagatgcctgtcttgtcatccttgtaatgtatgtttcattcgaccgctatcttacgttaacattatccatgtgccattgagaaagcttggatgcaattattgtcgatggaagagttatccagcaagaagcagttgacatcaaaccggggagtgaaattgttccagggccccagaaagatggtgagacaattatgtattttgagtttggcattttgtgcatagattggttgttatgtttatttagtggtcttgtattttttttaaatagactattttattcctttatgaagccaaatgagtgtttacacatgactctgaatatatgtactcattgagtcatttggaatgtttattgtttcctagacctttctgtttagaaagtgaaacttctatggttgcatgtttgtaattgtgcttctgaaaaatttaccaaattacaaatggttttccttttgtgatttcgttatgttggacaggtgaactgtaccactatgtaatgcatttatgctatccattttcttgcagggtatctgttgtacacctttgatataactggcctgaatgactaggacaaaaataatatcaaggtattttgttgaaatgaatgttgatcaacagcaataacctgggtgcataaaagtcactaacttctatttaaatgacgatgtcagattgtgctaggtattgagaatgcaaagtgcagcatatgcttaaatttgtgggatgatgttgttactgttgcttcatgcctccacaacttctggtacttttgccaattttcctagctacttttgatttatctcaaaattctgattggtgcttattcctgtattccttttaagcaatggctgcttctttgagtggttaagaaggtcttcagctaattcgcgtgataaaagttagagtgctgcctgtccacaatgtaggacgacagtgcaattagttggtgggaatcacttcctacataatattgaagaggtgtgatagttgggtgtgatgacttaactcctcaatactgtttaagtgctacatattgtacagctgagatgtttatttatagttctgcttttgtaggctatactgtaagttttttcatcgctacagcggtctgatgaggagattgcattgttggagtcatatgccccggtcaagacaaatattgtgagttcaaaatcttactaagaaattgttgattcccaccattttctcaatggattgtatcaagtgttgtgccagtctcatatttgccagcactgatatttgtccctgttatctgccataaaatcgaatattgttttaaaatcatcatctttttttcaacttgtaaaccttattttttttcctacaaactttgcccatgttactgtattactgtttaatcaacagctaatcaaggccatctacaccatccgatgtaccacgcggcaacgatccgtcccctcttctgcttctaccctcccgtgagctcgtggttgaaagttacatttgtcatgaatttggattatcattctattttgaagatatccttgattgataaatgcactgccatgtttcagataacattttattctcttatttcccccaattttccttccatttggcaattctcgtggtgttggtttgtctgtactgcactttgacacattatatttaatttacaagacttgccaggtgcctaggattgtctttagtattcaacttttgacaagataatagtggatgaaatgaaaatctgtttacaattagtactggcctcttaataaactaattagtaaaacaaaattccccaaatggtgggctcattccgttagtcgggtacttataattgtagaatttcctttcagtgcaggttgatctagaatcatggttctctctctaagtcctattttgcttatcgaatacttgcctcttaataaactaattagtaaaagaaaattccccaaatggtgggctgattccgttagtcgggtacttataatggcagaatttcctttcagtgcagtttgatctagaatcatggttctctctataggtcctattttgcttgtcgatgatattgttaaatgttgccatggaatgttagcatctgatacatgggcttctcatctatagacatgttgtgcttgtcattacctctaaccatatcatgttatttaatttatatcacatgattgaaaatgcattttagcatgaatgactcataacgatttagaattttctaacttacaattagcaaaccatggcagcacaatatggtatttcaaattttcatttagttgcactacttgagaatgagtttagtggtttggttggattgtctaagtgcaaatgttgctgtcatttgtgggaatcaggaaaatataaaatgccatatataatatcctctatattttagttcatagagagtatagtttccattcactcccaaagaaaatatgggtataatccggagcaaataatctggaagcagatatgaatatggatattttttgctggatatgaatacaaatactatgacgttggcgaaagggcttgtagcctagtggttacaagagcatcagtagcatctgaggtcctgggttcgactccccatgggagcgaattttccagaatttaacggcgttgtgctttcagtagtaggcgacgtacccgtcgacagcgaggctcctgtgtagtcttcgaagatgctcacaggggtagggtttgcgtgcgtgtgtttataggggtaattctaaaaaaaaaagaaaagaaaatactatgacgttgtttccagtggatggggatacaaataaagatgcatgcttattgtttttcaaccacatttgcttaagcaatgattggtctattccagtattactattgttggcccctttggaacatataattgatatgccttttgcatgactcttctcaactaaaatgcattagattgcatcatgtctgtggttcacaatatgttacatatgttatctggaaagaatataattaaatttgctacagttctgtgctattgttatgttatttttgcattgttgcatgtggtgtttgggatccaactaaaactaagttggttattttattatgtaatctcaaccgatatacggaatttatatgttgtgtatattcatggttgttaaattgctacattatgttcagtatatatacagttttttttggcttcaattttatgccgtcctttccagctttcccgccgcaccgcgcggggcaccctctagttatatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaact

SEQ ID NO: 59115 - DNA, 13702 bp, Oryza sativa
aaaaaactaaaatgcaacaacaaaatggaaacacatttcaaatgaatgtattacctgtgatgaagtcagcaaaccagcagggcttcgccgctccccttctcctccccctcacccctccctcattctcttttttttttggattttgagtgaatataatgaaaattctcagagggggaagaggttttatactcgggaggggaaaaatcgccctccctaagggcggcaaggggggcgcctgcaaaaaaactaggccggcggctcccgaacagtgtaaaaccgcgctccgtaaggacggcaagggggccgcctgcaaaatggcaggccccctataaccggccgtaaggacttagctaacggccgtgtgccacgccacaaaaatcgccctctccaagggcggcgggcgactagttttgtaaaattttcaaacacaaaattagttttataaatattttaataaaaaaattcaaaataaaaaaaatcaaaattagttctgttccacaccatgcagttatgccaagattacaaacatgcaatgcaacacattgtatcttgaaattaggtacatcagttctgcaggcaaattgtccttttcattcaggccttgtttagttcgcgaaataaaattttttaggtgttacatcgaacgttcgaccggatgtctgaaggggtttttggacacgaatgaaaaaactaatttcataacttgcctgaaaaccgcgagacgaatcttttgagcctaattaatccgtcattagtacatgagggttactgtaacacttatggctaattatggactaattaggctcaaaagattcgtctcgcaatttctcctctaaccatgcaattagtttttcattttatctatatttaatgctccatatatgtgttcaatgattcgatgcgatgttttttggaaaaaaattttgggactaaacagggcctaaggcctaagtactccagctaatgcagttgtttgtaaagagtctaatcagcagagagatcagttcatccccccaacgatccgaccgtccatctcccctcccacggatcgacgggcccaccaccctccccttcccccaaccgtttaaatacgccaccccaccggcctcgtctccatcgcgcactcgcattcgacgacccaagaaaaggaaaaaaaaagaaaaacaatcctccacgccttcgagcgcagcaggaaccagcttagctagactagccatggacgccgccggagccggagcgggtgggaagctgaagaagggagccgccgggaggaaggccggtgggccgaggaagaaggcggtgtcgcgctccgtcaaggccgggctccagttccccgtcggccgtatcggccgctacctcaagaagggccgctacgcgcagcgcatcgggaccggcgcccccgtctacctcgccgccgttctcgagtacctcgccgacgaggtaataacgctcgcccacgcccacgcccccactttgtcgtcaacttcatctgcagtgcaggtttcgatctgtgtgctgatctggtggtgccctctctgttcgattgcttaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggcggccggcaagtcccccaagaaggcctagacgtcggcgcctcgctttgcttgtttagctggagtagattggacgggatgtgtgtctgttagtagtctgctgatgctgttgatctaatctatagtggtgtcgttgaaccttgtgtctgttcaagaagataaatctaagatatgttaaatttttcttcagagatgtttccattcttgctccttatgctttggctgtggagatctgaattttctcaattgtcagatccgatcttataagatcgttcgaatttggttgcttgggttgggcgggtaacttaaaatcacccaaatttgttggtggtgtgttgggcttagtgccgcctcaaaaatttggtgtttggaatgaaaatcaccgaatgcctaagtatgggtatctcagcatctgtgattttgctggatgttgaagtgattggttggaatttgcattttgggaggcaatctggcgctttggtttgaattagtggagggggaatggcgggaaaccgggtacgaaatgaaaatttgtcttgggatttcctatggcattgggcgggctaaatccatggaagtttggagctacttggcccctcaattgtgtcttgagctgtatatttttgggccaacaggcaaataaacttggtcctcaattccgctatggacttattttgggtcaagatccacgtccttatgaatagaccttctctgtatttatgttactacctccatttttgtattgaacacgggtaaaattaaatgtgatgattgtgatttgttgagaatagaaaataggtgaggatactaagaggtggaaggttgtgattggttgaaaaaaagttattatatttaaggataaacgtacacctaagttgttatattttgaaacgaatgaaatactaatatatttgaaagatccatctttgtaatagggtcttgtttgtgtaccctcctttttaagcaaggacatttattttttagaaaacatagtacaacataggcgcttaaaatatgcaaactcactctacgaatacgcacatacacatcctaactctatgaacagtcatcatgagtacatcatctatcgttaaaagaataattagttgtaaatttgagtacatttgttgaatttgaattagttccaccacaatgttacactcattccgtcaagggtatttaattttgatcaactatataacctttgtacctatttccatatctcacagagcacgcttaatttttcatgtagtgaactaatgatggattataatgttatatctgctagtacaatttaattttgaagaaatggttgtctgctcctgtaaaacaataaacttccggtacatcctcaggccaaggcaacccagtagcacaagatttttttaatttttgttggtctttttattttattaaaatattttttaaaaaaatcatagcacaattggaatcgtccccatatttggactggaggaattttatacaaggaattaaactaattactgcaaaattcctacatagaaaggaaccctttacctatcctaggttaatcagcgcattctaattgatttaattgaactaaagtgagataatccaactttagccatgcccatggaactataacctcttaggtaatgtgttcacaggtccgcatgtcaatgatcacgttactctgacgtagggcacaaagccatccaaaaccagttcatcggatatacataacggctttaatacttttcagatcaaattcaaacaatatcgctttatagatgacacagaagaaaacggtggaagcactagctagtggagcaggggcgggtatatgggtcatccagcattctacgcatatataaccttccagctcgggttcataaattcaacttaaccttccaacaacaattttcctgtttgaaagctttctttgtctttaaaaaacaaacaatgttgttcgcaaaccaatacttggctcaacagaagtcacaaaagtacgcattcaggccgggagaagtgctcataggtcttgttggaactaagccagattagccatgtagtcatgtacgagtacgctttaaggcaggaaaactgctccagttcagcaacgatggtgatagactatgccctatgcagttttattcttttgcaatttccacaaaaattagtcttccacgtatgatctgccaaagaaaagatttattgaaagtttagtcttacaataaaacagaccaatcaggggaaataagaaggctggtttagtataaatctatgctgaatacgaatcatttccacatgaagaaagatctgaatgaatactcacacgtcacaatcccaaaataaaaacaacattctacagtgacaaaatggtggagggccaacatgctagcaagatgatatctaatctcaaagtttatggccaatctagaagatattttctttgggattaacagaataaaaagaactatataagcaacacaatgttcctcacagaaggaaataaaccccacagtttggtccacatggttttacagaaaaaggcagcaaaaagtttgcttcacatgatttttacagtaaactagccaagttctcaatctgggttgaacgtaaaatactataaatctctacttagtgtctcaatctcatagaactacaaaaattagttctgttccacaccatgcagttatgccaagattacaaacatgcaacacattatatcttgaaattaggtacatcagttctgcaggcaaattgtccttttcattcagtactccaggtaagtgcctcagctaatgtagttgtttgtaaagagtctaatcagcggagagatcagttctgcagtcaacttgtccttttcattcagttgtccaggtaagtgcctcatctaatttagttgtttgtatcagtggattttttttatccccttagtatctgaagtagatcagagataacatcacaaatgaggcccactcaatctacgagggtaggtgttatcatgaatcacaataaaccactctaggcttcaagtaattaagctagaaatgtgtgtgtggtgtgcatgtaccttcaattccaattgaaaaccaggtagaaagtactatatacagattttcagaactcttctcagataaagaagaatcaaaactaacatcagaaaggtaaattgcgggtcataggcaagataggggatgagcagagcaaatacccgtccatccattgccttaacagctttctctgcgtctgcttgagaagaatatttaacaaaaccaaatccctttggccttccagtttggttgtctctcaccaatcgagctacgcttgataaggtagataaagcagagtgaaacttgaatgccaattaagagcaacaacaaggatttaaattgccctgtgctgaaaatcatgtgactactgactggtaccttcctcaacagcgccaaatggtgagaagacatttttaagttcttcctctgttgtgtaaaatgatagccctacaaaatcccaaaatgagtgaatgaatgtttaagctgtacaagcaatcaacatcaaaacatgatagaatgagtggacaatccactaagaacataacttacatggctttagcttgcatagatagcagaatatctacaggcaatttatgtgttctactcatggtccaatgtgaacaggtgagcatctcacaagctcaacagattagggacttctaagtaccgctatcaccaagagaataaataagcatctatcaaacactatgagctctataacaatagctagctatgtttctataggctgtaattccctaactcgctagaaagcatcctctgatcgatcctttgttgcaatcaaaaggaatcatattctgaaagcaccaagcctcaacaacttctggcatgccatatctatcatattcagaaaaaaagaagggctaaaggacacaccatttagtgctcatttcatccaccatatcatattcagaaaaaaagaagggctaaaggacacaccatttagtgctcatttcatccaccacaccccccagaatcacaccagatcatcactcatgaagttctgacggacagatcatgacaagcgaaactgtgaagcagcaggacatcacatcacaggctcacacagatccaaacattttgcagcaaaccacaagattacgtaggcggcgaaaaattaattacttactgctcacaaatatctccgtgctgaaaggcttggctccaaccatccgagaggccaagccagccagccgcccacctcgcagcatcatctccagaagtacagagccccccgcctcaaaccctagatccccaaattgcaatcgcataagagagaaaaaaacacgagatgcgaatcagccaccgacagtaaataacactccacgtctattacatcaaatccaagctgtccattatgatcaagcacaatttacaaagcaaacacaagcttgcaactactgccacctagcaaacgagaggggaaagggaaggagagaagcatatggcggcgaaaccctagagagataaggctagttgctggtgaacttggtgacggccttggtgccctcggagacggcgtgcttggcgagctcgccggggaggacgaggcggacggaggtctagatctcgcgggaggtggcgatgggcttcttgttgtagcgggcgaggtgggcggcctcctgcgcgagcttctcgaagatgtcgttgatgaaggagttcatgatcgacatggccttggaggagatgccgatgtccgggtgcacctgcttcaggaccttgaagatgtagatctcgacgctcttcttcgccttcttcctccccttcttgtcgccggcgccgccctccttggacgacgccttcgactccgacagccgcttctccgccttgggcttcttctccaccggcttcttctctgccttgggcgccatcggagctgcctctcgagggatcggcgcaaatggagattgaggtgggattcgtgaggaggaagactttttcccttcgcgtggagttgaggcaaagggaaagaagacctcaattatatataggcgcgtggtggaaccccattggtcgacatgggttcatggatatatctgtccggtgctagcatatgaatcttttactagaaaacctgtcgaactccatacacatttatcttctattaggagtcattcaaaaatgtttaatacgacaggttttgtatttctcacattgactagagcagatataattgaactccatagctcccatacaagtaagatatatttcagcacaggacggtcgaaagagtttattgatggcgtgcattattttttgagagtggccgatgctaacaagcataagggttttatctgttgtccatgcaataagtgcaaaaaccagaaggagtattctgcattaagaagttttcatttccacttgtttgagtcggggttcatgcctagctataagtgttgggcattgcacgaagagctaggggttcaaatggaagaagatgaagtggattttatcacggctgttcaagaacaactgatgggattcatcaacgaacaaatccttgatcccgagggtgaattctactacgacggatcgacaattcataccgtcggtccttcttcttctgagataacaccggcgtcgaagtcgtagctagcgagcatatgatagaaacattatatttagggtccgaaggaattgtaaatatatgtatatatttatatatgtacacatttagtttagtgtaaatatatattttggtaatatatgcacataaattgttaagtgctttaatttatatgtgtgtaatacatatatgtatttatacatacaaatatatatcccctagaataactattctacaccccccctctcccatgggccaatcccacagacagaaatggtaaaggtttcttcaggagaagaatctgttcctctttccttccacggcagatcacacacacgaaagaacaaacccatcaagcaacaccagcccaccccccaaagatcctagcacaagaaccctaatccgcgcacggaacagcatgaaacgggcaccgatcaggatgaaaccgggcgggggaagaaggattcaggaggcgaattgggggggggggggggggtggggacaaacctggccgatctgggaaccggagatcaatcggaactggggtctcggctgcggcgcctcctcctcttgttgttgctgcttttccccccttctctctcgtgtttgttcttttctccgtgtctttgacggagctatgggctaaaataaataaaatttaaaaagaaaaacaaaatcgacaaatactctctctgtcccatagtgtaagggagtagtatacaagaagggggcggcgttgcgtgtgcgtgcctgacggggatagggccgacaacgttgttggcgtacgtgaggcggcggcagctcggtaggcgtgggcggaatggcggcggcgacggcgcggcggtcgaccgcgtaggtggtggtgtaacaccccaggtaaccacgtacctagagtgccacacaaaaatacactcaaaaccactaactcacaagttttttagaaatttcggcaggcaaatataagataactcaaagacaacataacccacacaatcccaaaccatcctagctccataaattccgtgtgaaaataaggaccagaactttaaatgacctttacaagttctgtgcaaaacttatgctaagcataatcacagtccaaaactaaatttgaatagtgtgcaataataatgtgtagaccaagggtgctactcccatcccatgccgatcaatattattaggtacctaaaaaccaatttaaacacaagagtaaagaatactcagcaagtacaatatagaactagtaaaacatacacagatttattgcaatatgaaaccaatataaaatgttggatttactttattctaaaacaaagaagtcaaaagatagtacttccctcccgggcaggtatgaacatcctcttagcattaccggtaagcctagcaagcgtgatcaacgcttctcaaggatcatgaataaagatacaaattgcactcccatgcctacacatggttcttgaataatgtaaacagaaacatccgaaataataaaacacgaataacatcgtgaatttgaatatggattgaaacatgaataagtagcataacatcagagccatacgatcaataatatcaagcaattgaataataattatgcaagtaaaacccaaaaaaaaacaactaagttcatccatcaaataagtccgtcttgtacttgccttaagtccttcgatactccgactcaactcctccaacgttggaaccctccacacctgtggagcaaaactacgcataaaccactatatccaactaatgatagttacaagggatatctactaaaatcaataacctagaacatataaactttttatcgatttgtattaaataatctatagtagttcccttactgttttatgtgtaactcgcaaaccgtctaacggaatctagcaaataatacaacttcggacatctaggcaaaattgtctacatctttcatattgggcacaaaatcagattcaccctctattggtctcagattaagaaaaactaattactgtccctattttcagaccgggcagccgcactgttttttctgtttctcctaaaccgtttatcggaatcgagcgaaaccagtggcgttaaaaacatatcgacattgactacaaactttatttagaacaactaacctgaatcccgacggtttaataccagatgcgaaaatactattgtcagcccataaacaacatctaaaaacacccgaccggcaaaccgatcgattcccacgtgaaaatttgagctaccatggatcaagaggagttacccttacaaaggagaaaaacaaatttgaggtaaatttgcggaatcccagaaaatccccaatttttgcttatctttccccttttcttctattcccctcctcttcatgtgcccctgaaccttctcctccctgaccacacaacggcagacctagcagcaacaccagcagcagccagctttggatcacggcagcagcgccaaccatcagatcggcaacaacagggaaacgatagaaggaggagcagccgcaggaactcaccgggaagaagcaaaacggaaaggaaccaccggttgcgatggatggcgacggctgcgacccccggctatggccgtggtggcggcgcaaagatagcggcggcggcaagaacgcaggcgtgtggcggctagggctgctgctgtagcgctctcttttttttccttttttttttctcttttttttataaaagagactaaaaagagatctaacggcgcacttcgtttcaaaccccgctatttcgttcggactccgattactataaacttatatctattttgcattactcgacgagctctgcgcatccatggtttctgatcgcctattcaaacaacggtttaaaaattgaacttttacgtgtttgttcaaatattccccgaaatatattaattcaaaatccagggcattacattcttctcccttcaatcgaattcgccatcgaattcgtccaaccatactctagaacacagggtattataggtggggactagggaatggggacggctcatgcacggtaggaaaggtaggagcagtatttctggcgccgtttcggattgtgggaatgaaacgagaaggttatataaaggattaatttgatccattgccattgtaattattgtattttagataaatgtcattacaatttatctattcataattacatcatcaaaattttacaaaattagagccgtgcccctatcgtcatgttttctattttcttttccatctgcacgtgggacccacgcatcatattcttcttcttccttcatcttccccttttctttttttcccatatctctccatcacctttcagcctcccacccaatccatcacgtcctctcctcgccatatatgccacgagctgcacatggccaccccggattccctccccactgcccttctcctccccacctgtcacacccagaaattcacgaaccagaatttctaagctgaatatgtattaaatccctgtccaggaccagccagggtacacaaacgacaattgttgacatacagatctacgtcttacaaaaatacaaaagattacaaatgcagcggaaaagataaaacgagctagacttggacgcttgacttcagcagtggggcgactccactccacatgcaatccttgatggcagcgatgaaaccaacctctctaagatagctccaacttggaagaacttcaactctggtgtgggagaaaagagagcaagactgagtactacccactgtacttagcaagtcataccggaaaaggaggtatgatgcaggatataaccaaaggaggctaaaggttcatttgcataaagctagcatttaaaagcaatagttgaaaacagtaaaacaattgcagtagattaagcaatattaaccaatcactgtcctacgctacaccacgttgcaataggcccaaccaaccacctgaactacaccagttcattaagctaatctaggggtgagactaatcatggtgaatctggttgatcgcccataaccgcgggcacgactattcgaatagttttactcttgtcagaggtgtacaactgtacccacaagacacgattccacacatgtcaccatgccccgaagtatcaccatgatactacaaagggggaaatcgtgcaagaccctccgcataaccctcccctaaccatccacaccacgctaaggtttcacccccacccctcaaaaggcagtgagcaatcccctcgtgcaccgcggtgaatccggcagctggacaaccggatatcccggccgacccaactacatcacgcccaccctcgccaccgatgcctaggaaagggtcgagctatacttcagatcaagcagttacccactccgcttgtggtaaacacggtaagtgtaacatcccggcctagggcttaataggattaatagaatactcatatcaacaagttgcaacttcttttccggaatccaatctccaaagaactccagggttaagcgtgcttggcctaagcgtgcttggcctggagcaatttgggatgggtgaccgaccgggaaattcttcccgggtgcacacgagtgaggacaaagtgtgcagaaaagatatgtgttggtctgtgagggcagtctatgacctatcaaagctatcagatgtaagcgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgactggggtgtcgatctctcttaagggggtgagggtgtaacatcccggcctagggcttaataggattaatagaatactcatatcaacaagttgcaacttcttttccggaatccaatctccaaagaactccagggttaagcgtgcttggcctggagcaatttgggatgggtgaccaaccgggaaattcttcccgggtgcacacgagtgaggacatcttcccgggtgcacatgagtgaggacaaagtgtgcagaaaagatatgtgttggtctgtgagggcagtctatgacctctgaaagctatcagatgtaagcgggcctggcctgggggaaggcgggacgttacatcccgggtgcacacgagtgaggacatcttcccgggtgcacacgagtgaggacaaagtgtgcagaaaagatatgtgtaagtctcctagggtttcccgtgaaccggtccttaactgccatgggtgcgaccagcaaaaccatgcacccacagcacaccatttagtgtattttaattaactaacaccatttgtggtggtaccaatctaaagctatgctaatagacaaagtctatgtaataatgtgatctccatttgtgtactagttgagctaggcatgactaaacattttcctaaaccaacatctagtcatttttgatacccaagttatcaatggcataaggtaaacaataaatggctgagtaataggacccatcacacgtgacattgtaaaagaatacaacatttaatagaaatgcaggatatttgtaaattgggtacaatatgatcaattgttatacatgacttgccttactctcgtacttatgagaccacagcaacgtcttcgagaaaccgtggatcgacgaaacggccgaaatctacgcgacaaacaaagcacccaagcaaaacatgctataagactactgaaacaggaaacaaaaccatttttaatagattctagggatttttatgaatttactaagacttgaatggacttaaacggagctcggatgaattacttatgaatttgaattttagaagataatatgtgcttttacaaataaagaaaaatccttattcgatttattgcacaatattgccccaggaccgacgtcagcggcggggggggggggagggagacaggtgggccccacgggtcggcggcacaaggcggccggtcaaccgtggactaggaccacgcaggtggtccactgcctgtccacgggaccgacagtccagatcggccgggagccgatcggacggcgcggcggcgactaggaatggctcggctcggcacaaagccggccggccggccatggggagcggcggcggcgagtggtcgcatgcgacggtaagtggcggcgcgggaggcaacagcgaccggcgcggaagcggcggcacacggccgatgcggcggtgcaacgaaaggcggcggcgcacgcgggaaggggaaaaaaaggagaggggggag

SEQ ID NO: 59116 - DNA, 23100 bp, Oryza sativa
tgtttttgcatataacctaggtctactttcttgccattggaaatgcccttggaaggataaggggtttgattagaaaaaactgatctataagttccaagatctcaccatgcacataaatgcattacatcattctttctgccttattagtatgagaactctactaatatttgtccagtgtactagtatttgtctagtggagactttacaaaattttccatatgcttgattgactcaacaaagcttaatcattatgcccacactttggttgtatttaatcattatgcccacactttggtttcattattacttatgttttgactagcaaaggtgatcaaaaagtaaggaagtgaaagcggagcagtggaggccaccatcccttctctgcaccacatcaacttggcatggcagattcaatgcttagcacggttccttcatggctccccgtagggtaagtgacttaactttccgtcgttcataattttgacgtagttgtatgcgtggggatcattttggttgatagatacatacattgatagatacatactattgtgttcatccacaggatggaccccttaactacatatttgttggaaatcaaactagccagggatcgaaaaaatgctagggtggaatatgattggtttattttcagtaaagtgatagactcaaatgcgatgtgctacaaagactttattgatgatattgcgaagtcatatccatgggggccaaatgaaactgtcacaattggctacgtggatatggttcataaaattactcatcatgtcacaactgaccaggatatgcttacaatgtttgaaaagtttgttgatatcaaggtgattccaatgattattcgcatacatggtattaatgaaagtattgatgagttagaccacactcttgttaaagcaagcgcatgtgttcccgatactccttctttggcaaccccatctcaagtggatttcagccaacctagcagcagcactcttccttctcatgtcattgtgccatcagacacatacttagtaaactcatttcctatggctgagcatgttggtgttgatgaggaaggcatatacttagatgaggaggaggctgttgttggtcatgctgatgaaactagagatgaaggggctgtcaatgaagtatccgaggatgaatcttgggctacatctgaggatgaatctgaggatgcatctgaggatgatggtgtcaatgaatccgaggatgagtcaatggcatcagatgggatgcctgaacatattcctattgcaacttatgacaaaaatgacccaccaatgatcgtaggcagcgtatatccaaacattaatgaatttagattggcaatagcacaacatgcaataaaaaaggagtttgaatataacatcatccgaagtgaaccagggcaatttactgcaagttgtgctgctaaaggctgcaaatggaggattcatgcatccgtggttgctgatggtgtcactatgatggtatgtttttaatttaaatcagcatgcattctttaagtatattgtcatatgcatggagcccatacttctatgagaaacatatggcagccatacaagaagttaaaccagaagcagtagcataccttaagaagtatcacaaaaggctatggagtaggagtcagttctgtacaatttgcaaggttgattatgtgacaaataaccttgcagaaagcttcaacaacttggtgaaagattggaaagcactacatttatatgacttcttggagaggattcggcggtggttgttggtgaaatgggataagaggcaaagaataggaaagaaattcgaaggctgcattctacctcatattgtcaaggaattgaatgaaaaaagtagagatttagacatggtggtcacaaggaatggagactttgaggcagaaattgaggtcaagggaggtagtgggtttagacatgttgtgaatttggagcacaaaacatgtacatgtagggaattccagatctcagggaagccttgtatccatgctatagcattcatcacatcaattagaggaaggcttgcagattatgtggatgattgctttagtgtgcatcgattcagggcagcatatgagaaattgatcccttcattacctgacaaggcacaatggccaaaagctgatcatgggtttttcttggcaccacccattctgaagaaatcagctgggagaccaagaactatgaggtacaaaggatggactgagaaaggaagcaaaaggagtaggaggcacaaatgcccaatttgcaagagttatggccatcattggcacaattgcaaagagggtgatccagaggaagtagcagcaatgcttgctgaaaggtacatatcattgcaagtcttttattcattttagttggtggttgcaatttaggcagctgtgtaagttgataaatatatttcatgacattccatccttgtagtactaaacattataattaatggataagattagaaagtaatgcggtggttcgatttaataacctaaacacttgtgtatatttgtctcacaaatttccattctatttctaacaagccttatgacatatattttctcttgttcatagagggccaccaaagaagagaacgaagaaaactaatgaagcaacctcagagactagtatcatggctgctccaatagttacaccaataatggcataccctcctaggttagcctatcttctttatttcattctacattggatttagatcaattagttacataacaatttatttttcacagtcaaaactttaatttcaccgaggacaataggacattgaacaatagctcaggttcaagtatatcaattaggtaagtaattagatcaattatgtcaatttgctggtattatgttgttctatgcaatatattcacaattctctttttcagatcaagatcacttactggctccaaccaacctgagccatctaacatgattgtagccttgccatgtctgggggaggaaacacctacagttgcaccaaaaatgaccaagagcaagacaaagggaaagtcatcatgttctagtactcctggtagcccagctatgagcacaaggagcaaaaataagagtcctgcaatgggcactaggagcaaaagaaaacttatggactgaatcatatggcttgctaattaggttttattttggtactgtccatttctcttgtggaggctgatggattttgttgttgtgatgccctgcaaagtggtctagtcatagttgacatattttgctattgtaaggattgcttcctcatgatgtaatgatgcactgttatggaccttatgccattatgctcatgatatattgcgtagctaatttggtttgttggttgcaccattttgtttgaaatggaaagttggtttggttcctgcactattgggtatggaaatgaaattgtgggtgcgcatgatatgaactgttatgtatggatgatggaaagattatgttctgtgcatgatattgtgtgttctgtatgaatatctctattattatatatgatgctattgatgctcttattttaccataatcaatttcttgtacagaggaaccaatttcttctatagagaaaactgatgactgtacagacagtcagcttttcctgatctattatttttccaaacaaaaagttcattatattgcatttttttcagtgccacaataaatttgttatacgctcattatttagtctcataaaatacacatattgttcagttaacattttttcaattttttcaatctagctgccactcctacatctacaaggggattttagacatttggaaccacacataacgtgaaaatgaaggaaacctaacgggaggggcatggaagggatcacagcgaaatttcaggggtacacaggggattggataaaattcgggggtatagaagggattaggtgagttttggataaaattcgggggtatagaagggattaggtgagttttcatgggcacacaggggattttctctatattttagcattgcatttacatggaattagaatgaggagtattggaagaaggaagacggcggcggagcatggggcagcgtcgaggaagacaacagcaggtacattgatttctgcccatgctcccctactgcttgataaaatgattcaatttactgctacttactcattggtacttgtaatactaccatgaaagaccaagaattctgatcgtttttattttctgatacagttaatgatttatactaaatttcatgtgttccttttgacactggattgacactatttctatgatccttgtgtggcctatgagcacctttccgtggcttttttaataattagaattgtataaaccaaaatgaatgttctttttatctatactaattcgagtgtaccatttagtcaaaatgttatcactatagtaatctctggttgccgttgtattcaccatattgtagtatcgaaattcttagtggtctcgaggggcatcatatttgtgtaatgtgaactcttcccaagacaatggaaacggtatttgttgattccagttcgcactctggtaggtgttcacactaactcgatcaaatgaaatgtacgcattagtactacaacaaactattattagcttttcaatctctggatgttgctagggctgtatcctagacaggttctgactaaaccattcaggttttagcccttggcatcttccaagccatttgctttcacatattcagaattgactgacattcatttattgttacaactaatttcggtgatcagctttcctggaaaatatttgctgaaaatatatgtatcagtaccaaaatgtcacatcttaattgctgaaaacatatgtacaataaccaaatatatgtaacagaattgcatattttcagatattcacatatctactttattctgtcaatagctgaaaatatgggaaacatcgccaaaatctaattgagttgtcaccagcacatacattatccgtgtcaattagcaataccattcaatttaaagatttgtacagtacttgattaatgaaatcttgaagttacttgctcatatgagtcactaaagttctgctattttgatctctttgaggtctacctccatgagatttatgctaaccatgggctattgtattcctctctgagtctctataatgcagttctacaaataagaatatgagaaactgatgacatatttatgtgtagtgtcctgttgtcctatagggcattcatatagagcttttgaatttctgttaatggaggcagaaaccaaaatgagaagattgtaatatgaatttcttccttgcaatttgtttctatgtagtagaatatggaagtaagattcacttcaaacttttaaataatttagtaaactttcttgcaggtaaacaagcattttgatagattctatagctggtgaggcatttattttcgtagtctacatgataatttgatcatgcacatgagttgtgcccttgatatgaacacctgatagagcccgagataacctgtgatggccattgatctgtgccccttggcctattgcagtggacaatatcgttggaagctctacaccaaatccatttgcatgaacaggtgatacacaccaaatccccttggcctacccagtgacatgcactggaatcttagcaactgtctgatcgttattaattcaattcatcactcgcattctataactctgtaacatcatgacaacttgggctttgatgattggggagaccaatagttgtcttaatagaagaaaaatcaccatcaccactaaatccattttcattgcactcaggcgtgcacaaatgtatagagatatggctgcaagtgaagggagagatcaatttgttgtagtttaggcttcaagtacaacaaagcactgccttataatctattttggtgttcacatttcaggaatcatataaaagtattttaaattatgtataaaaagatcagattgtatgacggtagccactgtgctattattaaagatgtcaattcaaatataatttctctggaatttttcctatgctaaatgaattatctggaattagatccaaagtcttggagcaagaaacacaaggtttgcttctccagcagtgcactgcatcttatattggcactctagaaatacactgtgctgttttttttatagacctatacaaattgtcatcctaccatggtctatgaaactctatttttatctgtataatttgtatggagtgcagtgcatagaaaataccttatttattgttctattttcatatgtatatatattgcgaaaacgtgtcttgcacgtgcacgataactagttccgtataaacaactcagcgcagttacctttattttttggcccaaaactacctagtttgaatagtggaaggcataagaatgcttaagctccatatgcagcatgtcatgtagtttctgttttgttattaatgttaccgtttaccgacgactatagtcacaaatggatattcatcttgcctgtaccagcatatagagaatgttcgattggtagaagtaatgaattgtctgctttgtttactccaataaaagtgtcttccaattccaaagaatctatgctgtcagtgctcgtcatgacaagaacaaggcacaaagtcgatgcatgactgcggcatcagaatgtaacattattactattattatttattactaagaggagcccacctctcttgtccagattttggcttccaatttcgctctccgtaaggtccaagttaggctattttcgtttgcattgtttgtagcgatggcaagcgattgagtccaaggatgtttgctttctttgttccttgtccgttggaacgagtgacaaacgaggctctgttggcggatccgccctcgtgctcgtgcgcgcaatcgtgttagtcctataagaacgtacggcgcgccattgagcatataattaatctaaactgctactaattcttctccgttaatcgccgaaagcaagcaaaagttttgaacgatatatcactgcatctgcatggcgaacactacattattgtactactcgaaattgctcgtgaggtgctcggcctacgagaaagatggtagcggcggcggccgggtgagggtgaacggcgcggctcaccgcgtgccgctccaggtcggggctgcgctggagacgaaaatcaacaggtcgctggccgggctgatgaggccgccggtgctgtcacagccgccgacggaggaggaggccgagggcaggaggagccagcggcagaacatcccgagtgagaagcagacggtggacccgttccggcaggcggtgatcgtggaggggggcgtgcggtaccggcagacggtggtggtgcggtcgtacgaggtcgggccggacaggacggcgacgctcgagacggtgctcaacctcctccaggagacggcgctcaaccacgtgtggatgtcgggcctcctcggcgacggcttcggcgccacgcacgccatgatcacgaacaacctcatctgggtcgtctccaggatgcacgtccaagtcgaccactaccccatctggtatattatattagtatttgtgttcgtccatggcgtcctgttcgttcagagaggccggggcaagaaaatttatgctcatcagacagaggttggttgcaggggagaggtgctggagatcgacacgtgggtaggctcgtcggggaagaacggcatgcggcgcgactggctcgtccgcggccgcagctccggcgccatcttcgtccgagcaaccaggtatgtcttctagagatcatccgccagtcttaataattagttatactagaaaatatgggtgccagttggcgcgccatttctaatagtagtctgtttagggtaatgtgaatattttaatgtgttttcattttttcagttagccaataacattgtttcgacttaaaatattcctcaactttttcattgatttttataccattcaattagattgacttacgaatacttgttgatttgaccggttgatcgtgagtagataaacttttagcgttattttttacataacatcataacagatacatttaaatatattaaaaatgtaataatacaacttggatgctacaaaatttgattgtttaaattagtgttgatcaaagctcagcacttcaaagtaaaaaccaacaagtattaaagtccaaagtgttttgtgtttttacccttttctgatttttctattggtgatcattagtttgtgcactgtttcctggaattttttttgctctttattgagtggattttataataattggctatagcttactggacgtaaaagataggatttattccattataaaaaaccctttcctgatttttttagatgcccttgattttaggtgagccacgctttcgctagatgcatggcttgagagtgtaatcattttatactgagtttactttattatttaacctagggattgaagatttatttgataagttatagctgccatgtagtaaagttagctggtggtaaaaaccatcagcttaagaaggatattattacacgtgactttactaaaataatatgctttgtatttacatacaagctcttagaattataatttgtaggattaaaatataaactttttatctcaacttttgctttgaattttgttttactttcaactacttataatttgacatatggttattcaattacatggtagatatgcgctcgtagagcattatgcgcacacacaccgcaatcatatatccgttctggtaaaaaagatggagaccacatcaaatacctaaacccaatgattcttattaaaaatgtactccctccgttccaaaaaaagacaaaccctgggtttccgtgtccaacgtttgaccgtccgtcttatatgaaatttttttataattagtgttttcattgttgttagatgataaaacatgattaatactttatgcatgatttgtctttttaatttttttcataattttttttaaataagatggattgtcaaacgttggacacggaaaccagggttgtcttttttttgggagggagtactcaagtaccagggtttgaacctgtgaagtgaattcttgcactcatggtctctccaacgtcataccacctgttcttctccattttaacatttgattttgctatttatttatttttcaatttctagaaacatagggcattaacagggttaaattactttgcctaaaaacatattttcggtaagctcatgcaaagtaattttcagtaattttccccgcctgtatagcaacaaccacgaagcatcgaacatagggcattaacagcattaacagggttaccgagcaaaatttaccgaaaatttaaatatttattggtattttctttgaacttggttgatatacaggcggttttcgcacctcggtggtaagcggtaaccccgcagtaagggaaaccatgccctgggtattaattaactcattttgttttgttatactttactagtagtaactcagttagtcaactgcttttcttatccctagcgtcgtttgtgcagtacatgggtgatgatgaataaggtcaccaggaggctgtcgaagatgccgaaggaggtcagggacgaaatctcgccgtggttcatcgacaggcacgcgattgacgaggtggccaccgacaagatcatcaagctcgacaccaatgccacatatgtcgattccgacttgaaggttaattatattggttctactgcacaaactaagttcctttattaattttctcgataaaaaatatttctttattaatttaattgatttgcctttctatattcctaggctccagaggctctgcaattttcttcagtttgtcacaatctcatatgaagcaattaatttaacgcaggataggatcacaatatcttattcttatatatgcacattatatttgtagccgaagcgcagcgatttggatatgaaccatcatgtcaacaacgtcaaatatgtaaggtggatgcttgaggtaatattcatcattttatagcggttaagtttgttgagataacttagttgtataataacgtgtcagtgtcacagagtgtacatttttttaagaactgtcacagtgtttacaaggtggttaagttatctagaaaatgctgcatgggttatctgttcctatgtacatatgcatatatgtttgaccggccgttttatttaaacttttcataggacatgaatagtagacttacttttaaaaaaagttcataatttttttcaaatataacggacggtcaaacattggacatggaaactcacagttgcgcttaaaatgtgttagagtgagtatttgctaggctacttcctcatttattgtgagcatgtttcctaagcttcttgatctcttttaacagtgcttataagaactttatacataagtcaaataaatccatttttttaactttattaaagttaatactaaattaatcactgctttggtttccgtgccactaaccagcttagctattctatactatcgaatcttaaagttcgctcagttttctccttcaaaatatttctttatttgtttctccttttataaaaacatgtttcaaatttgtaaaaccatgtatgataccataacattacctttttaaaagaatgttgaaaattttattatagtttggatgacgtgtcaaacttattatttaaattagtcgtatgtgtttcaaattagatgcaaacagtcataaaaacatttcaagaaaaatgttgaggcaaaaggaataatcctatgatcatcccacaaaactttacttaaaatattactggtataaagagataaaatagtaaaaaaaaaactcctcagccccatcccaaaataagtgcaattacatgatttaaatttatcccaaaataaatgcattcctatgtactagtaatcacatcaactaactcttatttaaatatttttccagcttaccctcatccgtcctttcactttcattcacctatcatttaataagggtcatagatcattttatatttctcttaagttgtatttgacctctagaattgttgttattttggaatggaggtagtagaaatatgttagggagtaaaatgagctactctctatgttttatattataaaactctttaacttttttaagtcaaacttctataagtttaaccaagtttatagagaaatatagcaactcttgtaacactaaattagtttcattaaacctaatattgaatatattttgatggtatgtttatttggtattgaaaaagctgctatgttttttataaacttgatcaaagttagaaagttagagaagtttgaataagacaaaaaaatcaaagtgtcttataatatgaaacagatggagtagtttagaaatgataaaattttataaaagcaaaatttagttggtttcaaacatgccatcggtaaaataatattacaaggtacggtacatattttatggtgtaagtaagaaacgaatggaggtagtacgttggtttctctcccatttggtccggttgatcttcattctctttaaaaaaatatttatctttacttgtttctccttttataaaacacggtttaagttcaaaatttgtagaaccatgtatgacaacataatatattttttattatagtttggatgccgtttcaatcttgttatttaaattagacgtaggtgcttcaaatctatgcaaatagtgataaatattttttttcaagaataggttgcggcaaaaggaatactcctatcatcatacttcaaaactttacttgaaatatcacttctataaagagacaaatagtaaaaaaatagaaagatctttagggagtaaagtgagctagtttaatagagatgatataaatttataaaagcaaaatttagatggtttcaaacatgccattggtgaaaaagaacggtgtagtacatgccattgatccattcccaatttctatcgattcccacttgttttattaggcataacataaagatcgacatattctaaatgtctttttatggcgtgcagactctgcctgaccaattcctgcagcagcaccagcttagtagcatcattctggaatacaggaaggaatgtgggagctcagatgttgtgcaatcaatttgccaacctgatgaagacacgattatgccgggagaaaatgttagcattgtgatgggaccttcactttcgcaagagatcatcaatggccaccatagcttagctggtgcgctccagcagtggccaacgaagtacactcatcttctgcaactaaaggcaaatgacaagtatgaggagattgtgagaggtagaactacatggaagaaaaagtcatatagtatatcaaacgtcttgaagttttaaaggaaaaaaaatcaagcttattgattatgtctattacagatgggtatatatgtatatggtgtactgctctagcagtttctctgtgttggagatattgtgctcgccatacacatgtacatgttgggggtctcaagacaaacattattcacaaatttagccttacatatctccagagtacctttatacaaaattatctttcttcttccaatatatgtgatttcacttttctaaagcattccataagtgtctctcagtagctgtaccaaacagtaagtatttcataaacattttcttactccttatgtttttctcgggggaaagaaatatattaattaaacgacgactggattacaatctcaggacaggcgttcagaaacacacttgggagcctgagagccaaacaacactttgtttcaggcataggctgagtagagcaagaccatgcgttacaaaattactatgccttccgatcttctggatttgggcaactggagcttgctgcaaggccgcctttgcctcctggatgaaatgccaaaataaaagactcatcgggtttcactgagtgagttccattttgcttttacatttttcttttgtctttttgtcttttgaagcaccctaggtacgaaaacaagtgtggggtgatcttgtgctcacatgacgcattcacatacaagattacccatgtctgtgctacaccgtgacgcttgcacattcacaagatgagacgaagcaaccattgcacaaggctgcacgtcttcacactcacatatgagcgttggtttgcacgtttatccttcatatccttaattccttgagttggattaattttgccttatctaaaattaactcaacaattaaaatgagtattgacatgatcaactagagtctccgaattgcttgtaaaaatgacttgcataccttctattccctgcacacaccttctatgacttacatactcatgggaccacgtgttatctaagttattgattaatgagagatggcctaatgatatgaaacttgcacttgatgttgaacccttggaatttataaaggaaaataaaataactttgcatactcctcaatgttgttcctttcctaccaaagccatatgtcaatcttaatgacgaaaccttatacatatgctgcttgctatcattttgagttttgctaaatggttgtgacccttgttagattattttcatattctcatgaccaaagtcttgtgcacttagccaccaaaaattttgctttttctccgcactgtaggattagcaacacattccattcactttcatatgctaaacttctacaccagaagtcggcatccaccaaataaagactaaaaacattgtatggtctctcctctaatgatccatgccaaatgagacatgagctaaaaaaaactctgctcaaaagagaatgaagcaaattttctcaagcatgatgaaaaaaaaagtatagtgatgttctctggaataaaagtgcaagcaggaggatcataaaaaaaatgagtcaccatcccattttcattttttccactctcccatttccacccataaatataggtgaccaagcttggtcatggttttatgattagttatcttcttacatcctctatttgactttacaatatatctgatgtaagtatgtcttttcttattccctatcctgatctccacataagccttattagaaatataggatgagaaaatgcaacatcaatgccttgatgagtgatttgagagaaattaattgagaagtatagtaaaagttatattgtaacgagcatcaaagaaaacccaaaggtaattcaccagaaggagtaaatgtgacttgattcgaggaccattccattcttcaatcactcaagatgacatgatagacgcatcaaggttcacagacaaaagtttgtcttggaatatttagtatgttatatcattaagcagaaagtcattactataatatattcatgagctttactcagggacgagtaaaggataagtgtgggggtgttgttgacggtcgttaagtgcaaactttaaccgtcaacttatgcataaaagagatcaaatatactatcgagacttagtggtaggagtttactactaaccacttccactagtgtatgattgagatgtcaactagagggggggtgaatatgcgatattaaaaataaatagcacctaattaaaactaacctaagttgctaggcttggtgaaggataagtctaacaaagcaactaggttatgttttgcaatcctggggtgataagggctcaagtatgtctctatgaatgtaaattgcacaaaagtaaatgcaataagtgaatgagacaagagacaaaggaaattttacttgaggttcggaaactcgctggtttctaatccccgttgaggcaaacccaacttcaccgctcaaaaccacgaagccaccacaagcccccttcgccaaggggtgggcaaggttggagccggcccacgagaagtggactatcaagcctcaatcactagggtagttcttccttcactccgaaggtggtgaactccaaatcacgcacaaaccggcactaggccttctgtacaatctccttggagaggtcaccaggcaatacctccacaagtcgtctatgagagggcaacctctaagagtaacaagtaacaacctagcttgaagatgatcaagtgccacgctagctctacaatgaagcaatgcacttgtcttggctcaatcaactctcaaacacaccaaatggatgaacacaagctcaagagagtgtatgcaaattaagcaagtgccatgagagtccccttgctactgatgggggagtatttatacccacatccacaaaaactggccattggggtcgaaatccccaacccctgttgcctgccggtcagaccaccatagggtggtcggtcagaccgccaattggtgtaacggctagaagccgttacggttcatttattgcataggcacaactagcacggtttgaccaccataggtcggccggtcagattggcctcggctctggcagctctagatcgccaagctaggggcatccaaccgactcaaaggaggcccggtcaaaccgagcctggcccggtctgaccagcatggggcctgcggtcagactagccatggtcaggggatgtatgagtaaaagtagttgaaccaagtgacaatgcaagaaatgttagttctctttctttgtcgagataattgacgatcgaaatcggtacttaatgacggtcaacattaatactcatcattttattcatattctttatatgcggttggttggtcaagtattagagatcattaacaggatcattgtaactaacaatttcattgagttaaataaaagatataggtccttagaaatggaaaaggtgctaatgctcaagtcacatcatgacacctaatgatcaagatgaatagtttgcttggtcaaaggatgaaaaaagttgaaatatgcaagcaaagatcaattgatgagaattactgtgaagatattgaagaggtggggtatgaagtagctatccatggaaagatattgaagggcaagaaatgattggtcgtcataggccatgtggtggtgaagggcaagcaatggcttggcaccaaggaccgaatctggaggtaaaggacaagtgaaggctttgtcgtgatgtattgtgcgaggccatttaaagctacaggtaaacatcatcaatcttttaaagaatacaaggtgaaatggttttggtgttaacatccctcaagacaaagaaagaaagaaatcatgaaggtattcctgttggtatagttttctttctatttgcgtttgagtataggattggcgtattattaagtgggatgcaatgtcgatgtgtttgtttatgtctcagtgctcaaagtttcatatccaagtgctacattgagagaaaacccaaacttaaccaatcctttgagtggttttagacattggttttaactgggttgggtacccctctaggtaagctttttatagagtccaagatcataaacaatgaacttccgggtgcaagaagctatggttatttcaaagattatagaggatttggatttttccctttaattactaacaaattatggatttcgagccctgctctacaccctctacataatcttgtagataaaatattattttaatatccatagaaacaatgataatccatgttttacactgttagagatataattgattagagttactttcaatcttttccgtgtttggataaggattggtttagttcccaattttattttcttaaaaatgtcacatcaaatctttagacacatgcatagagcattaaatatagataaaacaaaaactaattacatagtttgcatgaaaatcgcgagacaaatcttttgagcctaattagtccctgattaaccataagtgctacagtaacccatatgtgctaatgaagcttaattaggctcaaaagattgtctcgcggtttccaggtgagttatgaaattagttttttcattcatgtccaaaaccctcttccgatatccaattaaatatccgataagatatctaaaaattttcttttctccaactaaactgggcacaagtagtcagataatagcatagccgtcacaaaattatgtaaaccctagctggctgtccgtccttccccctccacagcgtcagtggcggctcaccgcaattctgtccccaatccagtgtcatttgactcatttcctcttcctgccctcggggagtacgtgaggacctaaaagtacctcgcccccaaaccctagaaccccacaccacacccaattcgcccacccaaaccctagtcctcccgatgctgtgatccgccgcgcgtgccccatggctctagacggccccgcggagcgacgggacgaggcccaggccgcgatgggtaatggcaacggcgtggccccgccgccgttgcggccggccggccggccctccggggcgccggcgtgcgcagatcggcggctgcggttgaaccccaacatggagcacaagccgcaggactacagcgacgtccgcggcgagtacgcaccagctgtatacagtgcacttgagaggcacctcccacccagtgtccttgatgccaaccgggaaatcaagctgcagctcatgcgagaggtcctcgggcactattggccccatggtgagcgcaacaaggtgaggttgtggatcttgttagatagaaatatatatgggccttgcgtgtttttttaagtgtttgctgtggcccttttgtcgatagaattttgttttgtttttttttttttactacggactctgaaattagagattcagaatgggcgatggtgaagaaagtaactgctgagttgtatgcccattaggtggaataatgtggttcttgtgccagcaacttctggcaggcaggtgttgtggctggagaagggtacgaggtgcagccacaaatgctggactaaatccaataaccaaaagatttgtctgttcattttgcataagacaagctgtagccagcccagacaataccagacaattgctgtgaaaaatttgatctggatttggcatacctgctgttaatatgtgccaatgccccaatctagtacaccctttctaggtataactggatgcatgtgatgatggaagatcctatttaagaatgcatgcaattttgtaacttatattagatgaacataagggactaattaaccatgggcaagtttggtttgatgcgaaatattgccctaccctttatttggtagcttcaaactcttgctagctatttggattggatccccccctcccccgaaaaaaaaaatcttgccaaatcaatataattgatacaactttaccctaccaaaaatttggtagtgccaaagcttgcccaaaggtttggcattaccaatggtttggtagagtagagaaccaaactcaccctaaatacatacacaatttgggttagagacaaaatattgtgataatcacttcctttctaaataattgtctctatgggttaatcactaggcttttccttacctaatcgtcacttggtccaccttaaaggtgtcataatatccttctgtttgcctttatctgctagttatgccatggcactttccttgatcaacctgtgcttatgaaaaatgtttggtggaagcctatctcttgcttgatctgcttgattgatacaacattatggattggctgtttctaggacatcctaaaattagtcttgttcaatacttatattatgacgccatcgatccgaactaatctatcttgaactgcaatttggatctatgcagtactgtactaattgaacttcattctataaaggattctaaaaaatcatattgtttatctgtagcttaagagttctttttccttgtagcatggcaaattgcatgatatatcttggttgtcttggaattcgaaatttgattttagttttggtgattgagaaaaaaaaagagtaaattcgactggcagtatataaacttttaagatttggtgcaaaacaaggccaaaatgaccacatgggcaaatctggctgacttgacaaggattccatctagctgagcagtggaccctggagttttcaggagccaaatcaaagtcttcatgcacataaatacaattagggtccttattcatgaaaagtgaagtacaaataggtcaaatagtcttacataacacaaacaaacgtttagtcatttcgggctttttttcatggcatataaatgcttgattacatcccgagaaagatgatcatatattcagaggaagtgaaaaggtgaaagaccacctggtcatctggtgttgcctgttgccaccttcagttgctggttgcgtgctacccagggatgctacgcttgcaggccatgagttgcagccctgtcaggcatcgtcgccagtactccatgctcagggggttggggctcagctgttcaggggccattctgcaagggagtgctattggctttgctagactctaactcactggcagttccacttcacacgcgcctccaacggaaaccctcaagatgttgaaaggctttgttgcatgtgcactcccgcattgacgcaagcacacgcatggtcttccggtgggtgactgcacctaggcttcttgggctttggtttactacatcctttttcctttttgcaaatttgttgggtatgccagtgtccacgtagcatcccatgggtccgcccctgtagatgaggtgtacttcattggttagttgttccttgatattgctgtagaaacgaaagcatgctatgttatggagcttcttgtgttgttccggctaacttgtaatcgaagaatgggattgaagataaggatgtgaatcttatcccgtgtaaatagatggtacgtacccggataaggtgggatccggatacctctcaatagccagttccctgtgtctatataaagggaaccgggaaccctaaagcaggtgatcactacacgctactcctaatgtcgtattgcgaacccctacacagatctaatccacataagtggactaaggtattacctctccctaagggcctgaaccagtatccctgtgtcaccatccctccatgatcttttgcaccccataaatattattgctaatccgtagaattgacaaggtgagtcaacgtggctgaacccataccaggatagctcacaacacaaaccatcacttggttgtcatccttgttaacaccaaggcaaccagatttgccttcttggattgtgtttgtcttggttcgcacctatgagtctatcatattttgctagttattgcactaatgtgtatcctccattcaagtttgtttaccacaagtgcaatcatatttgttaaaatataaagtgtatttggtatgaagcatataatttatgcaaattttgaggtaataggagcaaagttgcagaaagaaaagatagccatttaaattctgctgatattacttgcatttgcaagactagaatggattggtatcacgggaaacggatgcaaaaattaagcaatgcttaacatcaatatatattttattgtttacaataaactttgatgttatgcctagtggtaggactttttagtataagtttatgatgttcaaagaagctgttactgcataccacagagatcaggtcaaaatatttgtggctgcttcagatatttgtaattgcatattaatttcatgtattaaatttaattcgtcatgagatgctataccttagttttgcaacgacgagggagtttgagctggaacatgtcaaaagaaaacacatgtagtggtttaatttttccttaagtagtatgagtgaacaaagaagggtcacctcgaattattttttgcatttccagagtttcaaccttcccattttctgcagctgtaagattagttctgttgagattgtcatatgaagtgttcttttattgcaggttcaaaggcacagagaatacagacagagaatactcaaccattataaggttagcgtttcagcatagctgacattattcgaattatctctaaatattttgaaatgggggaatatgcatgttttttcttgtgcataactatatttgcacatagaaatatgcagtccaggaattcaggaattatatcatatattgtatgatttgttatttcttttgagcgttaagcagggtgtgatatgagatgtttatggaacaattgtattggtcctgtacgaccagccatatgtgatttcccaggtgattgcatgagcaaaatctttgttcttgaagagtgcagctggttcctggtacaaaagggcacaattggttggacaagaggtccgtgaagagtgtagggtggtaggatactggaagatcatagataaaagaattacaatccaggcatccagtatgcgctagtaattcaatatttacaactgtttgaatcaagtatgcatgactgtgacagagcactacaggtaccatgaataatttagttatggagagccttccgagatttggttatccaatcagcatttcctgtgttggttgccttgtgtgcatgatcttagaaagctgcttatggaatatttatcttattatgtcaaacgaatttggaattaaatttctatgtttacatggcaaaatataaaaaaatatacttcttttattaaatgaagtatacttcttttttattaaaaaatatacttctttctatgtcgatatggcaaaataaatttctatggcatgagcggtaatgaatccccagacaggagaattaaatgaattgtgagctgacgtgggtttcagtcaacaatatgtgggttccttgatttcactaacagctagagctcaagcaagtggaaatatcaatgaaactaaatggcaccatgtgtttgttacagttcattcatgtgtacactacagttgtagtgtatggactggaagtcatcaatcttattgagaaattgaaactaaatctatttgttttttgtgctagtaataataacttatattttttttattttcctgacagccacttcataaagagctatacaaaatgcgcccttcatcgttctttttaccaacattccttgaagctattaggaccaatacagaagaaagctttagaagcattatgactgagccagttcctggtgtttattcatttgctatgttacagcctaatttttgtgagatgctattacaggaggtatggtagcatataacatacaattttgatattgctatatcatgttttgttacaaacttacaatgataaaacaatgttttacaccttgtaggtagagaacttcgaaaaatgggtccacacaatgaaatttaagataatgaggccaaatacaatgaacaagtatggtgctgtccttgatgattttggcctggaagttatgctgaaccaattcatggaacagttcatagctccaatgtctacaggttatcttatcgactgctatccttgttaaatagaggcagaatcactagcattttcaaaatatatttcctatattgattttatgctgtgttaatcttcagtattatatcctgaggttggtggaggaacattagatacacaccatgcttttgttgttgagtatgggaaagacagggatgttgaactcggtaagttaccattataaatttataatattgttttatacttaatagcctgtaaaatcatatgaagtaaaagaattgttcttgattgatcatgtctgcattcagctattccatgtaactatggatactatttgtattgttgttcctccctgttgagaaatcaatcacatatcagtttttgagccaatggtttggcctttcctacttaaaatggcaatatgttgaaactagtttcaatgactagatgataaatcaatatgaccaactttcactgtcaggaacttgtggaactgctatcaaaggtagaggtcacatcttctctatctagtctggagtctggaatttctcttctctctctgtctactatattttggacagagggagtatcttattgtgcactatgcgcttagatatatttgtactactatcacctaggggtgttcatcgacaggaaagattagctatcatgatgaaaaatgaatgctatgctgtctcttaatgaagtagaacaaagaccggggctgatagaatggcatgataaaaccgttttctttctcagtttttttttttgaggagggggggggggcagta

SEQ ID NO: 59117 - DNA, 2560 bp, Oryza sativa
gttgcccctgccgtcgtcatcaatgaaggaggcggcgcaaggtcgtcatcaacgaaggaggccaccgccatccttgctgtgccgccgtgttcgacgccgggcggaagaagggagaacgaagagggagacggaaacagggacgacgtttgagaggagacagaaaaagagacgtgagtgccatggtttcaattttaaaaatttgcagtggcatccagccgataaagcgaatatgtgtggcatttttttatttgccacatttgcagtggcatggatccaattaaccctttaatcaatgactaattagaaaacagtatccccatctataatatataataggactaggatacaacttgtatcctctgagtgtatacttagttgacacctaatatttggtaaccatatatatcattttaaaaagaagaattatagtgtttgctctaccacccttgatcacatctaggcgatgatgctctatagggatgatttcaagggcggatccaaaaaatgtatagagggagggtttatctcctttctcctccaatccccctgctcttccttctctccctcttcttccccctcccacccccctttcttaatggtgatccagcgggatagagggacttgagtcctccagcacccacgttggatctgttcctgggtagtgttttgtccgtcaccaaacattgctacattacagttttaacatatcacagtgtgttagctatatgtttgctttattgtcacacttatgacattgcaactcgatttttaggctagttgtgccacacagaacgtacttttatgtttttttttcacagtttatctaatttcagttgtggcaagacgccaaccaaacatccaagaagaattcaccacgtttgtgcggacatcaggcacggcgtcctgaaaggacggcctgaattgttcatcaccgggaggcaaggacgatgatgcggcttgctggtaggcattggttgtgtgcccctgctgttgcctgttactcctcatagcctgtcggtactattgcactgggcactggctgctagtctgctacagtgcggcacgatctcctccccgatcttagctacagtaattacccatgaaacattgatatctcgtacaagtctgccccaaaacagccggttcatcattatgggtgccttttctgtccatccatgtttagaagagtcctgcatatgaatcaatatcatcccacttccaaaaacaaacacatgttttatagttattttatatatttaagagcggagtgtatattcggtcctaagcttgtatgggtgtatcatcgagacccctaaacattttcaagtttctatattgatcttcgacatcatataggtccaaacatgttccaatttgctttgtacattgacatggcatgcaacaatattttctacgtattagtgtgacccacgtaacattcatataggaaaaaaaacatattttcttctctctaccttaaaatttttaaaaatgattttttattttctttgtcttttctcctctctatctaacatgagaaaatatgtttttaaattttatttttattttagtgggtcctactaatacgtaggcgccaccgtggcatgtcatgtcaacactaaggatatgtttggtagcaagttttcccaactcatctttctcgtgttccgcgcgtacgcttttcaaactgctaaacagtacattttttacaaaaagtttttatacgaaagttgcttagaaaaactacattgatccatttttgaagaaaaaatagctaatacttaattaatcgtgtgttaatggaccgctccgttttccgtgcacagaatacttgttcccaactaatcctaatgaacacagcctaagagcgggttgatgcccgtttagatctatatggcactaagacaaattcaaagacacgaacatgtgttttgagaatttgagaatttagggttctagataacacacctgtacaaatttagagcccgcaagtgtacttaactaaaatatatacactcttgttcatatcaatatatctattaattattttattataattataaagacaactcgaaaaggaaacaacgtatttgctatgaaggcttgaaaattaccatattaatcgaaaaaaatctaagccatcattagatcgtagcgagacataagtagacactattataactacataaaaacaaaagaaaaaaaatgaacattaaatttaatcatactttcaatatctaattatacttttatatgtaagagttgcataacaaattcaattcaataaatttgtgcgccgcagtttttatttaagtttcgctcacgattaggcggaccagcgagggcgtgaaaagctacgagaaggaaaaaaaaaagagctactagtagtactaataaatcaaagagatgatggcataattaagcagcgtgagctgtgacgtgagctgctctgaatctctgattttatcataaaccacaatcccgggcccacccgtcatggaccatcaaataaccgatctccctggcccatgggccccgccctcccagcacggcacaaccc

SEQ ID NO: 59118 - DNA, 9196 bp, Oryza sativa
acacaatagtgtcacagccagggacatcatggagggtgatggtcttgaggaataacttggtactgtggtggttcttgatgatgatggcccctggcacaccatgcttgtccatctcccagttgaacctcactgtgagcttggactccccttgtgataccgatggtaaatctgtcaacccctgctccagattcgcctctgatccaactatccccctgccctcattgtctgcacatagcatataagacaataggttagtcacttcatttgtgtcactggccgttttcaccttgtttccgttcaatctgtgctgagtactgagtactgatccttgattctttctacatagcaaacatgtacaaactcatgcaaagtaagcgaggaagaaatggagaaagatcagtactttggtcggcaacagtggcgctgacaagctggcaggtgatgctgtttccaaagacctcatggacgttgtcgaggagcgaggcagtgaagtcccttggatccagtaattttcggctcatcagcacagccaagcctttgatcttatttccatttttccctgtcagcttgtccttgagccctcccagcattctgtgatactgtagtcagtgacaaaagaagctatgttggtggtggtgtgtgtatgttgccgttgcaatggatggggaagaacttagcaatgcagctgagtttttatagaagggggagagggaggttcgcgatgtcagtgtgcccatgagtattggctactaatgcgactatgcaagtggatactatgtcaagtggaagaccgaaccccaaggcatcaactagcccattcacttggacaacacactgtaagttgctttcttttagtcgagaattgtagagatatttctcctgttttgaaactttgaagagtatcacattttagcttgaaaattttttagggtgtaaattcgaagtctaagagatcgagctggtcatccttgtctcacagccttgtcaaaatattaatacttattcccttgttgatagaaccaggcaagggttcgacatttttgagtcgtatgagctgggttcatattggcattgaaatgaaccatctgtatgtgaaccttaccaactcttggctcttgaggtgtgctgccaaaaatattcgaacagttttcatgggtgtgatacacattggcctcctgcctagtactagtatatttctacattatcctttttattatgaggtttcacccttagtgatcctatagaagttatggcattacattagtatcaactgtcatttacagtaaggtgttaattattccctattggcctcttggctttacttgctgacaggtccacttcagctgcacagtatactggataagcactgaacgaagactgtattaacttattagcagtttgaaacgtatttgatgcccgtgccaagcaactaaacaagaggccttcgaattgtcattgacgaagacctgagctacgggcctaaggtgtgtccatgttttactccagtttggatcatgtgaccggcatcttggatcttgccaattgcagtcccagaaattcaggtaggagcaaatgaaatgaggagcatatgcaaattgggactatctttaggacacgtttgcaggcaggattatttttgccgtttatatgggaaatcgagctgatttgaattagattcctgtatttggtttcatgtacttgagttgaatgcgcttaaatgcgtccgatttccataggcttcagtagagcgtgtttaatgttctttctacctccaattttagcaactctttgattctgtgcgcatgcagcatatttcttccaaggaagtacacctatcatgaaagattcgttgtaaaaatatgaactaaaatcgaaccttccaatcattaataggacttctccagatttgaccactaacatggcaacacataataagattaagtagaacggccatgtaacgctttgaagcaaatgtaacacgtgcctttttcattagcatgaaaaatactattcgaacatagaagtcgccgagagttctcaagccccacggtacatattggcgaaacccatatttcaggacatagacaagaaaagtttaacaaaagctcaatggacaatttcacgataaagatggacaccagccgaaaatgccatgatcataacatgagtaattcgtcatacttatatatgtaaagaaagcaattgctatggatttcatcaagttcatcacaccgagaaaaaaaaagatgatacattacatatgttcacaaattcacattattacatgtacagagggtaaaccacatatatattgttcaagcggccaaacaggtagtagtgatcttccaataacctgcatcattatgccatgcccttatcttcccattgaccttacatgattacatctagtggcctgtttgttgccgctcccaccttaggtcctcagagtactccatcatggctgcccttggatcaccgtctgtgacagataagtagtacgcagcggcaaatgccatgcccttatcttcccattgaccttacatctagtggcctgtttgttgcctctcccaccttaggtcctcagagtactccatcatggctgcccttggatcaccgtctgtgacagataagtagtacgcagcggttctgtcatcggtatgcaagcttcgcttgactgactccaaaatccttctgcttcgtcgttctgcagcagcagtgttcgtcgaggattctgcttttccactagggcgtccctggggataaaagactgcaacctctcttctagcgttataatccatctcaatgtagcatgtgctaccctgaagaatttcaggattgctgatcggtatcagaagcctctccctcaagtagatcccatggtcgctcatcatgttgttgaaacgttttatatcggtcacctgcttgcaattcatagagcaccaaagagtgaagaacgttgctcacacaagcaaagtgcatctttgtggaacaaaggagacaagtgtgcagaatggtatagataaacagaattcacaaatgtacaaagtaaagttatgtatggttttcaaagttcagctgcatcaactattaaagagagtattccagcaaaattcacaccacacaaatggctatatctataatcaactctacacggcaacagatagaatctagcagctgaaggtgcataggcattgtgcagcaatccctaaataatcttctttgaacaagagtgaatctcatgaatttgcaactatcattaacagtttagcacatagcaggaatcgtccaacttttgcacagtcaaaaattagtggtgagctccacaatactgagaatggccaaaggtgtcaaacgccaggtcctagattatttaaaccttaaaaaatgtattgaattgtcgtgcttgttcttatggctacacattatcagcgtctcagtgactagtaacctttgttcatttcattccagatgacctcccttctcagcaaccactcagaatattctaagctccagtgtctccatctttggataaaaagacatgttactgttgtttaaaactatcggttgtcaaaattaagtgctgcttggatcttccacggggtaattaggggcaaatctatatgagaatcatacccttttgtgtataacaagaaggataactaggcgcaaatatgcatagagctagcgatagagccataatcgagcatcagacgggccgatggttagtacctggatggagtacttgagcgcgatgccggggacggtgtccccgcggcggacggtgtgcgagagcgcgaaccgggcgagggacgcggcgcgccagaaggccctcgtctccggctcgccgacgacgcggcgcaccccccagggcgacgcgaaggcggcctccagcacggcgcggtcggaggcgaccccgcgccacagccggcagacgcacgccgccctcgcgaggtcgggcggcggcagcctctgcaggaccgcgcgcaggaggtcccccgggaagtcgttgctccccccctccatcgcagccggggtacgatcggggcaaaggcaaagacggatcggagctcacctcgggcgagaggaggatggctgtggctgggggcgatcgtgcgcggcgccagctccgccgctaccgcggccggtggaggatcggaggagaggagggagatcgcgaggtgaggcggctcgcgtgcggtggcgcggccgtggcggagtctgggatgatatgtggtgtggtgttgacgagtggtgtgcgtgcacggcgcagcagccgccgcgtttgcttaacgatccaatttttatctgaaaaacaaaaaacataaatacgacggtagtagtattttaacggaatagctaacgcgggcctagaaaaccatgactaaatttagtccctctcacatgtttctgtgagagggactaaagtttagccctactttagtccctccaaccaaacaccacctaatagctaatcttataataacagtagtctacttataaataatttgttcgagaagtttaatattttgaaaagcagacggttgacaaatcagcttttgagaatttgaaaaactatgttttcctagctttggacttttagcttatttttaagattctaccattacaacttctcaaaatctaaattaaaggctgaactatttgagaagtttctaattctggaagaaattgaaactagaaatttctacaaaaagatcccgaatcttataactatgattaccacaagtagatcgtaaatcttatacctatgtattgtaccgatactaagggtctgtttagtcggtgaaatgaaaatttttggatgtcacatcagacgtttgaccagatatcggaaggggttttcggacacgaatgaaaaaactaatttcatactccctccgtttcacaatgtaagttattctagcatttctcacattcatattaatgctaatgaatctagacatatcccacattcatattaatgctaatgaatctagacatatatatctatctagattcattaacatcaatacgaatgtgggaaatgctagaatgacttacattgtgaaacggaggaagtaactcgcatggaaaccgcgagacgaatcttttgaacctaattaagccgtcattaacatatgtggattactgtaacacttatggctaatcatggattaattagcctcaaaaaatttgtctcgcgatttacatgcaaagtgtgcaattattttttggggcaattgtgtttcagtccttgatttacaattcaattgtgattttacccttactttttagggtttgtgattttgcccctgcttttatgaaatgaagcacccgtctgcctctggttttgacataagtttggtgggcctgaaatttccgaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcgcgcggcggagtcgggcgcgggcagggaggtgcggcggcggcagcgtcgcggctggcgcgcgcgcagggaggtgcggcgctcgcgcggctgcacgcgcagggacggcctttggaggcgccgcgacgaggatgacggcgaggaagaggacattgccgtcgacgagagggactcgctcgggctgccgttgccggtggtgagcaactgctcctcgtcggagtgtgagtacatggccgagtcagaggctgagctggcgaagacggaggagaagtgcgcgtcggcgtcgtcagcgtcggagtacgaaaagacgtcgcagtcgagcacggggagcgtcgccttccatggcgctgccgacgccggaggagacgggcataaggtgagtgttagtgctgcttctattattctgcgtttagttagttgggatttgggatggcataaatacaatggtgatcgatcacgatgcccatgcatgctgtgggccaaaatcatccatgcaactgttcgtttatcaagactaaatctctatcacgagcaaaagtgcaaatatttgtcactttttatctccttttttctaatcattaggcattagtgttcgttttgctctagaaattatcattgaatgccaaaacatttcaggggtatatttgtccattcaccataaatttaacaccggtaccattagttaacaaagtaggggcagacggctacttcatttaaaaaagtaggggcaaaatcacaaaccctaaaaagtagggataaaatcacaattgaatcgtaaagcaaggatagaaacacaattgccccttattttttttatctatttttaatgctccatacatatgtttaaaaattcgtgtgatgttttttaaaaagtttttaggaactaaacagggcctaatctggttcatgtctggtaccatagtaatagaactggtacctaccataccgtgctgaagttacgttaatgtaattccgttcaacggtacggcgttatgtggtatgaaaatgctcctcttcgaacgttcaatcaaatgaaaaacgtcggatgcctacgaccagctcagttcttacatgctaatttctcctttctttatgttgatgccagggaaatgctgcaaatcagcagtctggtggattggacgaacccttatcgtactgtaatatacatgcacatgcctagttgtttcttttcattctttcctcctctctttaaatattttttctcctaaattacttatccgatctatggaccgatcacaccgttgtattcgttgcaattaaatatttacaataagatattacatgattatattatgtcaaaagaaaaacatgtgtttcaaaccattaaaacaaaatgtttcatacgtgttagtgatatgtttcaatatgtgtcttgtttcacaaaattcctgaaactacctgctactactctctctccacctcatgcatgcatacatgcatatgttttagcaagcttcaaaatgatttttccctcaaattacctattcaatttatgatccgatcactacattgtatttgttgtaattaaatctttacaacaagatatcgcttgattatattttgataaaagaaaaacatgtgtttcaattcgttaatacttgttgtttcatatgtgacagcggcatgtttcaacgtgtatcttcaccatatttcataaaatatctaaatgttccaattgctgattttctttttcaccatatatatagcatcatgttttacttgttggttaactgcaatatttaaccgttcgatttttttttcaatttaaaaatgtttcacctaatatagtcatgatgtttcattctgtaatgatcaaatgttaccgtgaattgaaacattctttcgctattcgctgaaacattattttcatataagatgaaacagcatccgataaaacattttcgatctacttaatgaaacaattccgatatacttggcgcaacagcgtgcaacagtaaaataattcaataataagctaattttttttatcggattatattcatgtgtggacttgttttaaaattttaattgcaatgaatttaatggtgtaatcggatcatgttttggataaatattttaagagaaaaaatagtctaaaatttgtttaatccatgcatgatggatggctggcgcacctgtgcatggatcgaactgtcgcgcgagacgtccgatttttcgtttcgcgccgtacgtccgacgcgtagcattctccgagtactcgctaaaaaaatgatccaatttgggattcacactcgtgggtttgatgagccggaagggagcacgtcaaagtggggccagttaggacggcccattaggcccggaggagcgcctatctgaagtccaacacccgtccaggcaccggctctccgccgctcgaagcttctctcttctcaccggaatctcgagagcacagcgccgccccgacgacgagatccctcaccggcgccgccgccgccgcggccaggaggccgaggggccatgacgaccatccgccggttctgctgcgacgacctcctccgcttctcctccgtcaacctcgaccacctcaccgagaccgtgcgtccgccctaaaccctcgccgtctcctttttcttctcttgatttcgagcttacccgtcggtatgctcgtcgcagttcaacatgtccttctacatgacgtacatggctcgctggcccgactacttccacgccgccgtcagccccggggaccgcgtcatgggatacagtacgtgttcttgcccttgggggcggctgggtctgtgctagctgttgctagtgattctgcgtctttgtttgtcagattcgctgaaattgtagagtaaaccctgcatttcctctggaaaacatgagaatttagggatcttttgggcgttacagtgcccgattggaatgtggttcgcaggaaatttatgatttgtggaggttccagtggagtctaatgtaatcttggtagtactatttatttgccgattaggacttattatttgcctctttgggaagggtggaacactatgacctgaattgggagcaggcgagcatgttgttcatagtagtgttaagagtaacccttttagtgctgaatgcagtattctatagtggagtattgagatgattcacctgtctgaatagatgagcactgtgcaatattctagtggatatgtataatttttaaaatttatatattttccaagtaatacaaagttcacctgcaaaaggctatggggtcagttgaccccaaatctgcatttccaccattgtgtaatgttatgtctgcaatatttcttcctcctccacattctcctagtttagtttatgtctttgtggccattcatttatttggatgtctgttgcagtcatgggtaaggttgaaggacaaggtgaatcttggcatggacatgttacagcagtgtctgttgccacagaatttcggaggcagaagctagccaaaaaacttatgaaccttttggaggaaatcagtgacaagatgtaagtatctcaactatgactatccctatgattgaaccttcacgccgatttggtgattgtaaactatactgactattattgaattttgtgcttattgtgcataaacaactgttcatttgatatatcatgttcttca

SEQ ID NO: 59119 - DNA, 19087 bp, Oryza sativa
tgtgttttgcgaagcggttccctgtgaaccaattacatcttggttacgagcataccttgcagaatctgcgtagttagaaccagcagattcagatgatctaggaagtcgccgtggatctagtgaaatgctggagtgcgtgctgtgacttgcattcatacttttcaaagaggttgccaggtgatagccatgaatggtagcaggttgatagaactgattgtcagggtaagatgggacattataatttgaataaaactgagtattttgttcaaacaaggtgctagttggccttgggatgtcagcattagataaacgcatgctctcagaccagtttgatgatccaatgcgacccatctgaagcacaaaattaaagcctggactagagacttccttagcacgtgagtcccatgatttctgtatggtagctgatcctcgtattgcatctctcatcaaggggctcctagaagcttcgatggcttggttatcacttctaactgctttcgggtatggtcctagcagaaagttgaaccttcctgcattagcttcttgcgttagcttaccatgataatcaaagagatgtccccagaactcatcaagaatcgctgctaattgcctccttgctgcacgacccaaaccaggcagtcttgagaggttactgccacgataaccagcatcagagtctctccccttgctcaaagtaagagatgttgggtcatcagaaattggaggtgccttgtttccagaagacttgctgacttccgcattataagaagcctcagtatcatagtccatgctagctcctgcttcttcttggacatgctttgaagttgtactcttcattttgatgttctcagcagtgttatgttctactactgtggcagtacaaacctttggcactggttccgtctggtcaataactactgattttggttccttatgtttgatagacgatgagacctccggaataattggcacaaaagcagtaagctgctgagtgccatgaccagactccacagtgatgtcaggaaagtcattatgctccaaagctgatgtttgataactttctgatgaaatcctgggaatagcattaatagtagaagtcgtatgatcttctttctgttcaaccagagaaagctcctctctatgataaaaagtatctggatcttctatctgagagtgctcagatagctgctgagtttcacgttcattacttacttctatttgataagtagtatctggatcttctctctgagagtgctcagatagctcctgagtttcaggttcattacttgcttctctttgataagtagtatctggatcttctctctgagagtgctcagatagctcctgagtttcaggttcattacttgctgacttcagtggagtgacagccaggaacagcgtaaaagtaattgatgcacaagaaattagaactacaatggcatgcggaagtacaacagggcttccagtgttccctttcaagttgtttgtccaggtactatcaccaaacaggatttccgcagcaaaaatgatatttgtgaacagcaaaagaagaaatgctaggatggccaatatttcaacgtacaaagatattttatatctgctcattataactcttgatgaggaaacacggaaaacaggaataacagatgaaggaaggaacatagcttggataactgggcagataatgagtaactgatatatcccttcagaacctgcaacctttgcatagtacatagtaggaaccatggcaacggcctttagtagcagatgatgagcagaatgaggcaagtttacaccaaagaaattcttcaaaattgcgtggctgccaataatagatgtcaatgagatgacatgactcgaaaagataaggatcactaaaaaaacaattggtgccatcggattcatgaacatctgcagaaggcattcagaggaactcatgaaggaactatggtgcagaattcatactcaaaacaagcagaatgcaaactggaggcaaaaacctggttcattaaatctacagaatcttgaaaagtaaccagagtattattggattcaactgctgctgagcccatcaggacataattcacaaggaaaaccccagtgaaaataaacaatattgagaacaggtgatcgtggaacagagcaccaagggaaagagttgtagattgtctttggccctgcacaaatgatttctgaattaacaaaaacatggcatagcagatagaacaaaaggtaaaaaataaaaaaggaaaatggtgtgggtttacgaaaactgcatggcacggagagcacaaatgtcaaaggtacagtagaaccgacttacacgttttatgacaagtttaagcttcagaaacaaaaaactgtattggatcccctgactttctattagttgattgtagaaaaggcatataaatttaaaatgcaggtttagtgatcatcattgcttagagaaaattgcaagaaatttttcatgagcaaaagaacaaatcaagcatttggatcaatctatgcatatttttcttactcttttcttaatatggaaagaatgtactacaaagttgcaggattatgcttgcacatcttagcataggatgcatgattctggtttgccaacccacacaccagtttctattatcacaccacaaagttgcaggattatgcttgcatggcttagcatgaaccagaattagcttccttgcagatttcaaaactaataccaatcatgtattagaaaacacaacttaggaaaaccggttactttaaactacagcctggggtcaagtcaacctgtgcaaaccagaaatcagcaggctcagttatgtgattagcttcatggccagcaagattgacattgcccggttttgaacagtccattcaaaacctggattgaacagcccaaccttaaactataatgccaagtgtgggaaatttttttaaaaaatgagggacaaaataggttctaccatttttccaaaaattggcaagtaatgaactgtcctcagaattcatggactgatcagaatagttatacaagttaaagaagtatttactcatatatataacttatgggtggagtacaagttcaacaaaagccactatctcagcatttacttaagcatcagcataaggaaatggagcttgcctgtacaactgatgaatgaacataaaaattgtgcgctattacatttccgccaagaagcgccatcaaggaataagcactttcaccactcaacttggggaacattgcattcatatcaactggaatttttggttgactgactaataaaccaagcacaaaacaaagaagtgcaaagcctgctacgcatgcattcaatgtcccagccatccgtttgccctagaataaagtaaaggcataacgtcttagagttgctcttagtggtgcagaactgcagatattctgagatcaatcataagcttaccagataagacatagtgtaaggtagcaaattgaccacaacactagcaaaatataagcctgcgataggatcatcatattcaaagaccaggttgaatccgactgatatgcctgaaagctgaaataaccaagtattaaaagtttgaaagctggcaaaaacctgaattctctggtagtgaatgctcctataggtcaactatgcataacattggtaaattaactctagaacaaagaattaacaaaaaaaaaaaagagagaggaaagcttgtctaaagtgtatgaacataccatggttagttccgcggttagcaaggacaatcctgcctgaataccaaggatgacacatattgatggactgtactcctcgcggcaaatcttccgttcatgtaatattgttacaaaagttaacagctctcgaagaaaatgatagatgacgaatatgaaatatcaaccacccccctaaagaaaaaaaaaggaggaaaaattgaagaactcccccactattttttatgtggttgatgctatctgagtaacactaaatacttccacttaggaaaaaaaggtacagccattcattgagctaaactgaagaaatgtgagtaggtgacgacagatgtcagcaaagtggtacctccgcaagatttttcccagtgaccatgccgatacacatcgacagatactggcacagaatggccgacaagttgaaaagcaacaccagtattacgagatcatagccaaaccgagacccggcatctatcgtttccacccacttcccaaggtcaatataccccatcgagatcaggagcaccggtccaagggtacgggaaagatgatgccaaccatctccagtagccagagattctataccgtgcacaccttccattttttgtggcagcaaatcttataacaacaaaagatggatacgaatccacaccactggatcaaatgcccgacatgcttatcaaattcagtcccttgaacactgttaactcaagcagtctaatcaaaccctccgaagctggtgaacatctagaacaccatgaaacacctccaagaaggatcaaatgcttatccactcaggtctcttcaaagctcttgtggtgatcgaagaagtctaaccatccaaacctgggggacatccatccacaacaccatgaaatcctccccaagaagcatcacatgcctgaaatgactaccaaattcagatccctaaagccctcctgttgtgacccaagcagccctaatcaaaccctccaaagctggtgaacatccacaacaccatgaaatcctccccaagaagcatcacatgcctgaaaaatgctttaccaaatccaggtcccttaaaaccctcctgttatgacccaagaggccctaatcaaaccctccaaagctagtgaacatccacagcaccatgaaaaccccccagggagacacccctgatctaggttgcccctgctctaagctccatccatcacagccaggggcggacctagcgtggaccatagatgttccattcaacccaatcccaaatgctttggagaacaaaactggtatacctagactactccagcacgcaggagcacaccattcggactagattgatttctcgcaacatacaggagagggatatacaagagattcgtacgcaaaaaggaaaaaaaaaacagaggaatccaagctgggggggctttgccgcggcaagaggcggagatgaatccggtggaggtggtggcagtcgcgctcgtgctccggtggcggagagcgcgtggaggtgagagcggctgctaggtgaagtggatttttttagtggaactgtggaaagagaggatgtgcgagcgcgagaaaaaagggcaaagctcgtgctatgcccgtgccttttttgtagattgtaaaggcctgtttaggtggtgtttggaaaggagggacaccttagttccctaaactttttttctcaaaaaattcccatcaaattttagacacatatataagcattaaatataaattaaaaaaaattaattatacagtttgtatgaaaatcgcgatacgaatattttgagtttaattaatccatgattaatcataagtgctacagtaacatatatgtgctaatgaaagattaattagacttaataaattcatctcgcggtttccaaccaagttatgaaattagttttttaatcgtgtctgagaactcattttaacatccaatcaaaagtttaatgtgacacttaaaaattttcttttcaccaactaaacacagcataaaatgagcaagcataatattctccagaagaagaccgcggccgaatcagattacggcggagtcgagacgagggcatatacgcgatactacgcctggtcccgtgccgaagatgctgccgaattaaccaaacacacgccgttgtctcctttgtctctcgggttccatcaaaccgctctatctcggggagttcagctgcaaaagcgtgcccacccaccctttcctgttttcgtcgtcgtcgtgcgtaggagaggcacccttaaacccatgcaaaacctctaggagctaaagtagctttgcacgtgtatgttgagcaacttgaccacgttcacctggggttgtgagttcgtctagctctctgctgtgctgtgctcccaccaggatgagcttgcagacgagacgacacgagaaaatcagtcggcagcagcccatgctaggtcgcaggattatggtgcctcctcctcgtgagtttggcagcatcccacgcccacgacacacactcgtgtctttgtcatgagcaaagccaggggcatcccggacaaattgggtccccgtgcgaaatattaaaatggatcctagtggcctagtaactgaggagaggagacgaagcgacgtggcgttgggacttcgacgacacggacgactgtacgatggaaattggaaaatggatcattcaccttttgcattgttttgggggcttagttttactaaaattgaagcatttaatattattatatattgggtatacttaatattttagggcccttgaaatttgggggccctgttcggtcgcacagcccgcatgggcctaaggacgcccctgagcaaagccacccgtcaacaatgaagcacgataacatcactaggaggagatcgtggcaacggtcaatatcgatgttgatggctaggtgctaggacacggtgttataagcaacaacactagttgttacctatgggtactaaccagatgatgtgtcatatgacgtacctacacataaggtgggtgagaaacatgatcgcttcaccatgttaggtgccaatcaaagctccatatatagcagcctcatggtctccttttccatcaccaatgacaatttatgggaggaggaattcgtgccggtcggtatcaattctccttgtttgcctcttttctgcatgagagtcaaatccggtgcacatcgtcatgccttaagcatgagacggaggacggggagttgaggaggccatgggtccagtgacgttcatcgtccttgtcatcaatgtgcgcttagactttaggcctttaggtttaatgctggtggcatgtcccattaccaccatgtgcgctcagactttaggcctttagatttaatgctggtggcatgtcccattaccaccatgcctattcacatactccctccatactcataaaggaagtcgtttaggatatcgacacggtctccaaaacacaactttgacttcttatttatataaaaatattcattgaaaagtgatatatgtatacttttatgaaagtatttttcaagacaaatctattcatataatttttacattttcaaactaaacaacttgagagttattcatgatttatattcccaaggtttgacttaaacattgtcctaaacgacttcctttacgagtacggagggagtatcaaatactttatccgtttcacaatgtaagtcattctagcatttaccacattcatattgatgttaataatctatatagatatatatgtctagattcattaacatcaacatgaatgtgggaaatgttagaatgacttacattgtgaaacggagagagtatctaagtatctatggctaaggagggagaagaagaaggggagcacaggaggggaacgactggagggagtagacgggggaagatgagatggtctgtcattaagtatctcgttgtcaagataagagtttcccccatctgaaaatttcccattaatcaaggacaatttactgttggactaggatagaggtaaggtagaagagaagattgattttcaatattgaatatatagccgcgtgaaagtatcttttgtgacaaatttagtagagcttttttaccacccttgaaatagtaccttgaggtactagtaatgggaggtactggatcaaatccaatcgttcatttagcagggtgaggatggaccagatgaaaaaacgagagagagagagagagaactcttatccacagcataggtccgtgtctcttctcccatcaccttgtcgcaccggcgacttgcaacctgctcggctgctaatctctatctgcaccgcagctgccacaaatctctccccttccttgctctggccggctgcgctatgcgtcctagcttcctccccttcaacgccatgccgcgccgttcctcgccgctctcctcttgttggatgcagtggcaagcgctgcattggaccactgagatgcggaaaggcgccgcggcagtaatcaaccagccttcacactacgcaaccgcagtaatcgatccagctccacgcagccaccgtgtaggaaggaggccgacctgacgtcgtcgtcactcccgccgaggtcgggattgagaaggttgctttgcttgtttgggctggaccgctggagacgcagacgctcctatccactagaatgaacgaatgtgaatgctaaaatacaatttttcccttccgctcaagtattgcatgcggactgcgaggaggtaccgtgcgcacatgaaacttgtacctcctgatactaaatcttgtcaacccttggatctggctcaatgaatggatgggattttggtacctctcaccctcaagaatgataaaaaagctcaattgtgcattctaaaacgacgttgtttcgctatttgggaatatatggatcataaaagttgaaacaaactctgaaagcaaaatgattttattaactttcattattccatgtgaataattcctaatgaaattatccatgcctcaaggttactcacatttgcaacgacttatccctgagaccctgaactacgaagaatcacggtaatgcacactgatacaaacaatgaaacaaatcgacgacggcaaacgcgcaacactagcaatagcacacgtatatcgatctaaagaatgcacgcgagactcagatggagatgctgttggggatgcccatggcggtgagcccttggcccttctccttggtgacatccgacgtgttggggtacagcagcatgtacggcatcttcaccggcccgttccggttcttgagcgccgagttgccgttcatgtccttgatccggttctcgatatccaccagccggctgccgaacctcttgaacgcgtccagcgccttggcgtccgacgtccactccggcgtgtcgcgttggccgaggtagacctcgtcggaggagtgcttggacaggatctcgatgagcgagatgccgaggatggtctggaactggctggtgattgtgtggatgaacaccaggtcggcctcgtcaccgccgcgctccagcttcgcgtactcctcggtgcccggctccggcatcggccgccggctcaccgtcggccggttcgggaggaaccccgcgtacgggtactggccgaagttgaccgccgcgtgcagcgccgacgcgatccagatgatgatggtgcacgcccgggtgagctcctggacggtgtccatcttgggccaccagtcctggtccttgaggtcgccatggccgacctcgcgcacctccttccaccacgcctgcagctcctcgtcgccgcggagcacgccgtcgttggggtagtagatggccaggtactcgcccacccaccgctcgatcgcccaccagatcaccagcccgtccacggcgtacgggtagtccttgatcagcagccggacgttgtacgggctcgtcgggtccggcacggccacccctctgcacacacaaaagcaaaacccatcctggtcacatcgttgttcttgccgtgttctgatcagccagagctttgcaagatgtcattcattttggttttacctcttgacgagatcgacggggagagcctgctcggtgaacttccagttcttgtacacgacggaggacatctcgagcgcgtacttgcctgggaagacggtcttctcgaagatgccatcggcgttgatgagtgtctgccgtgccagagcgttgatgttcatcgtgtcgcggtagtgcgggctcagcagcttgtgcacggggtgcaccacgctgagctgccggttcgtcgcgatcacgaacggctcgatcacggcgtgagtgttcagcctgcagcagcaacatgcaaaaacatcatgagcctccttttcatactccaacacagaaaacgaaacagaggaggctggctctgtaccagtggctgatcagctggtgccaagcagagtcgttgacggaggcgtaagccttggcgagctgccagatttggctctcgacgccggtgttggctggagtgtacaccttgctgacggcgccgtgctgctggccatcggggtgcggcaggctcagctcgatcgccaggggcttcagggtgccatcgtccttcaggagcagaatggtcctgctcgcatatatgaagttaccgtccaacttgttgatcttgtccaggaacggcatgaagtgatcgtggtggtctaggatgaaaagcctgttgcccttcagtgcctgcatagcatggttacttattggtcaatctcctgagtgtatgcagttctagtatagtcatatacgagttatttgcatttcaaagatatagcatgcatgtttagagctgaaatgtttcgctttgtatgtcagtgattcagcatacattttgcaccgtgaggccctccatgttgtgcttaatgtgagcttcggtgatcttgctggtatggtcaccgtacacatttggatccagagtactttttgccgggaaattctatgatcagttggagaacaaaaaaaagattactcactccattatgcgagcacagatgcacatacttgcatatcctacaacgatgaagttactaaccgtcagacgcttgatcatcactgggttaactcctgcgagcatttctcgtgcaaactcctcatcagtcctccaagcaaatttgtcctctgaaacatcataaacaataagttgtgataataccaaatatgaacagaatcaaattacccaataaggtataaccatacagagttatgctcatgcagaaagctggttacctttgataacatgtggtaggggtaacttcaagacttgatcgccagcaactggcaaaagactcttaataagttcaaagggaactctcttcttgatctctgctagtgcagaggcattggccactttcaatccaccttcatagagttccatgatgtcttgaaaagaatcaaactcctttggtgtcgtatcgacataggtccttattattgggagaacaccctcaacaatagccttaagagagtacccaaggaagtctgacatcttgaggtgcccgaaccgttcgtcgcgtgggacataaatgttcaagtccagcagaggaagcctgctttctgtatttgggtctgagaaaatattgagcaagaaaagaatttgagggaaccagttgcaaggtgccataaattcaaattgaagaaaatgcatgatatctataactcaccagtctttgttggggcccggccagttctgcctcgacggggataggggagttcttggctgccaccgaggactggtcgtactagtttactgcctttgtctggttggccaaggtcgttatagtaatcataacggtagatacggtcatgctccttgtatggtccaattttaccgtcccctcgtagaatgttgagttcttcttgccggtaagggatcaaaggtgcaggcattttgctaggcagatatgtctgcaaaacagcaagaaaataaggcaacagataaacttagtaaatagaatgagcagtttcagtcactcatcaagaagataagctgacaggtgaaaaccctaatagcaggagtattaattaatcaattggaaagtgaatttatattactataattaatcaattagaaagtgaatttatattactactcatgctttaaaactgaaagaaaatacaggcagtatcaatgacctccatttgattgtcagcgaggcagctattacttgtttttttttttcataaacaaaagaaaagcattcaatttttttatttctatcaactagttgtagatcaagcgattgcatatgccatgcatgatacataaacaaaagcttaattaaacagcacacaggtgagtggtgaccaagctaaactattcttttgtttgcttgtaagaccaggtcgctaatagggacgaacgagcggttggtggctttgtgtctgtgggcattcagtttggtgttgtctaggacaagtagcacaagacgcattcaatcattttgaagaatcaaacaaaaagtggctagtaaaaggactgtcattttcaaaatggaactcagcaggtgtaattttctagctatgtgatgtcttgcatgatttgacagtaggaatgtaggatcattttaataataaagactagcatgtaccattcatgagttacgagtagttgtcgatgccataacttgaaaaagaacaacttcatttttatacagccaattgtagagtacaggatgttatttccactatatgtttattgtgggaagccctgaatcccggacatcactatggacagttggacggttgactagactgcagcaccaagctcaaaaactgctagtaactcaacttatcagctgttctatccaactttctttccctgttgtagatcatagtggaagtcaagtcagcttctatactcctaacctgctgacagactggacaaggatgctatctattaatctataggtgtagtaaattaagaaaagatacgatcaaattctagatcacagttatttccaggagacaaggtggatatgcatatgctatttggatctaggtacagctatcacggtacctaatccaacaaacacttcaaaaacgaaagttgaccatgatccaatatataatccataaatatatgttatgacaaaaaaatggcataggtttgtttagcttttcaaggatttctaaaggcattgcgatatctaaatccatgagttggtgatagccgcctatctccagtcactgtagaggcatttacatattttcatgcacatgtaagatgtcatatgtccaagattcatactgttcctgatgtttctattagtatctgcactctgcagccatcatattgtctgcagaaagtggtcatcaattattgtaccatcgtctgcagtaatcaattttctaagtgacgtgtccaagattacttggcatggaccatccgatcagaaaccctcgttcagtgcaattatgaaaactttgccttgaatttttctaagtatcatccattatcatcatgcattcatggtcggctgaaagacccccacctgaacgaaaattccttactgcaaccaaactactgaaccgtacatagttcatcaattgcaaactttggcacaaacaactatgttctcgtattgattagaccactagaatttgcatgttgatttcaatattcctaatagcaagggagctcaaggcttatatagttaatgtcagcggtttagctcaaggctcttaagcaagttctcatctttctttagcttaagatgtagcggtactgctcattagcaagaattaactatggtctttgagcaacactgcagaagagcagtggcattggcaatgtccatctggaaatgaaaatggagtagtactactaggcttctactgtaactaagatgaccgttgaccaagaggaggactaggagtggactcacatcgttggcgaagaagacgcgctcgtactggtagttgtcggcggggtagatccacgagttggcgacgaagacgacggtgcccttgccggggacgccgtcgagggtgagcgtcttgaggaagaactcggaccggttggagttggtgacgacgacggcgccggggatcccctgcgactcgtcccactcgaacgccacccggaacaccgactcccccgccgccgtcgacttcatcgtcaccaccagctcctccaggtgcgccggcttccccagcttccccctccctccattgcctgtccatccacaaaaattagacaaaaaattggaaagagatagaaagaaaattttgaaaaaacagatccatcgatgaagtgggggacaaatcgacaggacgatcaatggaattgggtgtccttttcttgatttgatttaatcacatttaatcacatttgattgtagattgttgaggggttaagggacgtgtgttgacgttgaccgtcaatgctgcctcctcccatcactccactaattaatgttcccttcctttcttctctacggaagtagcattgaatgcgtgacaacaaccaaaccgcacacttcaaatttgtactactactatacgctttttttccgaggaaaagcttgcaaacaacgcttgaagactgcaaataccggtttgtaattaagctattagcgagagcaattaaacggaaaccccagccagagaaaacgcggctgtttctcctgttcaggaaacgaatcaaccaaccaaccaatcacgccgaggcaaaagctttggagcggaaacacgcacacaccaaaaaaaaaaaaacacgaaacgaaacgcacgcacgatgagcgttttgctttggccggcgagcggcggcggcggcggcggtgcttacttgggtcgcgggcggtggcgctgacgaggcggaaggcgacgccctccttgtggccgaggatgttgtggacgccgtcgaggagggaggcgtggaagtcgccgaggccgagcacgtccttcttcaccagcaccgccgtcccacggatcctcccttccttccacgcctccttgttcctccccgtcaacctgtcaaagaacccctgcacctgcatcctcgcagatcacaagtcacaatcccctcctcctcctcctcctcctcctctctctctctctctctctctctctctctctcactactctgctaaagccggaaagccaagcggaacgcggagcaagagcgagacgggctgatggagagagagacgaagccgcggtgggattttatagcgacgcggccacggccaccagccgcggcggctttgtggtgcccgcgcatcgccgtcgcgagtcaccaaagcggaggagttcgtaacagggaaactattggatagtaccatcctaccgacatcccttgttgttggtatgcacacttaaataattattaaacttttcctcgcaaaaaaaatattaaactttttatgaaaagatagattaatataaatcgcttcacagacattcaaatttaaatttaacttcaacatattataaaaaaattaactataaatatgcattaattattgtttaatttaccttttttaaatggtataacttaaaatttgatatatcatatgttaatatatcttctcaaaattttaattttaccattgttttttaattatttaagtgtgtaaacaattataaatatctcctattaaaatccactctagttcataatagtttttgtaaacgttgtgtttttgggatcgattcgcgagaggctggccgctggcgcgcgcgggcgggcgggctgtggcacatgggcggtgtaccggtcggcggtcgctgccatccgccgcgcttgatgccaacaattgccgggttgactgtccaaatggtggaaccaaaccatggaatgatcgaatgatcaaaacgagggaaatactcggggtgtttcgccgcacaccagcataaacacccgtgtgccgtgtgtgcgtgtgatggataaggataaatgcatcgcaaagttcaaaagagaatttgaacccggaaaggaattgaattcgggtactattcagaatgttgaattttgctgggttcgtacaacgtcagtgtcccgtcagctggttaattcattcttacaaatatccgatgcatcaaacctggcattacctcattaggcgcgctgtggacacggtgctttggcttcttgcgaattttgaatattttacgaacttgtataaaatgcctgctccttccaaggcattcaactccatggaaaagtaaaactcaatatcttgtatgcaatttatgcatgtttcagtctattgtttggttgtttaccatatctacttgagtaaactaacgaagaatcggcacaaactcattagcatgcgtcaccttacccttttctattagaaaaaaaaatgattacacatgcgtttaattcaaaggatgcgacagcaccacctcgagaacgagccacagctactccctcgtaaaaaaaaagacaaactttggatttccgtatccaacgtttgactgttcgtcttatttaaaaaaattataaaaaattaaaaagataagtcacatataaagtattaatcatgttttatcatcaacaataatggaaatactaattataaaaaaatttcatataatacgaacagttaaatattagacacggaaattaaggatttgtctttttttgacggagggagtaaccgtcatcattgttaacacgccattgtgtttttggaggcgagcaagagagatcggatcgatggagactggaagttccgggcctaattaagctacgtgcatgacaagctaagctcatggccgtggactcgatcgatcggaccgaccgatcgcgactaggccggggaggattacgtacaggcgttactcgaatccatgggcgcgcgtcttgactcttgactagcgagggtatacatacaagtgaccgcgccctctctcacgcgcacaaaattaacggtgcacgtcaggtgtggctacgtgccgagggtgagggaccccaccacaaagggttcgacgaattcatgaatatatactgccctttttatggggaaattttctcgaatgccttagaaatttcggccaatgtatgcgcttatattttgctcactttctgataaacgtttggaatttgattttgatttacgttacgtactcattttgccggttgagctttagttgttcgtttaaaaaaaatccattttacccttaagtacggaagaattatagaaattcatggagtacattgttggtacttggtagtgtataagtttattgtatagtatgactttatattcatgagtttgttgtgcggaatattatttatgataaaaatgcatgtcttatattataaaaccactttaaaaattagttgtgcctttaaaaagtaatagaaaggttaaatatttatttttctatttttcatattaaaaagagtaatgtggtataattttttatgatacatacaataggtttgtctaatactaagactttgtttggcgcctcttgttgtggctgcaagcgattgaagaaatgtaagttttatttctatagtagctggttgtacaactatagtcataacttctgaataagttctaaggttgtgttcgaatataaaggtctggaacctactctccaacatgaaaaataaggtggcttattagcatataattaagtattagctataaaaacctgaaaattaatataatttagcttttaaaacatctttcttatagaatttgttgtaaagaacatattcataagattaacgtgctcacgaaaaataagcaagtagaagtttaccactcatcatatgtttttgtaagtgtttctgttagcacaagctcaagtgctcgcttgcttcagcctttagagacgaatgacaataccagcgactagtctactcctcgaaaaaaaaactgcaaattgcttacgatatttcgtatataagatgtattttttaaaaaagcacgtgccatccctttgctgctcatctgaatttggacttaatctcacctgttgagaaacttgagatcatgtggccctgtggcctttgtttacttcgttgacgtactgcagtttattcatccaaaccatagcccgtacctcattggatggtctgtttgtactttaagacgaatacatatacgcagcttaagttgagattaggacaccggacacacctaaacaagacatgtgatttggaaagaaaattgagtacgaaaggagctactccctccgtcccataatataatataagggattttgagtttttacttgcactgtttgaccactcattttattaaaaaaatttaaaattattatttaatttttttacttactttattatccaaaatactttaagcacaacttttcgttttttatatttaatttttttaataaaacgaggtaaaaacttaaaatccttttattatgggatattatgggatggagggagtagcttattagctgccactttgtctaatcatgcaatcatgcttatgtctatcatcagattgtatatatggtatgtactcattcctagctaccgcacgcacgctacgcacgctaacacgtgaaacactagttaatccactgtccacactaaattatgtccctggaaaagatatatagacagctcggccgggcaggatagaaaatttcactatgatgcgcatggattaagtaccatttaatagtacgtagctttagaagatgagcatcaagtagtaataaaaagcggtagccttttgtccctttcttatttggtgcgaaaagatcaggttcttcgaagactagaagtatcataaatcttttttaagacgagacgcattttcacatacaacattacacatgtacaccttattcacacatttataagcaattcttttcgcacactcaaaagacggaaaattgaggtaactctttagtctcactaaattaaatttatattggaagcttatttgcttatgtaatatttatgatcggcatcaggatttaaaccttagtgatggagtcattccctcattatgatccggtactaaatatggcatgttttactattttcagattaaagtattttataatggtctttgctggtaaaaaaataaatctaaaccaatcatcctctcttacttactgaattatattttttttgagaattgtacaattgaggctcttgtaaccctgttaaatcctgaaaaataaatcctaaaaaaatcgcttccattaggagttggacctaggacctcaggtgctactgagactcttgtaaccactaggttacaggccctttcacttttatttactgaattatgtcttataccaccacttaactaccggttgtagattttttttattaatgacagaagttaaaaataaatagttgtggtcaataaaatagggagcatataatgtacacacaattttttttgtacacaccgtgcacacgaactaacaaattttactaaaaattttagaaaaaaat

SEQ ID NO: 59120 - DNA, 28121 bp, Oryza sativa
ccggccagagggcggcaaggggctgcctgcaaaatggccggccccgactggcttttttttattggggccccttccgccccaacagagggcagcaagggttttcctgcaaaaaaacctccctccgtcaccgcccgtctctcccccgtttgccacgtcagcttgccgccccagaggtgggcgacagggtctatttttgtaatttttttggtcgatagattatttctgtaaatatttaaaaaaaatctaaaaatgaaaaaaattcggggagtgggaaatttaggcctaatgcagaagggacgatgaaataggacccaagatgagtaatttaaggcttcttctttatttttttaatacatatgcgaagcatagagtatatatacttttttttcaaaaaaatcttgagtatacatcttaatacccttgaatcactactgggcccgcccattggtgcagtcgaagcaacgactgcaattttagcagctgcagtgattgtcaaactgaagattgaattcgatgttgttctaaagaatgggcgtgtaaatatgagcactccacgtacagttaaaaatatattgcatgtaaatatattccgggagaaacgaccattttcacgtgcaggacaatcacagtcagccacagggcatgttcagaactatttcattttgcaagccgaaacgtggaaatgaacaagcatatcgcttacagatcataccatttatcttacaattatcattaagagttatgagatcactaattcaatgagaaaacaattaaaagaggatctgaattaattttcctacttcagtaaactataaaatccttaattttccaactttacaatttcattaagcatggccagcacaaatctctatggttgatgagatcttatgatattgggatttcgatccaaactatgaagtgccataataaggctgagttcttttcccaacttttccaactcacctctcttgttttccacacgcacacttttcaaaccgctaaacagtgcgattattataaaaaaattctatacgaaagttgcttaaaaaatcatattaatctatttttctaaaaaaaagctaatacttaggtcttgtttggttcatgggactaatccattagtccatctattttagtcccaaagaatccaaacatgggtgactaaaagggactaaaagtgcatattgagactaaaatccattagtcctcttagagcatccccaggagctagacatatttcatcctccaaatacccatatggatagtcatctaaaaaagattcctcattcatatcccttcccactccaacagatcatccatatcccaccctcctatattttaatatcttccaactaaacttacttttacttttgtatttttaagggacatattttgaactactaaattttaacggtgttatttatcgcgataatatttcaaaatgagtatatttaacggatatatttttaatagataattttttaatttatatatttgaattgagtgaagcattttttggatatattcgcagcaacatcaataaaatgaacacaacaaaaatatatcaacatttgtactctattcctatttccttttctctactcaggcagcacagtcatgaacatactgctactactctttctgtagaggaagcatgtggctagcaggcgcggtggcgggtgagctggcgaggggcggcggcgggtgtgtggccgagggttggcagcggccgggcgggcgaagggcagctggcgaggggcggccgcgggcgtgcggcggagggtcggcggcggtgggtgtgtggctgagggtcggcggcggccaggcggatgggcgaggggcggcggcggacaaccggacgagggcgcggatgggcggggaggaggcagacggcgggaggagaagctcgagggcactgctgcgggtgttcgacggtgggaggagaacctgggcgcgggtggctgacgacgggagctcgtgctatcgcgaaacctccagatctggtacgcctattcctccccaccttcactgctctatggctccagcagccagtgtaccacggcgtcgcctgctcgttccggaggagggcaggagctcgcgacggatacggtggatgggatatggcgtgaggagagagaaacgccaaatctctctaatatggagcacacgctatttttagatgactagatggaagatctgctggagcatcaatttccttaggacggagtacgggatggagttgctgctggtcatgctcttagagttatttataggaactaaagtggcaacctctcttctctctcccttggtctatgtacctttagttcctggatccaaacagtaggggactaaagtttttagtcaagagagtaattttagtctagagactaaatgatctaaacatgaccttaattaatcatatgctaatggactgctccgttttatgtgcgcagaagatttgtttccaaccagtaggaacgaacacagcctaaggtatcatcagtctgttacacatatttttaggagcaacccaacctgtttatcatcagtaatttgccacaatgtgctgtaaaaagtgggactgtttaagcagagttccagcatgtgggctgaaggtatgtgtctgaaactgcacataaaattcatatataaggggataatgaaaatgtcacataagattcataaactcaaaggttgctaataatttaaaacaagatctcgataaatcatactcccttcatcctaaaatataagcatttttagtatagcgacaagtcaaacgtttttaactttgactattaatagcaaaaaaaaataaaaacatcaatcatataaaattgatgttactagatttatcattaaacaaactatcataatatgcaaccctttttatttaaaacatcttacttttatagatattgttgatcaaagtagtatctcggagactgttcagaatccaaaaatgcttatatcttgggacggagggagtagcataactgtacaagcgaaaatattcagcacaactgtaaaatcctaagttcactggttgagttcaatattttcgatgccaattttttttttgacaaagggcatatagccgtgctttactgaaagtttagggccccttttgaatcataggattgaaaaaatagaggaataggaaaaacacaggattttgataggaatgcaaatgtaaaacagagaattgcaaaacacaggaaaaacacagaaatgaccgtttgattggactgccggaaaaacgcaggaatcagatgagagagatagactcaaggaagttttccaagaggttagagtggatgttaaatttcctatgattttcctctagaatcgtagaaataggaaagtttcctacgtttttccttttttcattcatacgaatcaaaggcataaatagtgtaggatttcaatttctttgtttttccactatttttcctccaatccaaaggggccttaaggtttgagatacagcagttcacaactgggtttgccagctaaacaaacaaagcccagaaacacaaaaaggccttatcctgcaaagagaagtactacaaaaccaaaaaaggggcagaaacggcaagcacccgacagctacagaagctaaagcacaagattctcacacaacttcagcttcccacgttcatgttttggtttaacaaattgtttagtgtgccccaatatcaatacgatctaaaattacacaattatcgaacttcaatacaaagagaagtggcatacaattaacaaaacaatatgcagatttacactagcactaatacttttcacacgcaaaaccggttgaaggtgaagccacaatttttacctgaacttcacggaatcggcgacagcgcaataagacatcatcgaatcagggttcagcaacggcggggatgaccctggtgggggcaagatggggcaggcatgacgaggacaaacagcgcgggacactgtgccgacaaagcctccggatacgattttgctaaacgttagatggccataaggctcaaggctcggcacggccatctggcccgacccaaacatggcatggcatgactggtgacgggttcgtgccggcccagcccgacagttgagccatgcctgtgcagatgacttggcacggtggcgggccggcccagcatggcacacggtccaatgagtagcaagaaaaatagtagagggacccaaaataaacttagttgccatataaacttatcgcctaaagagaagagggatgcaaaataaacttataccaaccatataagacttggaaaaagtacaccgaaggtccctgaacttgtcatcgaggtaaaaaacgtcctcaaaccgcaaaaccaaatattcggcgttccttaactaatcaaaaccggtcacaataggtccttcggtggttttgaacccagttttatccgacgtagtggttgagtcagcgtgggatccacgtgggcgccacatgtcaggatgccacctcatttctctctttcccctcttctctcgcaggccgattagcaacgggcggggctgagcggcgcccgacagaggtggcgtgcgagcgcgcggcggctggcggagcagagcgacagcgggcgagtgcgtgacggagggcgaagccgccgtacttccccactgcagctgccgtcatcgggaggaggagccgccctcgaccacgcgaggacgcagccgagactaatcgacaagacaatgatggacgctccgccgagcaagcgcacttgcatcaccgccggcagcagcggcggcaacgacgatgaggccgatgccgatcggctaagctagctaccactgtcggcggcggcgaaaacaagatggcggtgcagtgggacaagctcgagtccatcgcctacccgctgctgctcacccaccgcaccaggacactcgagaggttctggatgtccgtcaacgtcgcccgcgggatggacatgggatgccctccgccacgtcgtccggtgggtgcactgcggtgtccagtgcttctccgcgccggtggaggtggaggtggtggcctagctcactgctttgtcggcgcccggcggctcgtcgacctagacctccccgctgcctccaccggtgactgctactactaccgcctccggaggctgcacctcaccggcgtctcgctcggaggccgcttcgtcgagcaagtccggttgcgacttccggtctggaggacctgcggctcagccattgcgccacgagcttcgccgatatcgcgtcgcggacgttgacgaggctggtcatccacggcaatgccggccgcggcagcggaagcagtggggagctagcgtcacggctccccgactctcctccctgtgcctcctctctcactggcctccaccgtgcctccgtcgtaggcctcggagccaccgtgctttcctgctgcagccgccgcccgccaccgcccgcggccatcgcagctccgccctcctcctctcccgcgatagagaagactgagagagaggaagggagtgaagagaggaaagagagatgaggtggcatcctgacatgtggggcccacgtgggtcccacactgactcagccgccacgtcgaacaaaaccagggtcaaaacagtcgaaggacctattgtgactagttttgattagttaagtgatgccggatatctggttttgcagtttgaggacatttttgtaactctatgataagttcagggaccttcggtgtactttttcctataagacatagcccaaagagatgagggaggcgaaatagacttattctatggagaagcataatgggctatcatgctttcgggctaacccggcacgacccgagtcttattgggccgtgcctaggccgttggttcagcttgtgggcgggcacggcccggcccgacgtgtaggtcgagccgtgccggcccgattgacctcgattcgggcccagtcgtgtttgggctgtgctaggccggatggcccatttggccatctataccaacggaactgcgattcgagcaggtctcacacgtagagtcggtgccactccttcagatcaatgcattagatcgcttctcagctgttgaatgaaatgcagcatagttagatgaatatagagctctacccatctcacatacaggcaccgggtgaggcttgtaccacgggaggccattctattttgtactataagtacagcactaatacaaggcaatcatctttgtgtgctattctctctttgcttgcactctttcaggatagaaagactggaaaggcatgtgaaccgtttgaaccggtagaaccgggcgattttgagtgaaccggctattaaaccacctggttgaaccgacaaggctggaccactctcaaaatgggccacatcaaggcccaattacttaactagcccaccttaccatggttcttttggcaaaaataagaggaaaaagttgctccatgaggactcaagttgagtcactcaacccctggtctccatgttcaaagcgagctgcgctagccaactaaccatccaagcaactatattttacaacacatatatagggagcatatattttgtgaatcgtggttaaacggtctgaccaacggaccggtgaaccaagggatcgaccgggtcaccagtcggtctggtttttcatactatggcaagtacccgtgcgcgtaggtgctctcaatagagaatataaatagaagagagagttcactctgctatctatcccggagatgcgaggttaaccagcacgagagaaacttaatggctcttctgtaacggctctccgccaggtacgttaaaaaaacgtaacacctagaaggagagcaccagtctcgtcttggcgcgcgtgtggcaatcccaccaccacctcaaccgcccaacgggtgctcttaattagcaacctatttaagtcgaggtccctccacattgctttccaatatgatattaatcccttaacactaattatgaattcatgaaatttactagaattaaattggacctagtccatttaattataatgtttcgtgaattatgtggtgaattagaaaaatgccaaccatgtcatttgacctgtccaatttctagatttatatggttactatgtagagatgcttttatctggaataataaggctcctttaatttctgatcagttctttgaagatgctcttatctggaataacaggagatatcaaaagtcaggaggataaagtgaagatgctgcttgctggcaactctggattaccaggaatcggctaatataaaccgtggaagaaggctcggctgctgggtgcttccacgtcagaatgaaacagtatgggatttactgttttcttccctttcagttgcaattggtttagaggaggggaagtgtttacacctaaatttggcacctagaagtaaaataggaaatattgccaaagtttagaagtatgtcggtttcctccgagtaggctggtctaaccgccgtgtgttggcaggtcagaccgccggttgagggccggtcagaccggcggcatgtggccggtctgaccagcaggtccgagtctgagtgtgtttcaccgggtctcgaagtttccttgctcgggaaggaatgtttcaggtttcctttggattctatcccgagttggacgtggatgagggtttgtagagggcaagaccaacccctatataagggacatgccggttcaattgtaactaatcaatctacaatcaatcaattgaatcgtttttcatattgcttttagttttctcttagtttgtccatctctgttgatttgcgccgtaaatcatccgccgccgctgtgagagtgcgacacttctttgtaggtttgtcctgaaaaccttccgttttacccacgagacgggtagttatctaggaatcggctccgctagccggtttagttatcaaaacctatcttggtatagcttttgctagatcgaagtgattggcgactctagaatcaccgcaaggcgtttaggtgttgtgatcgtgcttgtcaacttgtcatagaaagttgccaacaggaagcttacgtgataagaaatacgatctgctaattctagaattctacgcaacttttcatccgaggcatcgctactcactccgcttttctggtctctcttcacgcggcgctccgatcctcctgtcctctcaccgccgccaccacctgctttggcttggtcagtgatgatgatggggagctccggcgccggatcaagcaccgtctgtgagcgatccctgtattgatccctgtattaattcttttatgttctagggttgtgcggtctaacccggttcttggtccgacctccttctgctgcgcttcttcgcccgatctggtttcgcctgttgttgatgcaaggtacgaattggtttggattgattcagtgatgtttcggcgtggattgctgataccgattcctattgctattaattttggcaggaatattgatttgatcaagcgtggtactttcttagcgctcgatattcatgatctagggatggcaattgtgcccgtttacccgtttgtagaaaccccattaagattgggtatgttcttgggtattttgttgggtcaaatgctatacccgatgggtaaacaggcatgtgcataggcaaatactactcattacccactttgtccgtttacccgctaactaatctgtcatgtggggtcatgagttaatattatcctcatcaatttataacacatccttgcgttactatgatcttatagtagggtcatgagaattctctatagccatcggggaggatgccagagaccatccccaaatccaatctctccttactcccttcctattcgctcgatgagaaaatggatcatatgccactatatatgtggggtttcgtgaaatgcaactcaataaaatataatgaataaaataccacttagtatgttgcctaccagataaaatgccactttgagttctaaccattttatgaccaaaatacccctgactatagagaagggggagcgccagggagggccggccgggtagcaatggaggcctcactgggttgatattagtgatataccctataggcaatcatagagatgattgtatcatcgactttgttccttgaaatagataactcattattggttaatgaatatgtgattctttcatgagactctttatgttatgtgttgctatttctaaaggatcctgatcaaatatcatatgtggaacaaatatgtttagatgatcagcaaatgtattaattgatgatcatgtctcatggatcatggtatagagataccaaattaataatgtggacacatgttagtgaacatgttgttggatagacccaacatgagacactgcaagagccatatgtgttgtgtcatcagtgatctcatttagtgttgatgttgaatccttagacctgagattatcatggttcccaacatgtgtagtagcttacttagggactgctaaacgctactctgtaattgggtagttataaaagtagttatcggatatgctatgaaacatgtagtggaatatgaataatcaagatgggatttgcccctcctatggagagatatctctgggcctctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggagttcatacaagtatacactagagattcagccaatatgatctttatgtatgtccggtgggtcaatacgttctgctaggggccgctgttgtcgcgtggaccgaaaaggagttttcgggttacagccgaatatacatgaacctacagagtcgcacgcttaatgggccagaataaggggattggatgtagatccaatataagcttaattcggatagggatccgaataggagtcctacgggccttggaggcccgagtgatggatcctatatattcgtgaggggtgtgaccggcggaggcattgcatcacgtgagaaaccctagccgtcacttccctccccgagcaaaaccctagccacgcgcgggtgctagcacatctgcgtatggcgttccggccctgtacgtgtggataccggtagaggcgctgctggtttgcggtgctgatcggcatgggagtacggcgaggagaacacacgaggaggagaaggtcgagccggtgcgatcgactacttcctctacatcgacgcgcgctacttcgcaagaattccttcgacttcttagcgcatttttccgctgtacagcgcgttgagtggtaatgatctatgatctaatactttcatggttactggtttatgcgatagaacattttgatttatgctatcgtagcctacgcatatcccaacagttgaaccatcgcttgtgtggggaagccacgtatggccgccatggctagcccatgcacatgtcgggccaaactcaacatggtcagcgttgattcggttacaacacttccaaagagaagggcccctacgtactgtccggaaagatcaagcatctcgatcacggatctacctgtcgcctaccacctcaacctcaaacagaaggtgatcaccattgctgccttagccccaaagagaccgccttcgttgcggaaaccagcggtcatcgtccccgtatttgacaatagggtcagtagatccatgtcatcgctgccactacagccgttgtcatttagggcctcatcgtttggattttttcgtaataagccaaaacggcttattagagaataagaatgaatttgtagctaaaacttttatatatatgttctcggtgacttaaaagccaatgctgaaaaagaaactacgttgaaaatatcttaaaatcaatgtcaaaattaagtttgaaaattcaaattttggctttttctttggttgaatagaccatccgatggaagcttacatcttgctgggacttatggaatgagaaggctctactgccaccacggtccttgcaaccgcacagtctgctccagtggtggcgaagcagggaaaggactggaaggaagcggtggtagtgcaacatcgtcgacacccgagtcactcgacaagagcgacacgaggacaagatatctggtacaggggttcacaatcccaataccggatcaaaaatcactcatgggcgatatctttagattttgtggaaaccattgataaatcgacaaaatccggataaatcttgtcaaaaatttaaacttctgtttgattctttttaacttaactaaaaacggagcggtttgtttttccgacctggttcaggaagttcggaattcggattgtaaaccctaatttggtataactctgttaaagtgtaaaatagatatgattcaattatttagaagctctgaaaggaaggggattattttgtttcgaaacacaatacgggtccaggtaccaatataaacacgtgcacactcacccttaaaaatgcacatacacatcctacctctatgagtatcttcaagattgagctagcatatcacatatcttcatattcacaaagtcaccattgggtctcgcagtcggtggtatgtcgtgtaccagtgaaagaatacttagtcgtaaatgcgaatgctcatgttaagacatgtacctaaatggatagattttaccaaaaaaaatgaactagctgagctacgttcactttgtgaaaagaagaggattataattagagatgaaaactattggaaacggaatcattttttattatttttaatgaaacagtcggaaatggtcagagaaattctctatatttaagaatttcactgtttagtattaacttcagtgtgatggtgacaaaaattaggaaaaactaaattttaaaaaggtaataatcgataaagatatttctattatattaattatttaattttatggaagggagtagctatatttatggactcatattttttttaaaaaaaagtcagcatacatttacattgtaagtctctaaattacctatgtaattttagtgtgtttacaatgtaaataccaaaattacaagtaaatatcaaaatatcggtatcgatccggtcagaaaatttcctaccgttttcatctttaattataattcatctaagatcagacttcttcctttgttacacattcttatatgattcttataatagtgttgctttccactttgcctatcaactacagcttgttgctccactaagccgttgactatagcaggacttgtaaaggtgtacaaaagatatacacagtggcagacacaaaatattctgaaccttggcgagtcgtcgagcccggccgattgctcaggatctctgggcccctaggtctgccgctgaatgcaccctatctgaactcttgtcaatagatacaccaatatcatgaagaggtcctaggaacgtggaacagtaacaattggtgggaagaatatcagatggaatccaccaatttagtgaaaccatgacactaatactacactaaatatgcctacaacttaaaacaatttaccaaatgcaagattgatagtacactgtattatgtaaaatttcaagatcaatcttaatttcgctgggaagttatgaaattgacaaataacgaagcgagcacggtcgaaacaatttaattcggttgcttacgatttgatatcactagttatgaatttcatatatttcaaagaattgcgtagtattaaaattagcagattacctacacaacacatggtatgttctataactttctgaaaattcttcacagtttgtacagtggttttcacaatttgattgggctggtggttccgcggtacttgacggtccctgctgagtgcccagtgcacacggtaccatcgagctggctagccacgatgagctgccgattcactattgctctcactcacgaatttcgattctgtcagcgaaatataattacactcagattaacagatagccagagagggtcattaaaaaagctagtaacttttcacattatgtgcatggtggttattcacatgaaagggaaaaaaaaagactagaagtgctttctcttctttctttttttttcttttttcttaatctgatctgaaagcaaaatttagacccgatccagaatcccttggtcctcctcatttgccatggccttgtcccctttcttgtactccccatagacgtaggacgagaaggcccagaggcagagcagcatggccaccgccttctccggcccgaactcgtcgccgaacaccaccacgccgccggccacgttcaccgccaacagcgccgtcatgcagatgccgccgtgcagggacgtcgtcaggaacaccgttccggcggtgccaagaaagcacagctgccagctaagcaccgccgccccgaccaccgcgtagtaggccgccggcgacagatcccacgtggcctccacgccgtcccacggccacttgccccccgcggacgacaccatgccggccgcgccgacggccgtcgccaccgcctccataatcacctgcgcctccaccaccatccggaagcccgtcaccccgccgtgccggtacacgagctcggccgccggcaggtagagcgcgaagagcaacgccgcgccgagggtcgccgcgacgccgacgaggtagtccgggctggtggcgtccgcgccgccgccgccgccgcccgcgccgtggcggagcgcgaggagcagggacgagagcgtgaggagcacgacggcgttgaagttggcgaaggagagcggcacgcggacgagcgccgcggcgagcgccagcgtgaaagccagctgcatggagaggagtagcgccgtggtggacaccggcaggtacgaggtgccgcacgagtagagcaggttgttgagccccatcaccagcccgagcaggacgcagtacatcaccaggcgcggcgtgaacccggcgaacggccgtgacgccggccgccgcgcgcacatcagcggcagcaggagcgccgggaatcccgccgactggacgagcgtggccagccaccggtcggcgccgccgtgcgcgaagtagaaccgagagagcaggctggacgagagcgacccgacaaacaacgccgcgtagttcgccgccagcagcagcgcgccccgcgccgccctgctcttgagcacagggaactccacggccgccggcggggagcagagtaagaggcggtcgtcatggtgggcgtgggcgaggaggggagtggtgggagagtggagcttggcggctgtgtccatcaagagtggaaggtaagggagggggagagggacaggatgggggtttgcagtttgctgccttccttgatgtttatggtcgtctgcaaaggcagagaggcatatttcaagggattttgcaaggtattttctgtgtaaattgagcaccgttatattaaacccaagttggtggcacacgacatggactcgtcgatgatggatcgtactacgggtactccagtggagtgcaattatttgctctcaaaaggatgccgcccttcgctatcactgatgtgtcccttcttctttttttccccttttcttttggggtcctacatggcaacatcctccgtatagattaataagcttgtgtctgaatttcccttgaatagttatgtattagtactagtctccaacgatcaatcatcagctctgtatgtattactagtaggagtatctctgtactctctgaagaacgaacgatggagtatgtagtgtgtacaagtattatttctttcccctctgtttttggatgattgctggggaataatatctcgcttgtctcacatgtgagacacaagggggagagaaattcctgtgtctgtgtgtcaggtgcccggaaaactcgctagaaacgtctgtgctatgcacccagcagagcactgaaacagcacattttttctggcatccggagcgttgtcgttaccagggagtgttgggggcgatttttcttttcttcacagctatgacgacatcgcgtgatgaactggtgacagacaagcttttgttattggggggatattctgtgctgccaggtctgttctttcgtgcaaacatcttctgaaagaagtcccctatagtgcagtgcaaaattacgcagaacatccgtgtgcatcaaagtataatttagcatcaaagtatgcataatttatacagtatgcttccaaacacaagctacagaaggcttaaacaaacacatgtacacgtcgcaatatagtactataatataatagagaaaacaggacgagaaacagcaggcgtacgttggacagggagaagctttggtggaaggtttcggtgggcatgaaatcaatcggtcagatgggatctactccctccgtccttaaaaaaaaaaaatcctaaatttccgtgtccaattgtaattgtccgtctaatatgaaatttttttataattcgtatttttattgttgttagataataaaacatgattaatattttatgcgtgacttgtttttttaattttttttataatttttttaaataagacggacggtcaaacgttggacacggaaatcagggtttgtcttttttttttttttttttttgacggagggagtatatctgtatctatgtatgcagaagaagaagaagaagtgaagaagaagatgcatggtccatctgccggcggaggggcgcgacaacaaagtgatcgaaaaggcagcgacctacctatgcagatcgtaaaacatgatcggacatgggcccagccgttgcagcttttcaagagccgattgcccacagaccgtgggacaaaaacctgcccacttgatggctttccgcatctcgcttctctcggagtagctagtgggcgcagcagcagcgcgtggtggtgggtaggcgatgaatgtgaagttcagtggtgtaccagtacagccgcgcctgggtcgtccctatcaacaaatagaaggggatttaggctctgaaattaatttaggctctattctgtgctactttctttttttattccagcaaatcaatttattacgcctaagaaaatgtattacgtccatctgcgaaaatattcccaccaaattttctaatagtatattttaatcaataatgctacaattaattaactaatacataaatatatggtaaattttgctataggacattacgatttcgtgattttagccgtaagacactgtacaaactcccttttgggagaagacactctctaaacatggttatttgccagcgaacaccgtgccgattaaaatagtatattcgtgctgacgaggcgaaagctgaaagggggctcaaatatttacacagagtgaccaaattgcccctcatttctctccatcttcttctcttcttcctccctccccagcatcaacgcaacagaggagccggcatcgaggtggcggcctagaggaggcgagggtggcagatccacgggcaaagcctcttgctgcaccgtcgacgcaccacctcaagccatgggcgcattagcagcatccgctgccgctaactccggcccatgcactgcatggctctgatgctccgcgtccatccctgcatggcgccctagctcctcccagcactcctccgcgccaccgcttctccggatcgaggacaacaccaccttctccgtcatcctcctcaattctgattccgattctggccagcgtcctctcctgcaactgtgccattggccgactcattcctagcttcctcgtggaccccatcgtccaccccatcggcttcctgctcggcatgccggttttctccaccccgactcgtccgcaccgcttcaccacgccggtcgatgccgcccttgcctcctccaggccaccttggatccacctccaatgccggctcccctgaaagaggatataaggagctaactgcggaagtggaggagtagtggtggagccacgttaaaactgtagggtcagctgaccccacatgtttttgcaacatacaccttgatcatgtgaaaaatagtgaaaaagtacataaaacaaagaaaatttgtatggattgaccccacatagttgcatatttatgcattttgaccccacagggttgagaacttggctccaccaatgtggaggaggcgaggaaggagggctggccagggagccagggcgcgtcgctgcttgcgcatgctgaagggagtcgggccaccatgctactgcgacggaggtagaagggggggggaggagggaggaccgaccccttagcgtgagcccgggaacaggatcgtgctgccccgccgcccgcgcgtgctaaggggagcggggccaccacaccaccgcgacggaggtggaggaggcaaggaaggagcgtcgggtggttgccagcagcgagcggaggtggtgttgtggcttgagtgtgagagggagtgagttgtgggggaagaatatgtcaagtgggcccagggctatttttgacctttcacgctatttatctctcctattcaaccagaaattaatattttaatgtttgcagtgtccattagcaaataaccatattttgagagtgcattcccccaaagatcgacttttgacgtgtcctaaagctaaaaccacaaagtcgcagtgtcctgtggcaaaatttgcctaaatatatctagcaactaatagacatgtaatacggatataatacacatatattgtatgcattagtgaaaagtgcaggccatacaataagatttacagtaccgtcataattatggattatattgttaattacacaagcacatgactccactccccaagaaacttggactcttcacttatcgctaagctgccttcgaggttgaagaacagtccatctttatggtagcactcatggtggatgaagtggtagaggtcccgctatatgtttttagtgccttcatcatcaaagctagttcgatattcgattctagacaacagcatgcacgagaatatatagcaatatcaattagatgtgcattctatcattaaacttatactttgagttgagagaattacattaacccggaggaacacgcaagtataatatccacaaaggacacaacctttaggttccttgtgacacttcattatgacatacatatagaaggaattagttatacacgcaggcaaaagaaagtaagtaaataagtgtgtagagtatgtttagtaattatattctcatatgtatgcactagcaacttctccctccttgccagttcttcctcgccttttgctttgtagttgttgtacgcactgtacacataataggataataaagtttgtattaatgaacacaatttaataattattaacacttcatgatagtacacatgcaaggataagaatatcttactattaattgaaagattgttagaaattgtctatatgacttgtgattataatcgagggagtcgaggactgtaacagtcccatgcttcgggtagagcaagaataaatgtaatgatcgctacatagtaatgatgatttagttaatcatagattaaataaagatatatacacagatctaccagacttacttaaaattttatctggctattatgactcttctatcttgaaaatttaggaatgcttgtccaatatagatggccacaataagcaacttggttttgtgcaagccattcttatattcctttatctctttaggtgtcttgttcttaagctatttggaattttcttggagagtgatgatatgatgtgtttgacaaatccttgttcggtccaggtaaccgatgggttgtcgtgtcttctcatcatccatgtattgcatcctaaaaaaatgattattaatcattttcgggattatattgtctatttatttctttgtatgaatgtgcatttatactcacaggcaccatgcaaccacaaagttcacgtccatctttttacggcggtacacgacgtgaaggtcagcgaaatcgagccataaaaaacctacaccgctcatgaaagcttggggcgatgttcgaaacgttatggacgtaagcccttttttgctagcatccctgtaccatttatgtaatcttctcatctcctgtggaccttcttcaagcatgtgattggaccagacgactttccattttcaaacttcgccggtacttcatccgttggaatgtattcctctctagcaagttcatcaaccattttctgatcaatcaagcattccttggcatgttttatcccaactcggaaggtggttatcatccacttctccttttgcttattctctgacttgggggttgtggcttcgtagcacactaggcactttggacttattgttgctgttgtcatcatccttgggtgtgtctatgtcctctttggtggggcattggtcttcatacacatcgagttctatttcttcccattccatacccgttgtgtcttctggatcatgttggacataggacacaagttgtacttcggtttctggtctgtccatcaattgatactatggctgatacagctgcttccccttggctatttgcttgttggcctgcaagttgctcacttcaatgtgtccatcacaaggtgccacctcatgttctttgctatctttttcaacctcatgaggggccgatttcttttgtggaggtgttggtggtttcagcggagcatcgatggaggtcccaaagattatatcctttttgtgccatagtattatatattccaccgcatccccaagtacagctaaaccatcacatgtcaggaagtctaaatcgtatgtcttgaacccttcattcacatgttgtggttgcattttcgcataatcatctggaatataatcctcatgatgaatgcggccagggatagccattcattttgcctcgatacaacgggccaagtgcaattatctgaggaactatataaaccatgatgtgctccatcatattaaaatatgatgcaggaaagcacatctcaagtttgcacttggtctcatgtgagaataaacaatttagtgataacacttcaggattgatgagcttctgtgatattgcattaaaaaagtagcacatctttgtgatagcaacctttacatgttctgatttaatggcccttatagcaatggcgagaagcacggtgaatatgacatcaacaaatcttatagtcatgtgaattgtcacaggatatcaacaaatctttcatgaagactagtcgcctgatgtttgatgagaaatctatgggcactttaacaccgtaaaggcacttgcaaaatgccttcttctccttaggttaatgtaaaatgccttcttctcctcagatgttaatgtgaaataggctggagggagatatactttttaattcttctcaccttctatcgggtgtagctcttacttgattcccatatttattagataggtacgtgatagtacactattctttgtcttgtttggtatgtcaaggacaattctgacagtgttatcaaacacatttttttttcatagatgcatgaaatatatggcatagcaaatctccaaatctttccagtaccacatgtactcaaagaaaatcgatgcttcttgaatgtgggacatgatttatcatctggtttcttacgctttgttccctccgaacattttttcagcccttttccgaacacgcattgtattttctttgtaatggcatgtatttccttcctagttttatgttttggtggtggatcattctcttcgataccatcgaattctgacgtcatcttgcggtatttatgatttatgtgtaagaaacgccggtgacgcatgtaaacaagcttgttggaacctagaaggtaactgtagtaggacccatttaagcatatcacacatcatgttttcactttaatctgccccggaactgaaacattgcggggtaattgttaatggtaataaaaatgatgggcctttactgtaaagtattgtcttaaatactcgtcccacacattcatcccagcttcccataaatcttcgatatcttccgtcaatggttcaagaaatacatcaatgtcaataccaggctatcgtgggccttgtataaggacatagagtaaaatgtacttttgcttttgacaaagcccatgtaggaagattttacatggtcagaaacactagccaagtgctatgtgagctgctcatgcctctaaaagatgaatcgtgatatgcaactgttgaattagcctaaaaccagtaatgattataattccatacctcagtaggtgtggaataaatttcttccaaatccctctcaatccatttgtagcccagcccaaccgacggacgggcccacttatactttcatcctcgcttcgtgtaaaagggttaacccgggagtagcatggttggagggacaatgccttataagcttgtttcacccgtgctaaactagcaaggtggtactgttaacagtgaatttgataagcccggagtagtcatcggcttagagtcagcatcggcttcgaagtcctgagattagccgatgagagttgtcaagtcgtcagttgtcggattcttgctatattcggttaaagaaattgatctactaaagaaagcttatccagaagagaccgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttttatcaacccatgggtataaatatgtacacccggggtctatgtaatctatcttcacgatcaatataattcggcgcatcgccaccttttaccttttctactttattttatcgtccggcgggacttggcacctgacgcggggctgcattggtgttcgatctccggctaaggggtaagtccaatgttccgtcggcccaggcaattgtatcgtttacgtcggtgtcgttcaaggctgcatcagtacattcgacctcttggattgctctggtttggatgatatatttgcctaccaatttatcaaatgtctctgttaatctagtcttagcatatcaatttagctctatcggctgcttctcgttttagggtttctgccggtatcggctaaatctcgttgctagattagattagcttagacatctaccaccctgaaaactcagtcaacggcttgattgtctagatattatgtttcttttcatacttagtgctgcatcaattaagtttggtctactaagtcgtgcttagaaccgtaatctctagcctgcttcttgattgccaataagggtttcatcggggtttcagccggtgagttatctggacgttgcatcggctcataaggattgcatatacatataaattggatttagtcgatgacaacaaaggtttcactgtttaatctaatcttgtggatttcatgacatcggacctccagccgatgtgtgctttaaccttcggatcgatgcttatttatcatatcattatttgccgattggtttctactcgactatattgttattacatcatcatcagccgattgcctttatattattatctacattggacatatagccgattgcttaaaccctatcgctatcggctggtatcggcatcggttattatcgactatcggctggaactactccatcggcttgtcagccgatcgactgttttgatctactatttgcatatcttgtcagttgcaggatcaaactgactggcacactcgcatctcatcaagatttggacctgcacaggagctaagcagatctcccaggccggtgtgttcgaatttttcgtcaacacaaattggcacgcttggtgggaccacgaattttatatccacatgtatgaagaagaagtcaatgccaagatcatggtcacggtggagaatttaatggaggaacaacaatattggctcggggggcaagcgcatcagttttagcatggtggagcacatcagtatcggctcatgaaactgttcaaaaaaatgttatatagaaaaatgaccaaactaaaagttgtaaattttgataagttatacaactttgttgttgacattttttccatttgaaatcatttactaccctgaagttattttgagtcataaaatgaattattatactgcacttaattattttgctatagttcaacttacaaatataaacatttcatacgaaaaatgaaaaaaaaaaactcatcggtgacgggctttagttaatgcccgatagagattaagtcatctcaatcgggaattagtatatagcccgtcaatgatgagtcatctgtgatgagcctagttgttatctcaaacgggcctcaagttggtgcacgtcacggatgatggtcatctgtgacgggccataacgttaggcccgtttgagatatggaatgttatctcaattgggcctaaactacggcccgtcactgataggtgtcatccgtgacgggcttaagttttatgcccatctaacatgtctgtgcgaccatatctcaatcgggcacttttcggcccgattgagatgactttcttgtgacggcccgctatttctaggcatattagaggccgtcacagatagaaggatttataatagtgcttaattctattgttgtcttgggagctttgacgttatggaaacatcgtaattgttctgtcttcgacggtacttctcccaacatggctgaagcattgctacttgctagagaagagttgtataaatggggtttggcaagggctaagggcattcttgcccttgtgccgaacactgaatagtgtttgcttgtagtaggttgaggttgtcttttggtatcgtgaaggtctattgtgtgtgttgtaagggttcttaccatctcctttattcttcttaatataacgatatgcagctctcctgtttgttcgagaaaaacaattgaatttgacataaacatccaaatctctaacaataccacggtaactaatctttaacagttttgaaggcatgaacccactacaccatgacttagtatgatgaggacatccgcaccatgcatggatataatcacgccaacggcaagcacacaagctgaaccagtgattaaggatcaatcgctcgagctcgtgtccgtcaacttaattaccatgtagggttgcataagaatgatttactgaattgggtagtactactaaatgctagtggtgatgttattgtgattaggaatgacggtagagatgaacaaaagctcaacgaggatgcaagatagaatatttcggttcagtttgctgcaccaccccaaattcaaacgagcatacccgttgatctaaaaatccatgtggggatttgatagaaagatctcggaattctctttccgacggatccaaccaatctgaatcgtaagagtggtttgttcctagaaaccaaaaccaatggtgttgcatcacctccacttgggcagatgggtctggtttgtcgtagggcgacgtgccatgtcatacacactgtcctagatcacttcatgtataaatactaagccacccccttaagttcatttggtgttttgttagatcataatttaggcattgttacttcatcatgtaattgtgtgcagttggctacatcacttggttacttgtctttggaacatcttagtaatgagtacccttaagttatcattttttgttttttatttttttttcttgccagttctcgattgctcataggaatgagtaccttcgtggtttggttgattgttctccatcaaaatcactaaccttttctgaagttggtgtactggacgctgaggcgcaacgttcttgaaatcatgattagtgagcatcgtttcttgcaatcaaatttatcaacatcttagtacaattcatctgccatgaaaatatattcttggcacctactaattactgcatcattctttttttacttgtcaatttggcaatcgacacaatttctaatgcgtatatatatatttgattattacttttactaactatatgtttataaaagatattaaactagtatataaaagtgcatttcatgaaaaatctattaatatctttttttggcactttgaccatactttttcataaattctattaagtttatgagattatgaatgctattttcaacataaatattcatctaccatctttatattctgaaactaagtattaaggaaattgagcgtcaatgtttcaaaaaattaacatgaaaaagtcaaaagatttttatttgctagtctgacatttagcatttttgtcgtacaaactaattatcgttttgcagcaacgcaggtagtatttgtgtaggaaatgattaattacaagaataattatgattacatgattcatgtaatataagtcaaataaatatatagtttctgagaagaaaatgaagagaaataacttaaattattatgaggcaggaatgatggagattccaggaaagtgattcgatatgctgcagaagctagtactaagatcgccgacaatgatcagctgatggatcagttagctctttttttttttcgcgtactgtgtagtgcttctccacattcttaattacctaattaggtttagctgctctcgggaatgtcgacatgaccaaaaaagaagtcggtacggcgcaacctaacagactagtgtgatgtatcagagcgaatattaaagtgcttagtatttagtttaggggcttaatctgacctcacgttgtacgcgattgccagtctatagttctatactgccagtgagccatcagctgagagcgtatgacttcacatatttgtttatgtttcttcttattttaaaaaatatcgtatgacagcaacatagatacacctggtggtagctactgcaagactagctagctagtacaagaaaaaaatagggtaattttaccatttctgaggaggtacatagcgatattattattttctagtataaaatttagtacatatagagtatctaaagatataaaaaattttagtgtaaaatttagataacttaaagatactttcttctcaataaccgtaaaattcctcaaaaaataattaagcaagctacaatagtcggacaatgagtatttgcatggttcacacggtctatatgtttttattttccttctgtagcatacaccacacgcacacttaataattttgcctcgtaatggtttcaccttctctcgatgggctgggcaggtcggcttaaacatgccccatgggcctcctgttgccggtcgttaaacccaactcgaccgtcaattgttttcaataaaataaagaaaagacaacatatgctattgttcttactttttaactcacatattttcacaagttttgttggtttaacatgtttcgcaattttaagtcataataagatcatcctcggacaaggagatcatcaggaacttgggcccaaagttaactttggtccctaaacgttcccatccaaagcccctagaaacacctgatgaaaatgcaagtattaaacaaggcagttgcattagcatcggaaagaatctccacaatgttcaaaattttgtatgaggaacaacgaataatatcaaagtttgtatgagaaacaagcactactaaagccatgttgatgtaagtcacgtcttgcttgttgcagacatggcttcgtaagccttcatacaatcagatatgaagaggtaagtattggattgtgcattttttttatttgtttggggaagtatatacgatgcgcattttttatttgtttggattgtgcaagagcttattttggtgtacttgcaagaacatgatggacatcaggacatagaggcttcacttaacatggcagcacttacatttacaagtggattgtctacaccttacaacaatttacgaatgatatacaaacagcaggtactagtgatgccaaaacaatcatgacttaagccaatatgcgtttcttttgtttatatcgattttatattttttccaaaccgtatggttccaaccctggaggatgtttgcgctgcaatcagatgttcgttttccagtatactttgctccttgttcaacacaaagattatatatgctttcctacagagaagtaaaaaagatgtaacatcacatctttcaagtcttcctgggacttgactaactcttcgagctaagatgctacaggattcatttgccattctgttactaatcctcaagaaaaaaaaaaagaacatgtaccgtacaggaaaaatttgaagattgaatccaacaaaacttagtcaatgtggttagactgactgtgtcggaatcctttcctcaaatactctgtccctagccttttcagcctgcaagcaaataaccaacagaaagataagaatgtaaaacgttcagaacatagtataaaaaacaaaatcaattttttatatatatcaggtatatgacttcaagaggacttcgttttgtagactgaaacgtggaaaattggttcatagaccattgcaatataccaagacaaggaaacattgataatgtccctcgatgtagtttttagctaagtaggaccctttgtgcattttggtacattaaactcttttgaaatagatttacacaagtaaagttaacacactttgggtatttcttaagcttcttttgtatggtggtacaacataaaacctccaaaactgactaccatgttaaaaccgtaacaactggcaactgctttttttttttacttcatttgactgcagactatattaaaagtttaacattccaaaccggattgaattgagcttggtatcaggctcactttactttttctgcatggtttctaatatcccaaatcactcacaagaatctgttagtattgttatccaaattttgaggcattacggtttagagacagcctgtactgataaaactttatggagaagaaatggaaaaaaggaacctaccatctttctccagtttgtcattgcagtaatgatagatagaagagtgacctgtgtcgctccaccagctaccatgcccatccaaaaacccattcctcctagatgcattgcaaacccaaaaaagagagcaacaggaactccgacaagatagaatgcacctaggttaacataggcccctagatgctgccatccacagcccctggaaacacctggtgaaaattgaaatattaagtaagacagttgcattagcat

SEQ ID NO: 59121 - DNA, 21868 bp, Oryza sativa
cccccgctccgtcgccagcaacctctcccccatctgccatcacgcccgctcgactacttgagagaatcaacgacagaagagaagagaaaaaaaaagaaaagtgaaatgtggggcccacaccattttctctcacttacatgtgggccccacatatcaattttattattttcctgactaggatgtcacgtcaacgaaaccaggcatctatactgtcccgggaccttttttttttacgattttacatagtttagaagtatacatttctggtattgcagttaggggaccttatacagacttgacgtaaagttgagggatggccggtgaacttattccaaaactttacagccgttttagcatgtaaattaaccgcagatggggcacaaatttttatccgtccgatatcgaacctcgcagcctcgactgccgtcgagcccgctactccgtgacgctccgtgctctgccccgccgccaccgcacaccactctccgcttcgtttcgttgttgccgctgagtcgccacgtctgcgccgccccatcgccggcgccgccgcgatccgttccgcaaccatctctactactctgcgccacttatgcaaaccggcctcgatcctcaccaccatctgctgcaccagcgtcggttcacgccgggtccgttgtctacccaccttcgctatccataagggaaggaagagctgatacaagcggagagggaatctagggcgagaacgatctgcgccgtcgcctcatactcaccggtccatactctgcctccgaccctttatctctcgtcccagcttctcctttctctgtacattcagcccacatcattggctcattgcttcaacaccctgcgagagattcggcttgcctaggctccgtatcgatatggctttgtgattcagatttgggtctattcatctttttccccttcgccatgttcgttctgtttcagagttcgtttttgttgcaatgactagccagatagatgtcttacccttaccaaatacccaaacggcctgaaaatttttgactgtatgaatcctcggtgttcccaagaataaaagtgaaaatattttacaggtgaaaaaaaaactgtattcccaagaaaatcttccttcaagaactgttggtaaaaggaaatgtgcgaatgaaaattcatttgcagctggaaaatttctgttgtctcagcaatagtttcaagaaaaatctaggtcgctgctcggtgaacccgtcgatttgttcagcttaaggaaagaaaacgataagtgacagaacatggcttcaaatttcaagtcttgcaatatctgacagttctacttctaacttgtgcagataaaaaaagtactcctgtatcgaagcagccaacagtcatccgagcagcagatgccgttcttattttcttgggcttaggtgaggcgcagttgttctgcaaagaggaattaatggtttaattaacaccagctcaaaattccaagtggatcggcctgacttggtttaagctgaatttgagcccatgaggtaatcaaagtttgggccaaacatgaactttttggcccaaaaacttgtcgccgtttgggctattaccttttttagagtatgtgggctaatactccttaccatattccgttgcagtcgattccattccatacatcaacacaagtcgaaaacccttcaggagcatcggttggatacgcgccgcacgcagccctacagcctgctgtcgcctcccggagcactcctcctggtccctggtaaattaactaggtttaattcctccatgcctctgatctcgtatttcttattaatcgatttatcattatcattagctctaactaattcggatttcgttgcatcctcgtgatatattcatgctgtttttcgttttgcgttcgtttgagcaagatagattatagatggataaacgtctcctactctctcatgatcaggctatctggaggcaggattaggagcacaggccatggatgagaaagacggcaacaatggccgatgcaatttcagtacggaagatcctggggaggacaaagccttcgctgcctcgcttgtagatcaagatcaggatccggatcctactgatgctgccctactggataatgagtgttccagagttgtagatcaagatcctcctcctgatgctgctgccctcctgtatgatgagtgttctgcagcgtatggtgctcatgtagccaagaagaacaaatccgaggcaagtcatcttgctggccgaccaaaataaaacactacttttgaatgctactactactgtttcaggatgtgtcctgtatacaaaatagtggtctgattccatttagtgacgcttaattcttgtacatgaacttggtacttgcagtgcatgcgggtgtcggacttgctatgaaaatagatttgccgttggaacttcaaagttataatctagtataccatcatgcaagctccattagcttatgaatgatttcaaataagaccttgaccacataagatgttctcttgtcacttctgcttgaacacttagcatgtcatcttctttgtgacgactcgtactgttatgcgactctccttaccttctgtactacatatatattagagagcattctcacatttatattttttttccatgttaggtcaaaggagcaaacgtggaaaactgggcatgtgtaaatttttctttaatgggtactacagaaacacagaaatttgcatctgagctcaaaaaagcgtgtgtggccattgggatggtaaatccgtccactctttcctgggcaccattactttggcaacatgtgacacatctgacattgactttacataataggatttgaagtctgttcatgcagtgttcgtagacttgaactctcccaataaactagaaagtactttgcatgatgtgcaagaactgtttggcggacaaggagtggaagtaaaccagataaaccttctaattgtaattcttccagaattcagacgttctgatggtatggaagttatgatttgcatcaaccgcacctttatattcttttttttttgttgacagttgcatgcgatgttttgcagcgaaagtcaaagatatctgtaagaaccttggattcttatatcaatgttgtttgcctgagcatgctaggacacccagcaagctatacctgaacaatgttgctcacaatattcgttccaaggtttctctctcattctgtttgatgtgttattgttcttttttccttttgcacaactctcatgctagagtttcttaatcatgttgctgagggcaaaacacttttttgttcttgtgaggagaagagggtaaatggcgactctgagaaagtctatggttctgatgagatgagagaagatagtgagtcagatctaagtgatttggaagatatgggagatgctgactcagacatcatttacttggaagcattccctacatcagatgaagagatggatgatgatgatgattatggtgatgatgatgaatatgtaccagtatctcctgatgaagagatggatgatgatggttccgtgcagcagatgagagagaatgatgaattatgtaaacagctccagcggctggaagagaatggacatgaacaggccgccaatagcgcagaaggctgcctcaaaacctacaaggaaatagagactcatacagcgttagcaggaagtacttattctgagttaagtgaaccgccttcatttgaagccttcctgtgccctggtaaaactcagtttctggtctagtccaaagttaatcaatctaccctaggccagcagcttgttcttaactcttttgtatctcccagtctagtccattcacctttcttaataatttcgtgtggcattcgttgtgccctttttattttgcgttgattgtcctttcttgtttatgctttcttgcttcttcctctgtctccaggggaacgcgagcacattctcaagacaggatgggaaacacaacatccatacaagaagcctagcggcgtgtcttgggatgagtactctaaggtgtttgacaccaatggctactacaaactcagcaacatgcctgtggaggataaggacttggttgctgcagaatgtaacactcctgaagtgaggcgatgggaaaatcacatcagtcatgactatgatgagctgcaggtattgctagttatttagtacttccttcactcataaggttgttttagaaattaacactgtcaaaagatttctgttcttgtagatctattagacctaatggacctttcgataacaatttttactatagagatatgtgcataccattttcatgctatcaatctgaatattgaaaaggacattgacaactgaagtttggaaaatcttttttgatcaccacctcagcctagcaactgttgtaaatttgctactttacttgattgatgccatgatattgtggttgaatcagtgtgttcttctgtttcggaattgtatatatttggtttgtcgattcaccttctttcttcaatgttcaaataatgccgcgaggacaaatattttgctgatgatgttctaagtatcatcaaacaaaatgtcatgcatactcaaatcaaattatgcatcatatagtcctcggatgagatgtgcactataccagcttgtgtgttacaactcttgtatgatagttaatgttgcgtgcttgatgcgagtttgcaagtcttccaacacaaaacaatatgagaaccacataatcggaaagttgtgttcaaaaccagggatctgatagtctgaatataatatttaccttgaacagttgacaaacatgattggggcaacctaagaacatacttggctgatggattcttggtatagttttaacgtttggggtttttggtattttcactgctatgcaactctctttatctctcgtcatgattcataatatctttatagaatcattctcaaacaggcatttgttcccttttaggtcgaacgtggaattgtgagacgttgggcatgtgtaaatttttcacctaagcgtaaacatgcagcgcgggttgtcagtgacattataggaaagtgtatagacatgggaatggtaaagccctgcatactttccttgaacaaggcattctactaatcatgtaccacacatctgacttaatatctttgtatgataggaatttggtacattaccaaaaatggatgtcgatgtaccccttacttcccttcatatacgacgtactttgctggatgtgcccaaaaagatagacattctaattgtgattatggcagatgatagaagttatgatggtatggaagttagttgtgtcaggttcactgttgattttcttttttgacagttgcatatgatatattgcaggggaaattgaagagatgtgtgagagccttagaattgtttatgttttctgtttaccctgcctaagcaaacggaatctgaagagagttgcacgccaaatacaattgaaggtcatttctctttggtctcattttgtttgttatagtgttatcatgtttttggtttattaatcaggttgtaaagagttatgtacgtcgtcagcgactgcacttaccccttgtgtcagaagtcccaacgattttttggtgctcacacgatacactatgatcttggagaggattcagaggcaggagtggattcagagggcattgcatctgtatgtctcttctgtaactaccatctcctggatttgcgttttgttgttacacaatccaattggcatcatattttttgttggagtcatgtaggtggcggcttcattggactggccaaaattcagaaagtatcatacattaatttcacatcaacctcataatggcatcataaatctccattctagacgtggtggcatgatgacgtaattctgtgttctacataatctgtagctcaccgtcactttgatccatttggtgtactaacatttttcattttttttccagcaagttctttcggtccttctacaaaatgataaaagaaagacccaagaggataatcttctacaggtagtaatacttgtattccttgattagtgtgatactattagatatatgctaacagtgcaacatcttgcacagaggtggattaatggaaggtgagatggagcgcatttgcctgcaagaaatagatgctattaaacaggtaggaatacaatatgatttgccttcctgtatcttggtttgacttgctcattttgatggttttgtgcttcttcccttgaaaggcttgtgcctattcctacaaagaagatcaaccatcactgacatatgtggtcgtggtgcctactgcatcaattggttagtgtgtttgctgattctgcttgtagtatttcctttttaccgagtgaggtgaatacacatacatgctacttggctttggtgactgggtattgtttcataggaactgaggctgacaccgctaagtataagttcttttgccgccatactactcataaggtacattttagtttggtgaatctgcaaatatactcataaggagttgtctatccttgaaaaaaatatattgagctagtattggttgactgtagtcaacctcccgcgtggtccgctaccacgttgtccatgacgacaacaactttctagctggtgaacttcagtctctaaccttgaagcttttcaccttgtaagtttcacagctctacttttggattgctttgctgtgatcaactatcagtaggcacttctgaccatatttgcaaatgcatgttcatacccagccgtcatcgtcgggaatacccaaagatagatgcaggtgagtccttttatactacctatcaatcaattattcttctttcttgtgtctgtgttttctttaaaaaaaaaggtgtgggggttccgtgttgtcgaaagggtagggggtattctggattttggaaaggaaagaaatgctgctccaattggttgatgagcacaaggggcagggcatgtccttttttgtgatttattttttacgagtaaccgaacaatgagggcatgtccttttttgtgatttgtgtgggagcatacattttgcgctagtaaacactactatccaaagtataatattttttttgttgtttgaccaagtttatagaagaaacgataatatttgtgatatcaaatgagcatcatttgtagtttacttatttgacatggtcgatgtattctttctacaaatttgatcaaacttaggatacccctccttttccaattgatcatcgtacaattgttttaggttattctgaaatgatcatcatactagtattcattttttaagtctattcattatttgtgcatggaagtaatggacatgtgatgtcttgtttgttattgggtagaacatagtgaggatggctcatatgagtttgttacctcagtaaacgtagtttttcttggtcttgttgcactcatgtaatataatgataattgggaatggagggagtacttcctagaaatgcttatattgtatgttctgcttatgccttgcacatcggatcacttatgttttattactcactgcttattccattctatctagttgtaccggcctactacgcagagcgtgctgcattcaaagcttatcgcgcagagtgtgctgcatccaaagcttcttaagaagagcaaagcgagatgagaatgttgctactctagcaaaaattaatcagatgtttatctaacttattaagatgtctggtgtattttgaactcaaaaacgagtgtgcatatggtaacctgttaccgctgttgatcagacgtgttatggcgcttgtttttgttaatagttcaatgctgcgggttttgaaattgcatgtagtattggtcttttttaagacagaacaatccttgtacattttcaaatttaatatttatatatatcatgatttgaatggaagtactatctccattccaaaatatagcaatattttttctatgtatttggatataacattgtcctaatagcttgaagtagttatatttttttgtgctgaacatggacgcgttgcacgtgctccggttgtccggcacaaatccatcgtctccgcctgtggtgttcgataggcagcgctttcagtttggttaatatggctgctcaggttggatttgcaaggaaggagcgattgggtaagatgaaacctggaaacgatttgtgccgatttgagaatttggggtcttttcgccatttgcgcaaccaatctacactaaaaaaaagaatataaatccaccagaaagtgatgaattgaagccaaaatgataaaagtgatgaatagaggacaaaattaaagatatagaatgaattctaccgggaaaccactaccagaagaccgaacgatacataacacacctaatttcactgttctacgtctatttttcgaagtgtttgcaagtatgagcggcaacgggaatcatcggaacctacaaatgtacaggttatgtacattaaccaaacatgcacacagagattagtgcacagctcgtagagaaaggggatcagatgtaatctgacagaactgatgctgagacccgcttcaaggatgaggacactttggagatgtctgaatcggtgtggccggctgacatgaagaggcgtattccgacgggaagtttgcacctatccaaaggtgaccgctttgacgccacgataaaaactgaatcttccttcaatacctgttggaaataggatgctgtaaatatatgcaagtgaaagttcatttgcagctggaaaggttctgttgtgtcgacatggacttaccctctcagcaatagtttcaagaagatctatatcggtgtttgatgaacccgtcgatttcttcagtttgaggaaaacgataggtgacagaacatggctggaaatttcaagtcctggagtacctgacagttctgcagataaaaaacatcgaaggcatcaaggtgatcagcaggcaccagtaacgacatattatgcctgaacaaattcaactattgaatcccataatgtgtttcacaatttcaatgcagctgttttgaaactaccactaatgggaaaaatacatgataaaagtgatgccacaacattacatgctaggtattaaagcattaaaaactttacatctacattaatcacattaaaaagtaagtaaatgttggtcaaataagtatataaataacaagataatcttcttaacctttatgcaggaaagaaatgttgctcctcaggtctgcaagaactgacgggttcccctccaggtagctgacagcagaaaccgcagcgctggcaagataaggtggcagagaagccgagaaaacatagccagaactgcttagacgctgcaaaagcacaataacttaataggtcaagatatttaacaacattctattgcaattgattttccgtcaatctagagttgcattacctgatgatcaacaactctaacacttcctgtacaaaagccaccatcagtagctaatgcattccccattccagcagtgataatatcaattttgtcaatctgcacatgcaagaaaatgtaagaaataagatgtgccaatatatccaattaaaatggtcagtaacacaattttcataaattaacaggtgtctaccaggactccatggattatacctattctttttaatcttctactttggtgcgatgagagaacaaaaatgtcaggggtactcactggaactccataatgttcagcaaggcctcgtccagactggccaagcacaccaaaagaatggctttcctccagaataacacggaatcgatatttctccttcaatctgacaatctcatccaagggagcaatttgaccagaattctgcaatcgtcacagtaagagaggatatatccaaagtcatatgtttaaacgatttcatgattttctaggtcgtaaaaattcatgagaaaaatgagaaaaaaccatactcatgtccaatcagagttatcataaaaggcaccacacctggtagatagattctacaacaatgtatcgtctgatcttttctgctcgtttatttccacgtgtaagtttttccaaagtgtttgcaagtgaagccatatcattgtgtttaaaataaacaacagtgcttcttgacagatgaagaccattttgcactgcccagtgcacaccttcatcactgcaatgcatatagaaaacttgcttaggttcaaacatgaaaaatcaagaaaagaaaagtgctacctagtaaaagaactatccaggtatggagctaattgcatgaggaagaataacaactaaagaatagatacatgtaagaggtgacaactttgaagatcacaaggcagacatatacactactttctaaagggtttgtgcaggattttcattctttttttttggttggggggggagggggggggcaaggaagcagttttcatttgatttctttcttacaaaaggcaggtatataaaaaatgtgaataactaaaacatttatataagctgttgtactgaaaaaaaaagagaggacaaactctatatgtgccggtattgttcatattactatgtgggcaaaaggttaacttacgcaactatgatgtctcctttcttacaaaaggcaggtatcacactaaatattgtagaaatcccatatgaatacagaattgagtctggagttccaagaaacttcgctatttttgcctcacagtcaaggtggacatctgcaagtgttccacaatgaaaagataagtttctcttccatatttgcaacacagatcagtggtggcaaaaagagagtatacaaaccaattgttccataaaagccacgtggaccacaagaaccaacaccatatttctccagtgaaccaacacaagaatcctgcaattcacccatgtcaaatatcctggaagaagtgtcaaaataactcctaaataatagagttttggcttacaataatcttctcattgccaatcaaaccaagataatttgctgatgcaaagtttataacttctttcccatcaatggttgtatgtggagcagcagcactgtagcaagaaacgtaatagtgttaagacccccaaaactcaggagaaaaaacatgcaatgcccaagaattgcaggtattctgcaaacataaacattctcaattccagcattacacatccataaacaaggactcatcaaacagatgatatatcatgcattgcaatatctgagggaagggcaacaaaatgaatattctacgagtgagagttatttgagattggccacgctatgttagggatgctggaagttactcctaaatttgtattattcagaaagctgctgtccattattagtgcaacgcaagcacataaatggagtattgttgataactggataaagatacaagattataacagatggaggacaacttttataacaaaatactagcaagatgcatttggcagcatgtattaagtcatttgatgttcttattaacgtcgtaaaaagaagaggaaaaatgtttgagaagatactgcaagttacagaaagcagatggcgattgcgaatcaactataataacttcaagaaaagttagtctgcctaaagaatagaagattgtaagcatttggaaagcaagggatacatgatacttcaagtgattcatgatgccctgtattcgtctaaaatttgaccagatttgtggcatgcaaatcatctttttgcatgcagtatttgtcaagaataaaggttcaagtcaatattgccttcccacatgctgcactgcctagttaagttaaccaatgcttgagcttacaactgccccaatcctgtcatgctttctctcatagtttatctagtaactcactacttatgaaataatatagaggaatactgaaaacgaattatttcctgcaaggagctttaagaaactaccttcagaacagacactatcaaacataaaaacttccttaaagtaagaaaaaagaactcccatatggtgcatcaactaccgtttaaactttaattagaatgtaaccatcatacaaacctttccaacattggtgtgtcaattcgggccccatccttgatcggaggacacagaggttctggctcccattcatcacatagctcgtcaatctcctgcaaagatcaaaatgctaactttcaccaacaagttctggaaagcaatgaccaaaaccaatactctaacacaaagtaacagcgaggaacaggcagaagataactttaccttttcactgagtggcttcttgggcggtttgtagctcttcctagaaagctgaaacactatgaccgctataaggagcccttcaacaaccaggtgccctgaaaaatggaatgttaccgaatgtcgatcgcccttatcacatcacaagttcctcattgatgtggacgtaagaggcttaccatcgatatgaaccccaaagacaactgcgcgggcaaaaggggcattgaatgcagctgagacacgagcaagcaccgctgcggtggcattcactattggcaatgccatgtccatgtcctaatgcagcttttcgtaacacggaatggaaactttagcgcctcaaatctgccaaaaaaggcaatgggctgctcatcaatcaaccagatcggctgcagagcagaatcaatgttgaaattcatataagagtaaattttactttgggccaccttttactactggtgttttgctttggaccaccctttaactaatattttcactttgaaccggaaaatcttacctttgtgtcactttggagcacactcaaatcttttatctatctacatcaaacttgtcatctgtcaaataaattgccaggtataaagcggtgggaattcactgatgaatcggagccggcgtactcgaaatcgttcatatgcttgagaagagagttagggtagtccaaaatgcaacaaaggtaagattatctgatccaaagtgaatacgttgattaaagggtggtcgaaagcaaaacaccggtaataaaaagtggtccaaaatgaaatttatactccttaaggtcaaggattgaactatagacacggaatgtaatcctcaggtccaggggcgaacgatacgtgcgccacggcggttgatactactactctactagtaaaactaaggctactaagaagacaaggtgaaaacctagcttccagatctagaagagaagataaggttactgcaaaattcgagagaaggcgtgggtagaacgggatggatggggaaagagagaggatgtgaggtcggcacgggtgctcaccggagccggaagggaagcggggagcaggacgacagcacccggtcaccgctgctcgtggaacggatggagatcggcgcggcgcggcgggcgaaccagcgaggaggagacgttggggatcgacttgggcgcaaaacgagtcaaagaggggagaagagtatgcggcggccttgcgacggccagcgcaagccggatgtgacaagtcaagagagaagagacccaatccgttatgcttgcacgttgctttgttgtttggctttccaaatcacgttttcgatctgctaaagggccgtttggcacgaccttagactctagcttcatctctactcaagttaaaaccaaaccaaacgattaaacgattttagttccaccttaaaaaatgaaactggctaaaatgctctcacaatataaattagagatgtgaaactatgtttatgtttagtctatttcagacctaatttttaaagttaaatttaaaagttggtgttctattaaacgggtaagtctatggctttccaaatcatatttttatctattaagtctgggagtgaccgaaataaaccgaagtagcacaatttatatatgttatttggtggtcacttatgaaagacgatatatagcctaaaatagcgcaattaataaatcatttgtcaatttaatttaatccgagacgctttttaagtgaatatataagaagactgcgaagaacctatgttacttatttggttttcagtgatgtatgtagatattataaaatgatataaatagttctacaaatatctgtcacgacaattggaccaggtggtgcatgagtttttttttatccagagcataggtggcggtctaatctagccactaagatatatatttctatcaaacttttatacttgggagatatttctagtcgtttctttcatatatttttttggccttgtgcattatatgcagaggtcggggatcactcagttagattttattctcttgatgtaatgttattaactaagtttaaataaagcttacattatttaaaaatatatatgtttttataaaaattaaagtgtgataattattatcaatctgatggttataacacattataaatattgtttaagtactttttaccgtctacatttatatgtttgtttagacgatttaaaattgccgatgagttataataagtcaacttgtaatttatatataactagcaaattgtttgtgcgttactacggtttataaaagaacaatgatacgattgaagaccttttgctaaccttgtgcacagtgtaggaagaacattaggaattttcagagttgcaacaagtgccaaaccctaagttgacacccttgcttgtggaattcaagttgcatcaccggaagcttgggtttaaaagaaactgacatggatgggtttggaacattcaaagagtcacgaaccggtttcataattgcaaacctaggttaatgggcaataaaccgattgaaatcagagaggaatattttctcaataatagaaagccagctaaactgaattgtgttcattgtgttgaactgatccagcaatgggaccgacggcggttcaccggcatcgacgatggaggaggccatgacaggggcaggggcggaggtaggcctagggtagttatggcttgactccaaaatcatgttgaaatttcttaaactagctgggtggcccacgcaattgcgtagctagcacataacaatcatatattttttaagtatgattttacttaaaatttattaaatagatgtctcattgttaagactttaaaagaccaaatcttatcatcctcatgtttttaattatatagtttttaaaaattacaccaattgctaccccttatgtcatctccttctttatttgcttgctcgatctatcactatttctattcattcttcttggaacctttaaaaattggatttttacagtttttcgagtttattgtcacgttgggtttcgtttttataatttctagatgtctcgtcaaatgttgccattatactcctctatgtctcgtccactatctcttctctttattgtcattgagattttaaaaatcgaacgtaattatagtttaggttcatttttaatttctagaagtcccgccaaaccgtcagcggttttgccattgtactcctctacggctcgcccgctgtcttccttctttattgtcattgagattttaaaatcgaacatgattattattgtttttttttactttttagaagttctaacattggacttgtagtttcattttttattatttttagaagtcccatcaaacgatgtcactatatccctctgcagcccatccgccgcccactctttattgtcattgtgattctaaaattcgaacataactatcgttgcaattcattttttattttctagaagtcccgtcaaccgttggaggctctgcaactatactcttatacaccccgcccgctgcttctcctttttattattgtcattgagattttaaaaatcgaaaatgattatcaatatgttttttcttttttactttctagaagtcccggcaaccgctttacttgtttgcttcacggcctgcctgacgtccctccttttaatcgtcattaggattctatttggtgttttattaacaatttttataagtcgtatcaaccaccaccaactctactcttttataggcctgttacttaatttatctcgtcatgtgttttagatggtctttttttttcaatagtctttatttttgtcacaaaatttagttatttataaattttattcctaattgaaatcttttttttctatttcagaatttattttttcaaaaagatagttaatattgtattgtgttcttttaatgtttttattttttattttcaatttcatttgtttcaaaattgtatttctacttgagctctcttttagttttttctaattttggatattattatatttttttattcgaaattttaattaatctcgtattgggttcttatatggattcttcttttaacattgcttattttaattccgaatttcagctaattttaaattgtattcctacttgaactcttctttattttcttttgctaatttaggatttatttttatttttattccgaattttaattaatctcgtattgggttcttatatggactattcttttaatattccttatttttaattccgaaattcaggtatttttaaattatattcctacttggactctcgtttccttttctaattttggcttttattttatttttatttcgaattttgattaatctcgtattgggttcttatatggaaacttatttcaatattgctaatttttaatttcgaattttagctatttttaaattgtatttctacttggactctccattccttttctaattttggattttattttatttttattttaaattttgattaatctcgtattgggttcttatatggaaacttcttttaatattgcttatttttaattccgaatttcagctatttttagattgtacttctacttggactctccttttcttttttttttctttttcttcgattaatgtgggaatttctagcccctacagcgaacgtggtgtctcctttcaaggctattttaataatataatataatagatagatagatagatagattaccatataaattttacagaatatgaacaacttattagttaagccttagggttatccctattcttcgataatttctgacttcgccactaggccaaggagggttgagaggtactgcttctgggactgatgaggagtgccgagacaatggagaagtacataagcacctcgtggatgaaaacaccaagcagattgagtgattgatgtagcaattatgcaaaagaagagaaaaatctagacagttcatgtacgtacagatagggttcatgagaattttttattaagaaaactgcagatcgactcatgtacatatgaaaaacccgatcagacttcatacaacatatcaaaggttcaagctgggaggaagaactgttgtacatgctatgcattgcacgtagaatagttcttcgcgcagagtactatacaactatgcacagctcatgatcatgaaagtgacagcttgcagttaggttcgatcaagctattgtaatgtccacttgcagattaaagaagaacttgatgttattgaaaagcaaactattatatactaaaagttcattaaacttcctagaaatactttcaaagcgccacgtgatattctacaaatgcttctacgccaccacgtggcgctctaataaatagagaaaatcatataaattctaagaaaaaagcaaaacatccaaccatcaatttttatttaaattgatggacccgttattatcaaccattagattagatctatcgagtaattaacccctccctcctaatatctctctctgagtatgcacgcacataaaaaacaatcatacggcatgtacgtacgtataagcccacctataacagatttttacctttctttttctcaagtacttttattcactatataaaacacaatcgtggattagtttccttttgaagcacggcatactcatatgttacctcacctcacgcatatatattttaactcacctctttaaacgtattcctataagagaaaaaaataatacataaaccctgtgcccaaaataacctaatcctaagatttatccttaagattggattttattttactaagggagtattcacgagaaaaaaaaacataagtacgataaaaatcctaccaatccttcactcctaattctcaaattaataattaaaatatttttatgtttgtatgtaatacatacagttagaccagcccctcctccgtagctcctttcgctcatgtttatatgatagttaaacaggatttatgaattaaaaaaaatactacatcccatttaactatatttgaataaaatactatcacatggaacaatattataatccttttattatgtctttcgcatccaaataatctttttaactggcagcggtactatattcagttactgactttgatcgctaatctttttaaagaaatatataaatatgtgaactacatttttattaaaaaagttcacatggaacatattctatcccttttcatgtcattctcatttaaatagtcttaacaattagcataaataaatttaacaacacagattattctatcatatattatcccatgaacatgtataggtgaggaagatctataataatacaaggaaaataatatcaaggcccatgtaaaatcatatatttgcaaagaattattacttgcgcaaatatttttccacgtggttctcaccactaaagctattagattttctgaattagtgtcgaatgatcaactctgctaagttttaaaagagaaaattatatttgtaccactaaaatttagtagtactgattaataccataaaaacaccgtgcctactctataccacaaatcgattcaaaacttaaaagaactattttcattacctctattttctctatgttattccctaaagggcacaaagtatggaggacagggcatgctacgatattgtaaatactatgacaatattgctaaggtgatggtccagtgagaggtcactgttgttaatagagctcagttggcttagttactgatgcaatcatttattattgtaatgacaatgaatgttgaaattgtgccccacactgatcttaaggggtatggcaacgtcgatgcgaaacccatggtttaaggcataagagaagaaaaccatgacgggctatgttatgcttgatgcgttagaggaacatttatatataattttagtgattttatcatattaattgataaaagcgatattttttaatattcatacatagtttagtagatgacattagtgtcatggagcaggacgggctcagtaagtatgttgttcgcatgtatggaggttttttggtgaacagtatgtattttatggcgtacatatatggatattaggacagagaggtttctataaatacaagagatatttttaggagagattaggagagaggtttctatacatataggagattttgcagcatacgtgtacaggagatcaggattacatatctactccctccatcccagaatataagcatttttagagttggacacggttattaagaaagttgataggattaaatggggggggagggtgttgtgattggaggagaagtgaaggtaggtaggaaaattgaatggtggagggttgtgattagttgagaagagaatgttggtggagaagttgttatattttgggacaaattccataggctataagttgttatattttgggacggggggagtaataagtaagacatggacactgtgaagtgaagatggattctttattatattattgatatattaggtttatttttaagtataaatatggttctatctattaaaagagcacatacctttaagacaatggtaatatgtagtggtgatagataagtatatgtataaccgggataaagtaacttttgtttgaatatcatttgtctatttgacggtatacatattacttttatgattataattaaagtaatctatggtctttatagcgaatatggtgatatatgacttcttttaacattcttgccggcgcagttgtgcgggcttccttcctagttgtaataatgttgacaagtttctaccttttcagtagaaaaaaaatgtacgctgatgaattttgcatggaaaattaaagaaaaccacacagtaactgaactcgatgtagggctcacgatctgctagaaaaaagcagcattttgcctatgcttgataagaacatgtgaatccataagttcatacacattcagaccggcaatattcaacatcagaaaacccttatcccaattaacaaaaatccatatcctgatggcgcttggggaacagtggaaagccttgcagtcgatagcttattagggttgatcggcagcgaaggcgaatcaatcagtagaaagattgtaatgctttcaatttcgccctcatggaagctactgatctgtacatggcccatggatgcaaccgatctggacgtatcctcaattgtatcactttttgtagacttcttgaactattattagtgagatagaaaaaatgtaagaacaaaatcaaaatagagttgaaatatgttgtaagtataggggatatagatccaacccggtactagcatacctacctaggtttcatgctaacatcggcacataaactatacagcatcctcaacagtatcatgctttgtagacttctagaactattattggtgagagaaaaaattataagaccagaataaaaatagagttaaaatctattctaagtataggagatacagatccaagaatggtcaatgttaattagagttgaatggaagctatgagtcgtctaataattgatctcataagggttttaaagcatcattggcatgcttttatctttttaagaattatatccgtactcaaagttgagtttacaaattcaggtccgattcgagagttgaagaactagcttataagcatccagttggtgaaaatatatagaaactaggttttttggcttttaactagtagtttattctttagattctatagctatcgcttctcaaaacctgaatgagaatataggctatttggttgagctggatattctagaagtagttatagctgctgaaaacttctcaaatagggtattagctccaccactagggatgaaaacaataatgtttcaaggtatttgtggtgccagcttcccaatataagaaagaataaggaggatgggttgaccgaggaaaagttaccacatacccttcacacattggtgtctctcggcctattcacggccttcaccgtacatcgacagtccttcggatatacatgtcccgcagacacccacggtccatcagaccttcacacattgatgtccctcatccaattcacccccccccccaaccccaagcttggctacttgtgtttgatcctaaaatgaaaaccagggttgacgaaaacacaaggttgtcgttaggacctaggactatattccataaggagaagagcttcatggcaagagtaatgcaccgtgcccatagcccatagttccagcttccacctaagaaaaaggtgatgaagacacacataaaagtacaggccatccaatgcagagtatcttcgaaatggggaggattggtgaggagtagcaagcgtggttcttttttcgggtgtgaggaaaccgggactttaataggatgcacaaaacttgcaaagacacgggactcacctccttttctcctccacgtcaaggtttggcgtagctagaccgacgaggttactcgccacgcaagcgccctgtgaagggcctcatgctagcaatagttgcagtggtaaagcttcaaaccaagaaagagaccaagagaaacactacctctacaaatttgataaggtattttgacagttagtaaatcaaaaacacatatacttctttcatagtcagaaaccaaaccttgcattccattacattaattagttaatcaagaccaacaaaccacacgttacaaagtagagccagatacattttacatccctgacaac

SEQ ID NO: 59122 - DNA, 24395 bp, Oryza sativa
catgcagaacatccaaagtgaagtagtaatagggagcaacagtttctgtgaaatcacgaacaccaaaattaatgactagacacaaatggaaagtttgtggcaactgcaagagtgcatcagatgcatctattatgccaataattaagagaatgaagtctgtgatgcaaagtgaggacttctctagttctggaatctggatattaattcctacagttttatcttccattggatgcagtcttaccttcccagccaaatgccagaagcactgaggccataccgtgaagacgagctgaggtacctcagaggggaggacaggcaagggccgtatcaagagcatgaccgcatctaccggtacgatgtttacaatgacctcggtgaaccagacagggacaacccacgccctgtcctaggtggctcgcagaagcacccctacccgcgtcgtggccgtactggccgaattccgaccaaaaaaggtacagtgttcctcttggttctgtgcatctagagagcacttcttgacagacaagttcataaactagtaagatctaatttgcgtgaatatccatggctgcagacccaaactcggagagcagattatcactgctggaacaaatttacgtgccaagcgatgagcgcttcgcgcacctcaagatgtcagactttgctgggtactcgatcaaggcaattgttcagggcatcttgcctgccattcgcacatatgttgatctcacacctggtgaatttgactcgttcgaggacatcttgaagctctacaggggaggcctgaagcttcccagcatcccagcactagaggagctgcgcaagagcttccctgtccaacttatcaaggacctgcttccggttggaggcagctacctgctcaagttccccaaacctgatatcatcaaaggtaccatgatttagccattgtgtcaattgccatagtcgatgagcagtggacaattagcgaactgttgtactatgcattgttgcagagaacgaggttgcttggaggacagatgaggaatttgcacgagagattcttgctggtctgaatcccatggtcatcaggcgtctcacggtgaactatccaacattacatagtctttgatgttttgtgctcctagcaagcatgaacaaaacaagctgatgctaatgtataattctctgttcataggaattcccaccaaaaagtactcttgatcctagcaagtacggtgaccagactagcacaatcaccccagctcacattgagaagaacctcgaaggcctcagcgtgcaacaggttaggcagtgatccatttcatttacagtgcaatcgatagtcatttgacaaactgccaaagttgatttgttgtcaattatggctctgcacaggcactggatagcaacaggctctacattctggatcatcatgatcatttcatgccattcctcattgacattaacagccttgatggtatcttcacctatgccacaaggaccctgttgttcttacgtgatgatgataccctgaagccactagcaattgaactgagcttgccacacatcgagggcaacctaacatctgcaaagagcaaggtccatacacctgcatcaagtggcattgagtcttgggtgtggcagctggccaaggcttatgttgctgttaatgactccggttggcaccagcttatcagccactggtacgtactggcagtggcaaactgtagttctttcctgaaagcagtaagctaacctcatcattgatgtaaactcttgtaggctcaacacacatgctgtgatggagcccttcgtgatcgctacaaaccgccagctcagtgtgacacaccctgtgtacaagctcctccagccacactatcgcgacacgatgacaatcaatgcattggcacgccagacactcatcaacggcggtggcattttcgaacaaactgtctttcctggcaaacatgctctggcaatgtcttcagcagtttacaagaactggaacttcacggaacagggccttccggatgatctaataaagaggtaattaaacaccgagagccacatcacaacaagaaccaacaataacataactttgaataacatcctaattttgtaatgcagaggcattgccatcaaggacccatcaagcccatccaaggtgaagctactgatcaaggactacccttatgcaacagatggcctggcgatctggcaagcaatcgagcagtgggtcactgagtactgtgccatctactacccaaacgatggtgtcctccagggagatgtggagctgcaagcatggtggaaggaggtgcgggaagtcgggcatggtgatctcaaggacgcggactggtggcccaagatgcagagcttgcctgagctcaccaaggcctgcaccacaatcatctggattgcatcagcactccacgcagccgtcaatttcgggcagtacccatacgcgggctatcttccaaaccgtccgaccataagccggcggccgatgcccgagccgggttccaaggagtacacagagctggacgagaacccagagaagttcttcatccgcaccatcaccagccaattccaaaccattctcggtgtctcgctcattgagattctatcaaagcactcagcggatgagatctatcttgggcagcgtgacacgccagagtggacatcagaccccaaggcactggaagcattcaagaggttcagcaggcagctggtggagattgagagcaaagtgttgaacatgaacaaggaccccctgctcaagaaccgggtcggtccagccaatttcccctacacactgatgttccccaacacgtcagacaataagggggcggctgaggggatcactgccaggggcatccccaatagcatctcaatatgagactgctgcacgcgtcacgcgctgctgagttggtgtaggtttgtggctgttatcttaggccctagggcacaagcaatgaagctgcatagtactatttgctacaaattatgcaagaataaagttttagtgctaataataaagttactgttgtagtgtttgtcccatttttaagcagcttcacatagcaagctcaaatgaagaggcaatgctgcaatatggatgattaattatgcagctttactcctatgatgttagggaggcagcttctgtggtcaaatttgcagcaataaaattcttcaaatttcctcaaatgtaatgattatatctcattcagtcacagatcgattcttacttgtaaatctagcataaccagtagcggaatcagaaattaaccacaaggcaggaaaacaagggctacgaagtgatttgattgccaatttgccatacagctatatatcgcgcgcgcctaattagttccatggcaacccgcatcgacattttgctcttttgctcacataggttgtagcattcagcaaaacaccaccttcgacacatgtcagaagctcttactagacaacaacacggtcactatccatcgcattgcgcacaaatccatctagtctacgtgcaagcagagagagcatctaactacgtggacattgcaaaatttaaaggggatgagaggggaggggaagggaaggagtggggagatactgaacctggggaagcagagaagagggagccgccgtcgtctcggtccacggcggcgagggcacaccggtggtcgacacgctcaagccccccacgaaaccgccatatcgccgccgccggccggcgccgccgcggggtcatcggagccggaggaaccgatttgtctcccgatcgaactgggctttgtattctcgctcgtttgctccgccgaatccaggagataaatgggccgaaactaggtagtaacagtttagacctgggcttacggcccataagcctggacgtccgggcctggttctctctaacatgtgaacctaccacttacatgcaatgtgattaggcaatgttccatgatataccactccgtgcaaaataaacctaattctagctacgaatctgaacataaatatgtaaataagtaaaacagaacagtacataagtggaacggttaacaagcgtgcacaactttccatatcacttcagcacatagctaataattgcacaaatctagcttgaacggaacactaaccaagcaattagtgtgtgagcatctccatttgcaaattaaacatgcatattcgtactggctggcagcacagagcctcccttatttgatcacacccagtaatcaacactgtcgtctacacaagtcacaacacatatggatgcacccagtttcggacgaatttagccggtagaaattgatcagttgatgcagacggcgcggcaggcctggccacagtagttgaggcacttcgagtagtaggcctggaggcagctcttgcagccggccttgttggatgggtcgccgcaggggacgctgcagtccgagttgcggccgtagcccttgcacgacttcttgcacgcgtggtcgcacttccggcaccggatcggcttcgtcgccgtcgccggcgccgccgccgcggccaccgcctccagcggctccacggcgaaggacaggaggagcagcgccaccacgacgcaggcgaccaccctaggagaagaggcgccgcctgccattgttcagaacttataagatagagaagatttgcaagtgaccgaggagtttatattaagctgcttgatcgatcggctgcctatttataggcagtacgcgagtacaggcgaccaccgggtaccgagatgtgctgtgcatgatcagcatgcgtgcatgtgggggtagcgtgcgtatgctccgatcgtggtaaaatgttgactaattaaggagtttacaatggcaagtcgatgctcaatatattgcaagtcagagcatctagacctggtttaatcagattcgtacatgatgattgtttgaccatcctagctaacatacgactacagataagcatatatcggtttaagtaaacacaaacataagaagctgtattggtttggtcagatgcgggatgatgagttgatgacgaagacacgcctccgaacccccggccgcctgcaatcaggcaaactaacggcccatctatagcaatgttttaaatagcgggctaagccatttagcgattagcttctcaaacagctatagcgacagctataacggactaaatggagctatagcggctaaattgtacatgagagcaaatagctaacccttctcaaacaattatagcgggagatagcggcagctatagcgggatatttaaaaccctgatctatggagagcgtcagagcgagtggatgaataaccaatgccaggctgtccctccgtctttgtcagttgtcacggcttcatcggagcagatggccgctcgccgccgacgaacgcgaggacgcgacgtcgcgtgcagcctctcgtgcacgtacggttggacttgcgatgggtttcctctttcggatacgtcgataacgtcgcctcgcccaaactgggcctggagcggcatcgtcaggacaatgatgagctattctcaacctaagttctactggatgaaaacggtacggcatttctcgacggctcatctgacctatggctcgcggaaagaatatggtatgtttgagaaaatgatatactggtaccattcgatttcgaattcaaatatgtaaggatatataggttaaaatacgagaagagttgcatgttggaagcttgaaacgatggttatttaactttttgctaattatagatggagattcacaaatactccctctgtctcgtaaagagacaactcctagcttcccaatgcatgattaaagaagaggataaaggaccaaaatacccatcattaatagcaaattagtattggtagataggtagataaggggtattgaaggaatacaatttttcgatttacgaaccgataatggatgagaaggtagaagttaatttattttgggacaaagtttgaattccagaagttgatgtattttgggacagagggagtatacttcaataaatgtgtactccgtatctttggttgggtatttcttttggttcggtgggtttttcaatgtttcattaaactacactctttttttattgctagactgtaataattggctatagctcttctgagtaaaggccaggatgtttgattccattatctaaaaatgtaaatctattataaattcacctacggatataatataagattggttaatcaatattttacgaactcacatgtaatattgtataattttttccttaatgtatctcttttaacactttaattgtctccctatatattatacaaatagatatctgttcccgaatttaattctaaaaatataatataggataggatatcggatgaatgatatgttattcataccggttccgaacttgaaaggaaaatatgggttagggcacttagcctagtgggtttcgaacttgcgaaagggcatgtagcctagtagttgcagtgacatgagtagcaccacaaggtcttgagtttaaatctccataggagtgaattttagattgggttgtttgcggggctaagttaccaatttaaatagcatcatatatctggttggatgtagaggtcaggtaaaaaaaaaccattctctaaaaagaagtgttaggacatggcgttgtcgagatccgaccaggggcgaatccaggaacaaaaaattggggggaaggggctcaattacgcagtttctttaacatccagccatctaagaacctttagtttattattcgtggtgaaaaaaattgaagggggtgctctgggggtatccatcgatcttgtggttgtaggggggactcaagtccccctgcacccacgttggatccgcccctggatccgaccgttcccgatccaatttcaccttagaaagtgtcgctggatctgccttgctcgtgttcggatctgttcgtgcaaggctaaattgtggcgtggggtgtctcctctgcatcccttgcctggatgacttcggcgagcaaaggcacaggggggggggggggtcatgagttgctgaatttggatccattggatccagccaatggttaagacaaggtggcaaacgaaccaatcaaagatggatgaaacatgaatgagggttgtaggagttcggactgcctatcgagattggcttattccattttttgtgtggtatggctcgttaggcagcagaagatcgaaactagtcttttactccctccgttttatattataagactttctagtattttttacttcatatatgtgtctagattcattaacatctatataaatatggacaatgctaaaaagtcttataatatgaaacggagaaagtagcgttttagctttgttgtttctcagttataagaagataattaaaaaaatatttgcttctgagttcattgattttgtttctaaccaaatagaaacagtgtcaacaaagctacctacgtgcaaggctgctatgcatagacccaaaggatcaatggcttctacaaatatactcctaataaagagtcacaaatcgatcaaacacaacttctaaaaatactccctccatcacaaaatatttgacgccgttgacttttttttaaaatatttgactgcttgtcttattcaaaaaatttaagtaattattaattctttttctatcatttgatttattgttaaatatatttttatatatacatatagttttacacatttcacaaaagtttttaaataagacgaatggtcaaacatgtttaaaaaagtcaacgacgtcaaatatttaaggaaggagggagtataaatataactaccgaggaccaagatagcgataattaaataacataataacactcaaatgcaacaaaagcaagcgcgcgcccgtctctccagttgtggcatccagctgctaattaaacgcagttggaacggcagtagtcgccgcagcggggcaggcacctgtagaagtaggcctgcatgcagccctggcacgagccgcaggcgtagctgcacggctcgctgccggcgccctcgcaagaggagttgcacatctggtcgcactggctgcaggccatcggcgccgcctgcggcccggcggcctgcgcctccgcccgctccacggcggaggactgcagcaggaccagcaccacgtacgatgcaaacggcgacggcgccagaggccataggagaggaggaggcaactgtgagtttgagttagggcctgttcactttgatataaaaaaaacattaataaattttggcattgttgaaattttggcaactatgccaaaatttcggcgagttgctaaaattttggcaggatttcttatatagttaccaaaatttggcagcaaactaaatttagcttttttttataactttaccaaaatttgataagattgaaaatggtatcaaattgaacatgcccttaattaactagctctgatgaattgattggccgagagttactgtatctctctatttctatttataggcatatgggatatggcaaatgcaacattgtttctagttatcagtatggatatatttatactcaacgcatgtgcacgtcatgcatcagataaggcatggtaagtgttgacttcaaacgtgaccttgcgccattttattttctttataaagtcagagcttctgatttagttaaatcgatatgcatgtgttgattggccgactacccaactcttttggagctagatcctagaggtttgacttaggactgactattgagcaatattactagctagtcgctaatccgtatattacacggtctaaaaaatactttagtagcttatctaaaatagaaactctacatatataagaaagacacccaaccaaaacttgaatcaggtcgccccatcccaatatagcggcaaactcgtgacgacaataagggcttgtttagttctctaaatttttttcccagaaacgtcacatcaaatttttagacccatgcatggaacattaaatatagataaaatgaaaaactaattgcatggtttgcatgaaaatcgtgagacgaatcttttgagcctaagagcaggtacaatagcaggctataagccagctgcaaatatattttaagaagataaataaggagagagaagaggagtgggctacagatttgtagccagctgtagcacgaactccaaaacgcagtgtatgtatgccaggtaggaccaggtattaatagtgtagtatgtagctattatatgaatgagatattagattggctatagataaattggagctagcagttggctatactattaaacttgctctaattagtccatgattagccataagtgctacagtaacccacatgtgctaacgatagattaattatgcttaataaattcgtctcgcggtttccagacgagttatgaaattagttttttcatttgtgcccgaaaaccccttccgatatccggtcaaacgttcgatgtgacacacaaaatatttctttccgcgaactcaacaagacctaaggcgccggctctaggtacactgacctacgcactagggtgaggagggtgtactcctagctcaagctctatgagcagggacaaatgaatgttgactgctattaaacggaattctccattccgaacggtatgatacgagatggatattagctaggcttgctaccacgtgaataccggtcttgttacttatagcatccccagtagatgatctatatttgattctccaaatgcccgtataaagtatcatccaaaaaatatttctcatccatatcccatcattctatattttagtaatatcttccaactaaccttacatttgtattttaagaatatcttccaactaaccttacatttgtattttaagagatatattttttgaactacttatttatcgtgataatatttcaattagattttaacggaaatctttttaactgatatatttaaaatgtggtgtataaataaagtgtcaagtgtcaattatattttctatactgaaaagagctcttctgttccaaactttcgttttatctgttcttctatgctctcaaagagctcttcttttccaaacagggagaggcaggcaaagggacgggggagatggtgaggggcggcggcggcgggctgctcaggggtggcgctgggcgacggcggcaagggaggcgcggcggtggctcacgggcgcagggcggcggcggcggctcgtgggcgtagggccacagcggcaagcgaggggcggcggcggttggcgggcgcagggcggtgaccacgcgcggggagacggcaacagacgaaaggcgcgcacgccggaggaggaaggcgcatggagacggcgccccaaatctggtaaggctcgctccacaaatcgctgaaaaaaagcaaaaaacagggatggggaactcacctacgccggttggggacaatggcgatagaggggaaggctcgccagaggggaggtggttgccgatgtctggatgggggcgggatctcgatccggaggtgttgggggtgaaatggcgtgaggagagagaaacactatttttacctcttctctcttactatggcgcatccgctaattttagcgtgtgggttagcgcatccgctggagggcgttttttcgcctctacacgccaaaaccgggatggaggatcggttacaatatctgctgggatgctctcacaggtaccaagggtggtacctcgctatcatgcttagtaccataagtaccaaacctagtacatgtagatcttttatttttaaagagtacatgtacatgtagatcatgggtcttgaatcttgatcatggtggcaacggtaacaatactataatttcatatggaacatcacagtgataaaaaagtggcatatctccttaaaagaatcacccacaacatataatgcaaaatcaccctatttctctattggtccagatctgaaatcaaataaaatggaaaaggggttgagcggattttacctgctcattgccttagcagccgccggccatgcgtctcctagccgccgcgcgcgcgtcaccggctgtgggccgcccgcccgtgcgcgcgccggccgtccgcccactcgccggccaaccgcgcgccgccggaagccaaacttgttcgcctgctgctccaaggtgaggtgtgggttacgggatggagaggtgaggtggtttagggtagttagtggcatttttacataaatatgataaaaaaaataagtgagaatccactcactaccattgagctaatcacacttctacaatttaccactgactttgtcaagttcaattatatactatcatgttttctttaacctctactgcgtgccatcgccgtccatgagccattagtttgcatctgtttgctgtattgaattttttgttaatgactaaaataccctttgactaatatatccatccaagaaaatcagttgactgaaaacctgaaaaccctagcacaccgtccacccccaaatcgatctttcccagtctcccagcgagacggcgccgactccccatcgatgtgccggtcgccggactccccttgacgcgtcggcggcccgccgactcccggtcgacgcgcaattggcccaccgactgcccgtcgacgcgccgccggtcggccgacttctcgtctacacgccgccggtcgccagtctccccaatgatgacctggcgccgccatcgctaccgtccgcccaagtaacgatgccagcagcgtggctgcaaccggtgaccgactacaccttcgccaccggcgtcctggcgcttctatccccttcgccgcaaccacctgtcccagtgtcaccgcgaccagccgccgacctcacctccaccgtcgatgacatatttccctggacaaaaaaaataccatgtacaatgagttaggggcaaataggtctttttagagaggtaacagatgttaactggactgtgatggcacacagtagatgttaaagaaaactcgatggtatataattgaacttgataaagtcagtggtacattatagaagtgcgataaactcagtggcactgagtggattctcttaaaattaaagggtagtgggtcctttgtggtggagtggagttgtggagcagcaacaacccagctctaccccctagtatattttttaggaataactctgctaactacactcccaaaaacagaggatctgaattgtttggcacaactccgattctaattaagttgaagttgggagctataactgtgtcaaatagaaccaaacttggccttgaacaccttcttcgtactttaaatacgaatctaacaacataaatatcacaaaatcatatgcatttgtcaaaggttcatatcctaacgaaacaaaataagttttatattttttatggagggagtgacaaagtttaactaaaaccaaaggttccttggtactagtatgatactccctctgtttcaaaatgtttgacaccgttgactttttagtacgtgtttgaccattcgtcttattcaaaaaatttaagtaattatttattctttttatatcatttgatttattgttaaatatacttttatgtacatatatagttttacatattccacaaatttttttaataagacgaatggtcaaacatgtgctaaaaagttaatggtgtcaaacattttgaaacggagggagtaatacagtagtccacctatcaaacagattaatccgtaaaattctcgagatataaatttatcgttgaaaaatcatagggttagatttgtcttaaaacagttttaaatatttgttgataggttttaggagtactccctccggttatataataattaacgttttggacaaggttaaagtcaaacttttataactttgaccattaataaagtttaaagaaactagaataacatatatagatatatagatttgtgtttcaaaacactataataaaaataaacatgcatttatttattatgtatattataatagaaaattaaggtaatattttgtaaacagtgccattatccgaaacgttaattaaaataaaaccagacagagtacctctcttcgtgaccataccactgtcttagaagaccttggtaacaacgaaaggaagcattgaccacaatatatgaaatacagagccggtcggcatatagccatatactgtacatccacgccagctagcttattcgaaatagcagtactaactattgctagtatacaatactaacagtacgtgtacatgcacggtgcatcctcatgacacacatcaaggccttaggatcctccgggctaataattagccctctaaaatcttgctatttagaagtattaaatataaattactgataaaacttattttataaccaccaagctaatttgcaagacgaatataaaattagtccagagattatgaaatgagttttatcagtaatttatatttaatactcttaaatagtaaaatttgggagggctaattattattacggagtatccaaacaaggcccaagacgacggccggctgggcttttcagccgctggtgcaggtgacatggcaggacgggccacagtagttgacgcatttggagtagtacgcctccaggcagctctcgcatccgtccttgttggaggggtcgccgcagggggcgctgcacgacgacgagtcgcgcccgtagcccttgcacgattccttgcacgcctggtcgcactggctgcagggcacctgcgccgccgcccgctccacggcggaggacagcagcagcagggcggcgcagatcacgacggcgaaggccgcggcacggcggcggccggaagcagcagccattatttggtctgttggtgttgtcgttggatttgatgtggatcaagcaagtcacaggagagaagaacaggggatgcagatatgcgtatgtgttggatttgtggcagattaccagcgctatttataggcagtaaacgcgatacttcaacttgcaggtttttgtcactggattgcagatgcaaagcaaacatggcgtgccacggatatgatgatatttgaacgtggacttcttaaaccgtgctccacttcccaatgtatatttgttgatgattttgtgttatatgaattctatttgataacagtggagcgattattgtttaattacggtggtgcagggttaattaggaggtgagaagtacagatgctataatactcccggattatcttcctgctatgattctataagcacttttatcttagagaaaatttcaaaaagaaaacccgtgttttggggattctgtaacacaaaacgcccagttttgcaatttgtttatttgtcttatatatttatctgtaagcacttttatcttagagaatgtatgagatactttttagtacatatataacattagttgctttttaacaagcgttgatcatttatgtgtatatttaacctattattatattataattaacatgtattatgttaatctttttcagcacaaaattgagaaaaaaaatgaagtagacgagaagaatatgtccttttagccaactaatgtgaattgatgtagaaaacaatcttatgtaataataaaatatgagtattttacatgaatatgaggtttcttaaaacatttggctcaaaacatggggcttcgtgaaacaaatcacagtaaccagggttttatgtaacggatactccaataactgtggttttgtgaaattcactctttatcttatatgtaattattatgttttcagtggtagacgatgtacccgtcgatagcgaggcgcctgtggtgacttcgtcaatctccaagatttgccggctcagttatcgaagatgctcataagggtagggtttacgtacgtgcattcatagggtgagtatgcgtgcattgtgagtgtttatgttgtaaagtgtaattttaaaaaaatattgtaagcaaggcacaaagattgagtaatcccctacgtttgtaaacattcctcatttggtcgctattatttttttaaaacgatcagttacagacaacacgatcattcattgaatagagcagaaagaaattacaaaactattgccttaggagacattcgccaggaaagaaaaaatttaaccaccacgcaccgacagcgtctacacacatccaaagagaaggctagcaccaaatcaaccacttttaagcgtaacttatgtccctcttattgaactatgttcgtggctattattggttttcttccgtggttttttcaaagggccgcggtttttcaatgtgtagaactatgtcttgatcacttctttgtctgtccgtttatcgcatatatctatatggtcagagcacccgctttaattctttgatcttaagctgttctacatatattagtggtatttgaccgtcctaaattacgtcttagatgagccatgcatgaccaagaagttagattctgacttttggatatagatatgcatgacagtgaagacacgccacccaatgtgtattctatagaaaccagagtttttaagcagcacgaaaaaaaaaaactattacttcagtcctagactagctttttttcatgcagtagtaacttcgacagcagggaagagctttgttgatagtcacatttcgtgcagtgggagtggccgaggtgtgagcgccagagagtgtgacccatgtcatcagcggtgaggcactgcccttgcgctcaaagctcatcatgcgctccgagctctcgaaagcttgccgaggtcgctactacataaatgatatgatttttctggacataagtcatttttagattgcatacgaaacgtaaatagtcgcgtctgcaaaaaaatcatgttccattttcacgcgcggctctttaagacgactgcacgaaaaaaattaattttaacaagcaggccacttaataggtccgcacgcgaaaatagatgctaagtggcccgtacacgaaaatagccacccaccttttaatcgcgcgtgtcgtcgccgccccacaccgactctcagatcccatcaccctctcagatcaccccacacccactctctcctcccatctccctcttcgcccccacacccactcctccctctccctatccgcctcctcctcccactcctcttatctcccggcgacggcggcagcggcggtctcggctagggcggcggagacggagacatcgggttagagtggcggaagcggcggcggaggcgagtgcggtggcggcatcagccatggtggtgggaacggagcggatgattttcgcagacacctcgtactagacgggtgaaacatccgcacgcaaaaaccaatttcgaccgcatgaaaaaatcgttattgtactagtgctttgatggccaggctagctaggattgttgttgtgatcgagcacctccttagagatgaagacacgaccgttgcggcagctgatagcgccatatcacatagttggttggttgcttagatggcagcatgtacccatagacgcatacatgtgcatgggcctacacacatcacagagagacgttggcatgtcatcgctatcatatttttcatcttcttcccccaatttattcttctcctcctctctttcccttcccctctcagctagccaaccacaacagcgatgtcgatgccaatgccgcccccacaatgaagtgtggggacattctgataaaaaaagtgtggggacacagggaggagcgaccgggcaaaggcagccttggctgttgcctcccctatcgcctccctcaccgttgaatcctccgcaccatcattgtcaccgcatcagggccattgcgctgcaactccatcgtcgttgctatcaccctccaccgtcgatccacaacatcgccagatcctccttactctctctcccccactatccacccttccaccaatcctgggtcgccggcagccaaatccacatgaaatgcctgggcggacttcaccggctccggcctcccccaaccctaagcccacccctcgcctctcggagacttggagaagccattcccgcttgctactcctaccccgcgcctcgaaggagctcgccggtgagaagcggagggtcatggacgagaggggaggcggagctcgccggtgaggatctgagccgcttctagcaccgtacccgtcttccttcatgggtagctcatgcttaacctccatcgacctcggtatcttccccaagcattcaacactgccaacgtctcttccaaggctaagttcgtcctcgatagcaaggccatagtgcccctcctagagtccgagtcgacgctagcgcccatggttggtggtccctccccctagccggcagcgcatctatacttggagcagcggtggttgtggtggaggggaaagaaggaggaagagccgtcgttgtcgttgaccccatcccatggacgcttgaatcagcctctcgaatcttgctggcggggaggagaagaaaagaaaatgagaaggaaagaaaaggatatgtgatagaaaatgtgatggcgatagcatggttttaattttgttcgtgttcgaatgatatggatacgaatagacgaatagtaatgatatttctctagaatgacatatttgtaataatatagatccaattgacccactttaaaaaggcaaaggtaaatattagccaatattggattgatcggatgtgataaacggtcagcactaagcacggtaaaacttcccccatataaatagcgctcgaagtgtgattaattaaattttacaaggataatcggagaatcgagctcaccaaagaatgtagccagtttcgcttacgcagcagtgagaaaatcgaagacgtcgataagagtttcaattaacgaaacaaagcattaagccattgatacatcgcttaccgcccccaacacatcttgcagccgacccggccgtagggctgtcaaaaaactcgaaaactggagctgctcgagcttggctcgttctagactcgattcaagctcggctcgagctccaaacgagccgagcccgagcctctccctaagctcgcgagctttatcgagccgagctcgagcttccaacgagcctaataatatatgattttttgttgttatttaataaattaggagatcaaatatattatttgtatgtcttatattgacatcatatatttattttattctttttttcctcttctattaatatgatgaactagaaattaattatttttaaaagattatctttgaaatatatattgttttacttaaaaatcaagctctgtagttaagctcgagccgagccagcgcgttgctgcgtgcatcaccacacgctagcttatttgaactactagagtactagtagtgacaaactactccatccgttctaaaaaaaaaactcaatatctcctcctaggactatgaatctagactaccctttatccagattcatcatcctatcatcctaggaggggtcgggatgtgacccctccttaattgagtttttttgggacgaaggagtactctgaaataggacaaaacaaaaataacttgcaatatgcatgaaacggagaaagtaacagaactacatatgatcgagacagtacatacatttacgtgacacatcaaaaggcttcacgacggcggccggcgccgtgagctcagagacgaattgaagcgtgaacggtttttttcagccgctggtgcaggtcacacggcaggactggccacagtagttgaggcacttcaggtagtaggcgtccaggcagctctcgcagccggccttgttggatgggtcgccgcaggggaggctgcacgacgagtcgcggccgtagcccttgcacgacttcttgcacgcgtggtcgcacttgctgcagggcacctgcgccgccgcccgctccacggcggaggacagcagcaggacggcgcagatcacgacgacgagcgcgacggcacgacggccggatcggaattcggaagcagccatcgatggatctgtctgttagatttgacgctgatcaagcgagttaagagtaggagaaaaactggagaaaatgctgagatggaatttgtgttggatttgtgacagcgctaggcaacggtatttataggcggtgaacgcaatagtagaatgcagattttggtcactagattacatatgcacgcaaactaacatggcgtggatatgatatttgaacgttgacttctgaaaccgtgatccgcttcccaaggtatttttgttgattttgtgttatctgagttatattcgatgacggtggaacgatgattgtttacgttactggcagctatatgtgaaaaattaattttaatcgcacgtaaaaatagtttttttttagtacagctgatggatagagtacaacgctaggccgctggccagctagtcggagccgcagggtacgagaatatgctataatagtcctagattattttcatgttacgaaagcagttttatcttttcatatgtaactcttgtaataagctgagacgcaaagaacaagtatcacttgtgtttagagtaagattaaaattaagattaaataagggacatgcaaaaaagtcatcagcgcgcgtgattaactaaattttaattattacaacttattaataaatagatttatttgatattttaaagtaacgttgtaccgttcaaccattttaaaggcgtgctaacacaaattgagatagaatctcatcttaattagaaaaagaacgaggcctaattcctctacgctcgtaaacacgccttattttgtctgcattgccggtttacttccatgatcttttgaaaagggtttttcagttcgaaaaagtatgtctctcttctagatggcctttgtttgtctgcttattttatcacatatagacggtcagagcatccgctattatttctttaagctggtctatatataagcgggattttaccgtcttaaattacgtctatatataagtttcattctgacttttggatatagatatgcatgacagtgaagacatgtcacccacagtatagctagtctatagaaaccagctgagcttttaagtagaaagcagaaaaaaaaatagtttggtcctagcctagctcttttcatggagtagtaatttccacggcagggaaaagatatatgcaaactttcttgtacaaacattttacaaatcctgacgtatcatgatgtgattaaatcttgtttttttaaaaattttagttaactaaatcaaacggttcatacaagtttgtaagaattgtttaggtacgtcttacgtacgctgggtctgtatcctcgtccggctgggttgccaaggttagggtgacccaaggcccgtatacttatgggctaactagtgacttcaacgcgtcgaaagcccggattacggcttacatagcctggcacgtatagtggatgggcctttaagaactgaacggccgaattgcctgggtttgtttccttgagcttattaaaggtcgcgttcttccgaaggggttagggtaagttttataatggaggtgagtaccagatctaatttaaatcatgtcatattctcattaattaagaggtaacaagtacaacatgccacctctagtacacaaaccccaatattagtttactctcacatcatcttatatttttcttagagattatgtggaggttgcccctttcatgagaggtggctcattctctctctcctaacttctctcctccaactcatcacctaattttatgtggcaaatttaggggcaacatgtagaggcttatagtacttgcccttaggagcgcctaacctaatggaacgataattaaaatatgataaatgaagtacttcatccgtttcatatgtaactaaattcattagcatatatatgaatatgagcaatactagaaagtcttacattgtgaaacggaagaagtattagctaaagaaattccgaaggggttaggagcgcctaacctaatggaacgatagttaaaatatgataaatgaagtattagctaaagaaattttaaaaataatttaatatggctttttatagcaactttttatacatttttttaaaagaatatatcggttaataattcgggaaatttgcatgtgagaaatgagagacgaaggttgggaactttgagttaagaatacagcctaaggcatactccctccgtctcgaaaaaaaacggtgtccagttttaaactcaggattgggcagtgtcgtggaagacggttgatacggccgctatgacgcccgttaaaacggtgacggtaagcagtccgtcacattttggcaaaacggtcctcattagtcgtccaaaaacgcgtaattcctgttattaccgattaatccagcgtttttccgactaatcggccgtattggcagtatataatcgggcatgatcaaattcactgggcccagcccacgcacaatagcctatcctgttagttgtcttctctcgtactcctgtacagcatgcatgtactactatattaatctctttgaagaccaaatatttttcaaatgcactaatactagtataagatttcaataacgtgtaatgcaaattatcatggtattattatatataatttgttatagcagcaatggcaggcattataaactgaacctaccactagttaatgcataaatatgcattatgatattttttgcattattaactttagtacgtgtatgttaagttaatgtcatgttatggttgttctatttaaatatatatactaggaaactagaatgtgttcatatggatttaattacctctaaaaggacaaactattattaactatgtacttatatttgcaaaacgttaaatttccgtcatattccgactaatcatccgtattccgattaatcgtttggcggtactctccccgtccgacatccgtattccgtcttccacaacactgggatttggtttttttttttgacagtgggagtacgtgtctagagccagcatttgattctacattgatgtgcttgtcattccaacctgtgatagttatgatcttataaaatcaattctagctatgattttgatatggtatttttcatgtttataagataaaggtttataaataaaaaatgatttttattgaaggtgtaaaatatacataccgtcccataaaaaattaacttctgaggatgaatctggataaatatttgtttaattttttttttgttgtggtaagagcaggagtacttgtgtgctacaatgtctggataagtgttgattgtactgcctgccaatacgatagtagcagctgacacgtctgcatcatcctgtggatgaatccaactaccctcggaaaaaacgccaccaacggaatccacgaatggaaagtttggtactcgatcaactgtgattgtgacaagggtcgcaaaaatcggagctaagagcaagtttaacagtatagctaactactagctccaattcatttatagccattctaatagctcatccatacaatagttacatactacactattaatacctgctcctacctgttacacacactacgtcttaaagttcgtgctacagctgactacaaatttatagtccactgctcttctctcttcttatttatctccttaaaatatgtttgcagttggtttatagcctgctattgtacctgctataatccgactcctccatgcgcatatttagcatatgttgatatatggagtactcgcttcgtaaaaaaaaatggatgtgatacgttctaatacatcgaatttgaacatacgtatatctaaatttgtagtgctaggatgtggtacattactatgctgattttttatgggacggaggaagtatgtactatgcgcaccagattattcttccataaaaaccgtccactctaaaaaaaaataaaactgactttgacttctcaagaaaaccaatcattttaaaaaccaacaatccatttgatccaaatcctccactaaagtgaataaagaaaatgttgaacgcgtggacctataactagtagcagagaaaaactttagctatggttaaatgttattgaccgtcattatactctacaagaacttaaatgttatataccgtcattagccatggtttgatttgaattttgaaatcatactaaccccgtcgggtaacggccgggaaagcttccgaaaagagaaattttatgttactttaaaaagtacctcgaggtatataaattttacactaaagtttttagtttttggtacatcgaagtactaagtatccggagatactaaatttttacactagaaagtatggtatctcccgatatacttttttaaggatggtaaagttacccttccgaacatcatttggagcctcattggttgtccatatttcctaataagcttaaacataaaataaagagttaatttataggtacaactttttatatatttgttcgtatcgacttagaagtcaatactagaaaaaaagtatattgaaaatatcttaaaaccatctgcaatttcaattttgaaaattttgaaaatttaaatataggcttttacgtttattaggccaaccgggctacgcatctcggcaacgctaattaaccacatgatcaagtatgcagcaagagatcagaactgaagtttaatagtatagtccactactagctccaatttatttatagctaatctaatagtcaatttatacaatagttgcttactataatattaatatatggtcccacctgttagagcgggtacaataatcgacgataagaacgccagctcggattttgcgattacgtggaggagagaggggtcaagcgcgagcgcgagcgggcgactaatttgtcgcccagctgcacgctccgcccaaggttctggggccccttgtaccgatcatccgtgtctaagttcgtcgcaatcgccaccgtgcccatcgtcgtcgtccactgccgttgtaaccgttgtgtgcgtccgcctcctccgccaaggttggcgtcatcaccggcgtccgcctcattcgctgcgaccgtcggcggcggcggcgtccgctgtgaccatcgccccgtcctccgcagccatcgtcgtggctgtcgcctatccatcatcatccgccatggccgccactatggtccactgcattcgtcgctgtcgcatgcgttcgccgtcatccaccacagcagttgccgactcgccgtcgcgtgcgtccgcctcgtctgccacagctgccatggccgccatcatcgcctgcgtcccactggtagagaaaccatctttggtcggtcgacccaaatccacaatagtcccggttccattaaaaaccgggactaaaaatgatttttagtcccggttaataagaggaagatctttagtcccggttggtaactccaaccgggactaaagttcatttttagtcccggttgattccatgtcaggccggggtaaggccctaggattcctaagttcgggtaagtacccccaccggggattaaaaagggggaatc

SEQ ID NO: 59123 - DNA, 32818 bp, Oryza sativa
cctgtttggcacagctccagcctagctccacccctcctggagctggagctcaaccaaacagtttcagctccaccaaaactgggagtggagttgggtggagctctctcacaaaatgtactagagttgtggagctgggtttaggcagctccacaactccactccagactcaactcctggagttatattaaggagttggagctgtaccaaacaggcccgtaattcccttgtttacccctttagctctttctggcttaggccctgttcgaacgagagtttcaggctcaagccagttaaaaaagaagaaataccttctcaaaagaagaagaattacaggcttaaacagtttgtattatcggatatcttgtatacattcgaccctccgagatctgttgtaagatttgtatcgtggcaccttctctcgctccagcgagcttgtgcatctgcggctacaactggcaacaaacctgacgtgttttggggtggggagggagagttcctcggggtttacacggaagcggacccgtgttcaacgtataaactcttattaattcaacctcaagatcttgtgttcaattcttagcacgctcataattttttcttagagagattcttcttaaaaaaatgtttggagggatttctcttccttcaaatcacgtttttcttaacccaaaagttgttaatgctaagtgcagatatttcagcgaactattgcaatcgttaaaagcttagagagattcttcttaaaaaaaatgtttgaaggtacttctcttctttcaaatcacctttttttaacctcgaaagttgttaatgctaaggccttgtttagttttcaactttttcttcaaacttttaacttttccgtcacattgaattttcatgcacacaaactttcaacttttctgtcacatcgttccaatttctttaaacttccaattttagcgtggaatgcagatatttcagcgaactattgcaatcgttaaaaaccctaaagatttggtaagggtagcttttagtccaagaaacttcgtttatactcaatgcacagagatacctcatcgtttcgcctacgataaattatactcgtcgtttcacctacgattgattataaatcataacacttattaagatctttaaagaaatatagataaaacttttatatgtgtgttattaggggcttaaaaaccgatgaattacgttgaaaaagctggaagagcaaggctaccgatcggtggatggaatcatggaatcttgtgatcgatgtccaacaaggcaacaccaccactaatcatcattccaattaacacagtccaagcctccaagggcgacaggatatagtggataactgaatacacagtccagcagcacacgcctgtaatttaatcacagcggcaattgagtaattgacagtcaaggacgactagatggtgtaccaatgtgcaatttataatcagcgaggaagcacgccagcagcacgcctgtaatgatttccaattactaatgtgcaaagtgcaatggcaaattgctaacgggcgtaaagaggagaccaccatcaattccaccacacgcggacaggttcctccatcgtcacgacgcggccaccagccgaagcgtctcctccgagttcttggagttctgctccgccaggagggactgcaggtcgctgccgttggccaggctgttgaactccaccgacctggacgggtccgtcgggtacttcctctggcagaaggtcatcagcctcttcacggactgcaggtacttcctggtcgtctcgtcgttcatgatgtgcgccacgctgttggcgtagatcttctcgcgcgccgagcgctcgtggatgcccaccatcgtgacgccgatcggccacggcgagttgccgatggcgagcttgatgtagttgtccaccgccgccaagtagtcccgtctcatgcagcacctcaccacctccagcaatgatccacggacatcttcgggcagggtctgtcatgggataattggattcatcaaaatgtggaaggaattagcaaggtgattcagaattgttcacacccattatatttgggtacatcaagaaggaaaaagtttggattaatgaggcaactgtaggtgaagaatagtagcagcaaataattttcttggatcatactgcagagcaggtcctatgatggcaagcactggcaattttgaacaattcagcaagcattggcaacgttaaacaatccatttcaagaaaaactacccataattccagtgggaacacactagcatacagaaaataagttgccacaagtaacacaaaataaccttagtggtgatcacagagagcacattctctgacattatcatccggagggaaggtagtaggttaatccagggaaatcatgaaggaattatcgaacttcctaaaagcataatctgcaacctgataattgatttgttgtttcaagattcagaatggcaccctcctatttcaaaggcaaagagaaaaattaagacaaatatattcctctgttacagagatttataactctcttctttttttttttttgcggggaacagagatttataactctgaagtctgaacacatcatgagacactttgataataagaaagcgcaaaggttggaacttgagaagaatacatgtaatatctgctgtcttgttcgccggaatgtatgatgattaccagcttctgtctgtcaacatcttcatgctacaaggaactaagaagagaacacattaaacaatatttgcaacacactcaaatcactcagtagcattaccacttagttcatgcctacaaaattatagccgatattggaaacgaattttgcaatatctacaatgtgccaccagtacaaaggcagtttggtgtttcatcgaaactgttgcatgtcttatgaagtgcattttcaaaatggaagctcacataacctatttggcttcttcactatatcatgtgttctgtaaggcttgcatttccccttccacagtgaagcatcccaagctcctaacatgtccttatgcagcaaacattggttgtaaaattgtaatgcttcatactgttcttttagcacatcttacagactcactccactaactttgggttttgaaagcatcggaggcattcaataaattcgattacagcaccaaagaacatcagattcttaagtgtgtgcgtgaattaatactgtcacataccttcttcttgcacagcttgaacagcggctcgagatagcgcgcgcactgcttgcaggtggccaccgcagccttccctttcgccgtccgcctctccgcctcgggcatctcgtccatctcctggctccactcgctcatcagcctcttgaagaaggtcatgatcttgtcctcgtcgcagagctcctcgaacggcacctcctccctcgtctcgcccccgctctctgcagttgcagcgccagccttgggcttcgccgccgccgacgccgacgccgcaacggccttcgcccgcagcgcctggatgtcgcggaggaagtcgttggtctggccctccccgatctccgccgcttcgacgtcggcgagcgccgcggggtcctcgagcacggcgtggaggcggcggaggcgcgcggcgtcgtcctcgccgaagagcgtggccggctggcgcagcacgcgcaggcgccggatgacctcctccctggggaggagcggcgcgccctccttctcctccccgtcgccgcggtgctcggtccgcgacgactcgtcgccgtcgggagcccccggcgtggtcgtggagcgcgacgcggcgcggtggtgggaggaggaggaccggagctgcttctggaggaggagccggcgctcggcctcccggatccgctccatctcgcggcgctcgatctcggcgcggcggaggagcttgcggccgccgaagtcggcgtcgagcagctggcgcttccgctgtagctcgcgcttcaggacgtccattggctcgccggagtgggggtgggtcgcggtggcgcactcgcagagtgggttagctttgctttggattttggagaggcgaatcggaggttccgcatggcggatcggaggatggatggatagtttttgagcattcgtttttgggagatcgatgggttctggaagcatcgagcacgaaaggtttctcgcgcgaaccttctcgaatctcgattttcggagttcggattgagtgaagagtaaaccggtaggtgattggcccagtttaactttaggcctgctaagtgcaaacttaagcgcaaagcaaagcccatacaaacagtgttttctccgtatttgccgtgtggaaaatactctctccatctatttttgatagtcatatttcatcttagcacacagaccaaggataaatgattctacttatcatccatttaaatatgctactagtcattcatcgtaaacaggcgattcattaatatttatatttctcgatgcccatgtagccaatcttgtgtgtaagaatgaagagtcgcgcattaaatccaagaaagccattgatatgataagttgttggattgaaatatgctaatcaaaaataaatttttcagatttagaaatatgaatatcaaaagtagatggagggagtactttggtatactaatttaatcccctttgatctgctgactggtttactactttcagatcagactgctggggaaaaaaatgcaaatgctgaataggactaggagtatttcactagaattactactaccgtaacaatcccaattccgtagacattcacccatttcttaccgttaactaaacgattacgtaaaagttttaaaaaatgataaaataaattaatggtaatatattattttacgcacatgcaaatacgaattgaacttctaactgtaaaaaaatatattagttagagttcactttgttatttttattacaacttgtaaaagctagatttaaatttttatgttgtgaagtgatatatttcatatataaatttatcttaccattttttaaaaaaagtttataatcattagagtttgcataaaagaaacagagtggaggttcacccggaatccatctccgattcccagtctggtcaatccgccagaaaatatcctcctgccctcgtttcaggggctgcagcagcagaggaggccggaagcagagaacgaaccgcacggcgagaaggcgcgcaggctgccgtctgcccgtctgccgaaaccgatcgcgaaagcgagccagccaaggtgccgcagtgccgcccccttcccttctttcgcccgcaagcacgcacgaggaaaggaaccagcggtgcacgcacactgaccaccgcacaacacagcgccgcgtccagcgaggaacacgagccgaaccgccacggcgacacaccaaaaaaaattccaattccctctcgtgatccacgcctccccccagctcgtctcccgctctatttaaacgcaccccccacccccaaacccgctctcccctccttctccccgcgttacaatcagcacacgctctctgctagtctgatcgctctcgccatcgcacctctgtctcgtcgaacaatggcctccaccgccgccgcttcctcccctttcgactgcgtcctctttggtaaccacgtttgtctctcgattctaggctcctctcatagcgtgatcactttcaattctccgtctaaactctgcctttcccgggctgttttttttttctttctttcttttctatgaagacctcgacgacacgctgtacccgggaagcgcgggcatcgggctggcgacgaagcgcaacatcgacgagttcctcatggcacggtgcggcgtcacggcggagcgggccgccgcgctccgcgtcgagctcttccgctcctacggcagctcgctcgccggcctcatcgtacgtccaattcccaatccccccacgcacgcacgcacggcacactcgaacaatccaaattcgcctctgttttcgtcctctgtttccgtttctaactttggctttcggatttgggtttccgcgcggcaaaggctctcggctatgacgtgcacccggatgagtaccacaggtcagcacaacacatcacatcacttacctttgcagctttgcttaaccaattcgacaagccaattagtaattattaagcggctaattttctgtctaatccgaatgctgacgctgcttggttgatcgattatcgtcgcagctacgtgcacgggaggctgccctacgaccggatcgccgccgacccgcagctcgccggccttctgcggagcatcccgcagcgcaaaattgtaagctcacgcatcctctttttttcctgtgaaattcctgtggttttccggacttaattggaggcagctaattcgtgttcgtgtttcagctgttcaccaactctgatcgcgcgcacatgaggaaggcgctgcagcggctgagcgtcgacgagggctgcttcgacgccgtcgtgtgcttcgagaccatgaaccctcacctcttcggtgaggcgccgtgcgcctccggcgatgaccgccccggcgtgatcctcaaaccgtcccccgatgccatcgtcgcggctctgcgcatcgccggcaccaatccacaccggacggtaagccaccacaccctgctcgacatttttcagtaggattttttggagcttgttgcaatgtaaatgtagttaaccatatgggcaattttatcattcttaaaaatatactgggaagtaactcattttctggtgaaaagtttagtatctccagtcgatataggtaactcgaagtaccaaattttttttatctaaccatgtacatttaacagcaggtctatcctctaatgataccgttaatttacaaacccaaaatgtattaatcactcttccatttttcttatcacaacaaggaaatagaatgtctatggaccaaagagtgtattatgcatcttggaaagtgacatcgagtgtaaacccaaaaggcttagaaagtaacgagtagtaatagggtctttgtcagcgtatccttttccatcgaaacaaacatatcgcacacatatggtatatgtgattttacgtgcttcgtttgtgctcttgtcaatgatcacgaagctagtaaataactcgttcttgctctgtcagctcttcctcgacgacagcgagaggaacatcgccgcaggaaaagctcttagcctccgcaccgtcctggtaattaaccaccacaacttaattgtgtgtttcagttttcttcgtaccgcactgttggtttaagctactataaccaagtgacagtattttccttgttttgaaatctgaatctttttctccactaccataaaatccttactagctccaaacgggacatagatgtgttcaaaacacagtaaaattaatttcaccaaaaatttacatgattggtagatatcgattcaattcctatagtaattatcgggaaaaatacacaaaaatcaatgaggcatataagttgctgtctctgcctgtccatttgtcgatgggttggtcgatcaggtggccggtgcacacagcgtccctgcagctgatgcatcgctgatggtgttggccttgtcggattagaaaagcatatatcccaatttcttcattgccgtgatgccaagagtttggtttatgcactcaaactgtgtgtgcattattggttaatcctgcttttgcacatggacgcttagtcacataatttagtgctctcgcatttgtggctggcaccaaattggccatgtcgtcgacacggctctggtcggtgtgattgatatatctggcatatatgatcccccatgattggttgaacaaattgcctcttgatactacttgagcagggaaaatttataattttaaatatagagactttttaaatatatggtttcgatgtgttctttgctggattcggtttcaacaaccaatttctaaaaagaaaaatagcacttatatatagtcctttcctactagtacaacaaaagctagtgaaaaataatggcaaaaaaacaggagacacacacaaaaaatctcctctgccagtgtacagccgttaacccatcgcatcgatgaacagtatccatgacgtgccaacgtttgataacaggggccatagcccattgagacccaactaatttgcatactttgcggctaagtttcctgcatgaacacgaatttacgttagctaattaatcttctcaattaatattcaggttggcaagagggtgaggagcaaggaggccgactacgctcttgagagcatcggcagcctccggcgagccatcccggagatttggggcggcgtcgccgtcgccgtcgccggcgaacagctcgaccacggcgccgcggagaagacgaagggaatgaggtccgatctggactccatcatccagccaacgtcagtcctggcgtaatcggttcctaatccattcgcacataaacaaatcgccactaataaaagcaagtactgtccattaattatcatgtaaattattctgattcctgatgctgagtgcgtgtgcagtgtatttgtatatgggcctggctgacaaggaaatatgcatgtgtatatcagttctgatgatcagcttttgtttgctgtaaaatgtaaatggcactatgagcaaggaatttgtctttgattgctgttttttttttgtttgtgtgtgtgtgtgtggccactgtacaaattgaagcatgctattttttccccttaaaaaatcgtagagctgcaatgagtagtcaccgtgcacaatagcagatgcagctgtcccatacaaatgaaatgttcttgcatccatcaaggagtagataccttctaagattatagaagtaattatgcattagacaattaactggaccactgttatgaaaagaaccattgatatggaacgattcggttcaagtggaacttggttcgttcaattttaaactggctagttaaatataggaatcgaggaactttccccacgtttaaaacgaaatctgtctattcgtcattagtcattgccatatgtaatacctgtagtatgttcagtcctactgtcctactccctccgtcctataataggcgatgtttttgactttttatttgtaacgtttgaccattcgttttatttgaaaaattagtataaatataaaaaaaagataagttatatctaaagtacttttgataataaagcaaatgacaaacaaaataaataataatttcaaatttttttaaataagacaaatgatcaaatattgacaaataaaaactcaaaaaaagacaagtaatatgggacggaggtagtagcagctaaatattcgcctttacgactccgagtcactcccttgctgcttcttgtgcagccaattgccaaatggaaagatggggagacccgtttttatatgtgcctggccttatcacctactagcagctcgcgcgcggcaacttgattggaccgacgcgtcgcccggggatcgcatcgcatcaaccggcagttcggcggatgcaagcgtcgtgcgtgggcgctgacgcggacggacggacggtgcgtacgtacgtttctagaatttttatcctcgatcgatcgctagacgctagctgttgggtttgggcagtttagataggatcgctcgctgctaacctcgtcacaccgtgctgtcgtcgccatccacagcggcctcgcgcgcatcctcctcctcctgctccgcggggaggtgcggatcggagcccatgtcgccgtcgccggcgtgcgcgcgacgtacgtggggacgaggcgtacgcgcgtgttcttatcgatatagtcctccgtcctaaatatttaataccgtcaattttttcaaacatgttatgaactttcgtcctatttaacaataaaaaataattagtaattatttaaaataagataaacgatcaaatatgttttaaaaaattaacagcgttaaatatttagtgacggaaagagtatatatacctgagtaaaataatggagggatattcatcagtcacccaccgatcggtctctgcgataaggttgtaacacaaacatccggaaacggcggcgtttcggataagagcacacgcgtacgccgtccgcgtgtcgtgtggatcgggcacactcccggttgttgggcgtgtagtgcgttggacgaaagagactcaccggacacatgcatgcatgctacagtaggttgctcagcatcgattgatcatttggccaggatagcatgtgtacgtgaggatatttccctagctagctactagccagttgccacgtgttgaggtcgagaattgtaaagcgcggtcacgatggaacgtacgatccccgtgtgtcgaggttgtacaggagtactccctccgtaaaaaaaaaaaaaagacaaaccctactttccgtgtccaatatttaaccgtccgtcttatttgaaaaaataatgaaaaaaaattaaaaagataagtcacgcataaagtattaatcatattttatcatctaacaacaataaaaatactaattataaaaaaatttcatataagacggatagtcaaacgttggcacggaaactcagggtttactttttttttttggacggagagagtacatttttcggctatagggggtgtatagatctcgtccagacatcacattatctaaacacatgcataaaatattaaatatagatttaaaaataactaattgcacatattacgattaatttgcaaaataaatcttttaagcttaattgctacatgatttgactacgtggtgctatagtaaacatttgccaatgacgaattaattagacttaataaattcgtctcgcggtttactgatggattctataattagtttttttattaatacctgaacaccataaattataccctatccaataccggacgttaacaccacgaaactttacaccctatttgacgtcaagaactgatagcaaaaggtacggctggcgacgacgtcgaaggttgttgggctggcgtataacttggccttttgtaatcataaacgggccgtgacgagttccaggtaacatcggcctggcccattatctgataattgggccggggccggtgatcggttttgcagacaaaatgaattttgatcgaatttttccgctacaaatcaggatttgctcgcaaaacaaatactggccattaacccgcagcatcggtagccgctctgagagagaggaaagccgcgccgtacgtcagcggaggccgagaaaaatgggcgcgctctgcctgctcccgtccacgccgccgtgctgctcttgcggcgcggccggcggcggcgggtcgccctcgcggacgcccaggctcgcgaggaccgcagcgcctttcgcctcctcctcctcctcctcctctggcgccgcttcttccggtggaggtttgcagctcgcgtgcaggcggcggcggcaagggggacgggggcgcgagcggaggggcggagttcttcggggaggacggcgtggtggaggacatggacgggtacctcaactacctgtcgctcgagtacgactccgtctgggacaccaagccttcttggtacggtttcttggttcctcgtttcttgcagtgtaaattgaagcagcttgagttgagcaaaatagtagtaggacaaagtagagactaaaattctgttctctgcatatatgagaggaaaaacaatctgaaattttgttgatatgttgtgaattgtaaattataaccaaaatgccaaatgataaatgcagtgatactattgtccatcgtcaatgactgaatggtccagtgaattttgattatgtctttgcttcaaataaacaatggattaattgatgtctaccaattcttcaatttcctatcaacctccaaagttagtagatcttcacaagttgtatcagataagaaggaaaaagaacatcttttattgttttctgttgaacattctaacaactttaactcttctgactctacagaactatatcctttcatatgcttttgtccgagtatgatcactacaactatatataatgcccattttcaggtgtcagccttggacaatcttactttcaggggctgttgcaattgccggtagttggttgcccatccattccgctgtgatcaccggaggggtttcttttgtaatatgtgcatggtggtacatatttctttattcctatcccaaggtttgaaaaccatttcccttattctttttgccactttgtggtgtttatatgattggctagaggtcagagccttgtaggttacactggctccacttatgattgttccacaagcccatgatcatgaattttcagacttgcgtcaaaaaaatatttttttgcgtaaaaaaaatgaattttcagacggttgatgaaagtagattgaaataacactctcgtttggtcttgacataattcttatgcaactaatgtagttacaggcttatagcataactgcataggttcttttcaaactgctaaattatacacttagctttcttaccctgattgtgcgtccccccacttaccagaatctatcagatacatctttcatcacatcatattgtgcacaagaatgtttgtaactgtgtcttggtggacttttactcctaacaaaatcacatagtaatatctcaaaattaatggacactataattttagttttttagcatatgtttgcattaaggggatgtactttaattcacgagctagctgtatacatgagaactaaaaacatagagcactagagggtagatttagctaatgatagcctcaactgagattgcatggtatcaagatagcaagtactacatgcaaaaggccggcgtgagtgcagagaaatcttgtggccacttgagatttaacatcaccctggtcgactagtgcttcatacactgtactatagttttttttgtagatgttgccgtagttcctgaagtgacgagcattatttctgatttccgactggaccttgtcggtgtaaccatcacatattgtctactttcgatctgtagtctttgatctgaatgtgttctcaactctcaagtctcaacatgatctgcagtagttcctgttagataattgcttgtttgtgcagagaacgaagtagaactaaccatctgaattgtcaggcatacaccgaaatgatagctgagaggaggcggaaggttgccagtggtgctgaagatacctacgggatggagaagagccagtgaggaattaattactgccaccactgcaggcgtgtcttgtttgtagcattgagtatgattgtgcagagaacaaaacaaaatcatcggtttgtaggacttgttcttcagaatatatgttccatggaatcaatctgttcagatcaatggccatctttgtttaatttgcaatggcctccattgttcaccatgtgcaagttggccatgtaggttaatttgcaattttttgcccgattcacatcaaaacagaaatattctttacagtactgaaaataaacaaaccaaaaaaatggttgcagggtatgactttaatacttatactcttagtggttcaaagccaaggttaaaacataaaataaataaaaacacttaaaatagcacttatcttttttcatcataaaagttttaaaggacacttaggacctaatttaaaattgagtaaatttcacgaaacttgggtattggggcatccataaaaaaatccagttattgtggtttgtttcaaggaaccaaatgttttggagcaaaacatttaaaaaaaaacccatatttatgtaaaacactcatatttaataaaattcttaaagtacgtgttcccctagtctagttttttttttaatttttcattgtacaaaaaaattcaatataatcctcactgataatgacataataactggttaaatatacacataaatggtcatagaataatgatcaacgatcgttgaaaagcaactaacgtgtatatgtatagtttttttttttctgaatttttcattgaacaagaaattcaatatttcctaactgataatgacataataattggttaaatatacacataaatgatcatagaacaatgatcaacgatggttgaaaagcaactaatgtgtatatgtactaaaaatatctcatacaattttttacaataattatagataagtatatagtcgggtagatgatataaacttgtagctgaggttttatgaaacactttgccctaaaacctgggtttcatgaaacaatttgcgttacggatgtcccaaaatctagggttgtgcaaaaatttgctctaaaaaattagattttatcagccaatcaatacccaacaaaatcaattttgcgccttgctgcctcacaggggattgtggccaggccaccacgacagcctagtctacggaaacgctttcttggttcgttcaaaccatgggagcatgagcccggcagtgcggacgaagcggccgccgccgcagccgctgccgcggcggccgccgccgccgaagccgagcgcggagtcgaagccggcgaaggcccgtgcaccggcaacctcgctactggagagcctcaagtcgttcaagtcccgcctggccgccggcccgccgctcgcgcccacgccgaagtccttcaagtcgtacgcggagacctgcgcgtccatcctccggctctgctccgccgccgcggccgcctccggcaccgctgccgcctcctcaaacctgccgctcgtcctctcaatccacgcgcacgcgctcgtctccggcctgaccgcggacggctcggtggcgtcgcacctcctcaccgcctacgccgccttcgcgcgcgcggcggaccgcgacggggccttccgggactgcgtctccgtcgtcggggcggcgtccccgttcgcctacgatttcatggtgcgggagcacgtcaaggccggggacatcgtctccgctcgccggctgttcgacggaatgcccgagaggagcgtcgtgtcgtacaccaccatggtggatgcgctcatgaagcgcgggtccgtgagggatgcggttgagctgtatcgccagtgcccgctctgctcggttcccttcttcaccgcgatgatcgcggggtttgtcctcaatgagctccccaaggatgcgctcggcgtgttccatgaaatgctcagctgcggcgtgagtccaaatgagatcactttggtctccgtcatcaaggcatgcattggtgcaggtgagttcgatctggccatgtctatcgtggggttggcaatgaaatcaaacttgcttgacaaaaatcttggggtacgcaactccttgatcacactatacttaaggaagggagatgcagatgctgcacgcaggatgtttgatgaaatggaggtgagagatgtggtttcatggactgctttgcttgatgtgtatgctgaattgggtgacctcgagggagctcgacgggttcttgatgaaatgcctgagaggaacgaggtctcctggggtactttggttgctaggcatgaacagaaaggcaatgcaaaagaagcagtgagtttgtatagtcagatgctggctgatggttgtaggccaaacatttcatgtttctccagcgttcttggtgcttgtgctagccttcaggacttaagaagcggaagaaagatccataaccagactttaaagatggcctgtagcaataatgtatttgtatccagcgctctgattgacatgtactgcaaatgcaaacagttgccagatgcacaaatgattttttactccctaccacaaaagaacatagtatgttggaactctctcatttcaggttatagcaacaactcaaaaatggtggaagctgaggaactcttcaaaaagatgcctgcaaggaatgttgcttcatggaattcaatcatctctggttatgcacaaaatagacagtttattgatgcattaaaatctttccatgcaatgttagcttcagggcagagtccaggggaaattaccttctcaagtgttctcctggcttgtgctagcctgtgttctttagagatgggcaagatggttcatgctaagatcattaagcttggaattaaggaaagcatctttgttgggactgcactgagtgatatgtatgctaagtcaggggatttagatagctctaagagggtattttatgaaatgcccaaaagaaatgatgttgcttggactgccatgattcaaggacttgctgaaaatggttttgcagaggagtctattctgttatttgaggatatgatctcagcaggaataacaccaaatgagcagacatttttagccattttatttgcttgctcccacagtggcttggtggagcatgccatgcattatttcgaaatgatgcaggcatgtggtatatcacctaaagcaaaacattatacatgtatggttgatgtccttgctcgagctggtcatttggcagaagcagaagatcttctcctgaaaatcgaaagcaaatcagaagcaaattcatgggctgctcttctgagtgcctgcaacatttacaggaataaggaaatgggtgagagggctgcaaagaggctccaggagttggacaaggataatacagcaggttatgtgttactctcaaatatgtatgcatcttgcgggaaatggaaagatgctgctgagatgaggatactaatgaaagggatcaatcttaaaaaggatggtgggtgtagttgggttcagataagaggtcaatatcaagccttcttttcttgggagacaaagcatcccttgttaccggatgtttatgagatgttggatttgctgacatgggaattgattgcttgatttttttaaaaatgtcatataggagtaaaaccttcgaggctttgacctcattttgcttctttagttcataaagataacgatagcaggatggagttgtttctggagaatggctgaaaggaaattgcttttgacattccaaaaatgatagttgccttcatatgctaagctccagaaatattcatggttatttgcttccaaccatctagctggaattttagcaaattgtgatagccgtgctggattattacaaaagaaggtagggcattattgttggtttattgactttgagcaccgtggtttgtttttaatctgctcttcaaaacagcactacctcggcatggtagcaacctggaatagaatgtctgtatctttttgctgaagttcgtgtgatttgacaacaaccaacttcagatgaacaacttcagaaaattcaactgtgtatttactgcattgtgactatcctgacttgtttactgaaccttgtattgcctcctttgatatggaattcaaatgaagattactgcaaaagatgtcccgggtgcgagaaccctaagcatgaattgtgctatgagctagctttagtgataacctttgagtatgaactctctggggtcaccgttgaagtgggtaaagaatgtctaagctttcgttattccagtttgatcgaaaatcaggtaaatactttgctatcttcgtcccttttgatattttataatctgctcgtgaattgacaatggacatgcacggatgcaccagcattcatgccttatttcgaagtcttttcagcattactggtcattttaatgatcttttgacatttatttgttttctcagtacagccaactggatcttagaagctgttcggtcgagaaatctcagaagtgtaccgtgtacgccgtctctgctacatgtatatggcttgattggggaactgattcttctttaccggttgaggtaaactcgttcacatgaaagctttataattataaagtgatttactctgtattctttatttttacttatggattataaaaggattttgattgcacgccatagtactaataatgtttttcctctacgcgctggcttcgcagtttttagatttcaaaaaagtaatgtgcagtttaaccaaactagcatggtggcccgcgcagattgcgcggctagcatcattatattttctctcatataatagcatatatgttttctcattatattattcaaatatattaaaatgacaacataattttaaattttgtaataactttacaaaactactaatgtgtaatattcatattatattttatatacgtgctatttattaattatttttactatcaaattttagttatttgtaaattatatatatttctatatggactctagactcgtcttttaatatatttttttattctgaattttctgtaaattgtatttctatatagactctatgctcttcttccaatattatttatttttatttatgaatttttattatttctaattgtatttctatgtggactctaaactcatctttcaatattctttaatttttaatttcgaatttcatttacttctaaattgtattcctatattgaccttcacctcttcttcccatgtttttcttaatttcgaattttagttatttgtaaattgtatttttatacggactctaaactatacttttaattttattatgtttattccaaattttagttagttttaaattcctatatggactctatactctacttctaatattccttattttttaattctgaatttctattttttccttaattctatttctatatgggctctatactctacttctaatattccttatttttaattccaaatttatattatttgctaattgtattctatatggactctatactctacttctaatatttcttatttttaatttcgaatttcagttatttcctaattgtatttctatatggactctatactttacttctaatattccttatttttaattccgaatttcagttatttcctaattgtatttctatatgaactctatactctacttctaatattccttatttttaattccgaatttcagtatactctacttctaatattccttattttttaattccaaatttcaactatttcctaattgtatttctatatggactctatactctacttctaatatttattatttttaattccgaattttagtgatttcctaattttatttctatctctagtctcctcttctaatattccttatttttttaattccgaatttcaactatttctaaattgtatttctatatggactctagtcttctcttctaatattccttattttttaattccgaatttcagctatttctaaattgtatttctatatggactttgccttttctttttctccgattaatgtgaggatttctaggccatgagagcgaacgtggaggctcctttctttatttctttaataatataatagatagatgttttgtaacgaagggaaatcagctatttttacaaaagaaagaaaaccgtatatctccacccataaacattaacggcagcattagatgcacactagtcgccactccctctcagtctcaggaagtcagaacgaacctagcctgtcggtctgtcggactactgacgagcatagtgactgatacagaggctgtatttgaatccaaacttctaactttttctatcacatcaatctgtcgtacacacagtcagatcgtactaatttcaacccaaacttctaaacttggaaggaactaaacacagtcagaactcattatctgtttacatactactagactagtatcttcttttcagtttattcactatattattgtcacgaattttgctctaggcttctaaaaatatgatatataaaagaaattcagttgttataaattatttgttagttttatttcttaaaatacttaatttatccctataacaggtagataatactttctctgttttttaatagatgtcgccgttgatttttgaacccacgtttaaccattcgtcttattaaaaaaatttatgtgaatatataagatataaatcatgcttaaagtactttgagtaacaaaaataactcacaacaaaattaattataattacacaatttttttgaataagacgaatgatcaaatgtgtaataaaagaacaatgatgatatctattaaaatacagaggtagtacacgataataatctttgaaaagctaatacatactccatctatcccataatataacaatctagaatcggatggaacatttcatattagaacgaatctagatagatgcatgcccagatttattgtattataaattgtctcatctaattttagattgttatattattggacggtggagtattagtgcatgtggaccgtataaataacatcactttctttctgtgtgaaccctctcaggatgcatctttggggaaggtgcagatccttaggtttctgtgctgtgcatttcattatcaaagccaaggtaactggacgacgtgcgcattgcactccaagccaatcacatcaacctgcagccgattgaaccgcggggttcaaattggctggccggtgccggtggcaattgatcgctctgcctcgtgccatcgtcggcacgcggcttgactctcttgtccctcctcgtgtcggcctacccgatcagcaccggacgcccagagcccagacacctcagcggctgggcagttcacatccgcgtgtactactacgcatattcttctttccccacccgcaatcaccgatcaaaccgcgtcgccctcagcagcggggtcaggtcaggtgcgccttctagctccttccttctcccactcgtctcactccatgctccactacttgacgcttatagcgcaccaatccccaactttaccaatctttttctccggacgatgttggtttctcccgcagttgtggtctaattaagagaagtgcagccttcaggtggctggtgcggcggggatggagccactggaggtggcgatcacgatcatcttcgacgcgctgttgctggtgttcatggtgaagctcttcttcgccatgttccagatgaagctcgtcgtcatcctcttctacctcgtcatcctcctcttcgccatggccttctccggccgggcacccagtagcttctagtatgccgcgacaaatttggaggtgcaaatctcttctttcccccttaattcgcgagctgattggtggatctacgtggattttcatcctctggtggaatcggtcgtctcggtttttgtgtaagaaaggagaatcatgaggccaaggtgcaaactgtgtagtcttgatcaaagaaaagccatggccatggccccctctcatgtgaatttagtcgagagtttcttctataatttccctgcttatatatttctacttacatttttgctaatgactcttgtcaaaagtgtagattttctagtggtttccttgatcatcaatggagagtagtctttcttgcaactttccccctttttctcttgaagaaaaataccacctgagttataccactttcttcataggagtatataaaaaggcagccttatgctattcatctcgccgtgtggcttcaataattatagagaaggtcccgaaaatgctgaaatggtagtctttctttcctggttcacgcgacactgaaatgtgcaatatagaaaacaaaaaagaagatccagtatactcctaccaatcaatcaatcatcaatgactattttgtcgtctgcgattgtacttaaaaaatactttttttctcatatcagtctacgctattgttcaagcttttctttctcatttcatcgaaactggctggcaaatctcaagttgacttatgtaaccttggcaatgaaacgaactgtgattacgccattacggcatcggctgatgccccctctgtcctctcaccacaccaatcgccatggcgtaacatgcgacgagcacaccacagtcaccgtggtcacatgctcacagcctcgcaggtgccacttgagagcaagtcttgaaatacagaaaaataatgatttaactacaaaatttcgtgcagctagaagtagaaatggggacaagttttgcagattttctgacagcaactctgcaagattgatcttcccggaaataccggctgaacaataaaaggtgccttttttaaaagaaaaaaaggcctattttacagcccaactgaagcctagcccgtgggtgttacgcgggagaatttttatttatatatttactttaaaaaattttaaaaataattggaaaaaaaaacgaaatactccatctgtcctaaaaagatttaaatccaacaaaactagacacacgtgtctaaatttattgtttttttttaacagatggagtatactctaacgcatgactgtgtattgtaaaagtcgccctttcaaaaaagaaatccttaaatattttttttaatttacagtttcacttcccgtccgttttagttactagtaatgctgatggatcttgttgagctctgtaattttgatgtaaagttttattttatccaacttcatttgacatatttgtaaagtggcaaactatatagaaaaaatgcatttaagtcccttcctgacctcttggagagcggttttcgcaaaataaataaaaaaataaaaaacgtctttacagagagagttaggggtatatttttaatttttgaagacaaaaagaattgtgtacataaaacaatccagtttactcgtgaggcccatattagtaggcccagaacggggttgggaggacgcggcccattacagagcagagaaatcgcccccagtttttaatcgatatcaagttcatcactcttcttgttttcaagttcatgctgaaattactccaccgagcagacagcagagaaatcgatcccagatgacaagcaagattatcgcacaataacgtcttgtttggtaacacaatgaaatcatgatgtaaaaaaaaaggaaaccaataaattagaggaaaacggagacccacagattatcacatttcttgcattctgattattaatcacctcattactcttctttaaccacctcgcttctgctcttcttgcccttggcggcggcgtaggcggcgccgtggaagtcgaggaagagcgcgagcagcgacgcgttgaagacggcgttgaacgcccacccggccatcccctcgcacccgccggcggcgaagtgccgccacagcatcaccgccgacgccgcgaagctgaagaggaactgcgcgatctgcagctccgtgacggcgcgcttccaccgcggcggccaccggaggccgaggctgcagcagaggtagtagccgtacatggcgacgtgcacggcggcgttggtggcgagcgcgatgggcatcagcgactgcctcgtggcgagccagaggtagcacatggcgatgacggcggcgtggtggtagacgtggagcagcgtcagcgggcggcggccgaggaggatgagcagcgtgtcgccgagctcgtacaccttggagaggtagaacacgtgcgcccagaagaagaccgggcccgacgccgccgtggcgccgccgggagggaagcagaaggcccaccacgcggagggcgccgtggcggccacggagagcacgcacccggcggccatggcggcggagagcgccaggaggaccgcgctgtggagcgcggagaccgcacggagcgcgcgcgggtgcggcgacgggagcgggaccacgcggcggtggaggaggaacaccgtggcgaggtaggcgcagatgacggcggcggcgaaggacggggtcgaggcgggcgtgcggccgggctcccaccggaaggaggcgacggcggggtggtcgaccagcgcccaccgggcgcgccgcagcagcgcggtcgccgccatctcgcagggcactgtgcacccacctccccgacctcgccggcctgtggagcgcactgtgtggtggtttgagtgacacgtcgagcctacattagcgggaagcttgggtatgggtggggcgctttgtgcgacagtgggagtgggcttgggtagtcgatgctgccaggctggggcaacatcagcccttctaagggcctgtttggcacagctacagctccagctccacctctcctggagctggagctcagccaaacaatttcagctccaccaaaattggaagtggagttgggtggagctctctcacaaaatgtactagagttgtagagctgtgtctaggcagctccacaacttcactccagactcaactcctggagttatatttaggagttggagctgtaccaaatatgccctaatgtttcgatgcctaaacgtgagtatgtacgtctaaatcagataacaaaaagggagtgaccaagtaagagcatctccaatagctttctaatatgctaataccaatcccaaaggataaattttaggaatttggtctaaaaccatgtcgccaacgtatgcctaaaccagctcccaatttttcagtactcccaattccggctcagcctttagccagatcttgggctcctcgcggagttcccaatctgagcaatcgttgcaatttaaaatgcaagggcgaacctaaactaaaaacttgaaactacatgcttgtttggcacaactctagctcaaactgcacctcttctagagttggagctcagccaaacagttttaacttcatctaaaatgggaacggagctgggcgaagtgctttcacaaaataaactaaagtaaagagatagaggtgggtttaggctactctacaactacactttaaacccaactcctaagataaatttaggagatggagctctaccaaacatgccatacatatttaaatccataaacttgcagaatgtattattgccagtcgtaaatttgatatggcccatcacatgggcactaaccccccccccccccaccacaaataaataaataaaaacttgagatgaaagtctatctagcaccctgaactttaacatcggacattcaaccccataaactttgcgataccattcatattagccctaagatggttttagattgtggttttgtatattttgaaagcttaaacgaataactttgaataactaatataacatatttgcatatcgtcggttgtaagtcatcaatttatacttatacattgatatcatactattaatatattggtagttgtttgtaagtgagagctaacaaggggtgaaaagaaagattcaggtggagattttaatatatatgtccaatgtgtatgtcacgtgatcaaacgcatccaatatatatataaattagataaaaacaactatgcaaaccaccttaggggttatataaatggtactgtaaagtttagggaaggttgaatatccggtttcaaagttcggggcaggggagggggggggtatttggactttttccctcctcttttttatccttctcatcctcttcttcccttgaacgactcatggacggtgataaacgaggtgagagcttgtgggcagcgaccgacgacaagctttaacggtagtgacttcatgtgaaaacgctcgaggccttgtggtggctagggatgagctcgacggcgccaagaaggtttcaggcagcggtgaggctgatgaggtgctggggtggatgcttagagggaggggatggttagagctcaaggtttgcagggagcttgttagcgcatggccaaatatgagtggaggctcatggcaaagtatttctacaacagtacaaccaaacctcatctttatctgaataagagttctccagggcctccaggcacccagacagagccccatttgctactctgaggcaaagaatgaggttctgcctgccacccataacaatatcagagaacatacaagagggtactcttattcagataaactaccatatcataattcagaaatcaactgtggtacactcatgggctcattgcctagaactgaacactgatacactagaagaattaaaatccatacagggctcaatatgcgtaaatatcaggaaacaatcagcctaattcaactgaataatgttgatgcacattcttgatgttccggccaacaataagctttgagcttcagtttcagaacagtggcaataccagcaaagtttctaggcattatcttataacgctacacaatacacattaccttttcccctatgatcatattcatatatcatctcaatttctcaagatcctgtgaactagtatccatctttctttgctgtaagaatacaccatcctctattcatagagatttgacatggcattagcaccacaaagaagtgatgtaaaacagaggtagataggtccccccaagttatcatccagtatcatcaataacacgaaccaaaatttcattccattagagcacaaatctaagcgcatgttcccaacagaatccatcaagcattacaaacatacaaaggatttgacataagaacatcacctcgagcacaggaaaacccccgggaaaaagctcagaagcagcagtcgcagtcgaaggggcagagcggggtgccgccggcgtcggacttgccgaacccgagctcgtcggcggagtatatcgccagcccgtccgccgtgcgccgccgcggccgcttctcctcgacttcgtcgtcgtcgtccgtgtccctgcccttgctacccttcttagccttattgctcttcttggccccctcggacctctccttgggcttcttggctcgcacagattcctcctccccctgctgctgctgctgcttgcgcttcttgccggatgacttggtggcctggaagatcttgtcgatctcgttggtcgccttcttcttcttcggcttctccgccgccaccgccgccgccgctttctcctccctctcctcctccgtgggtttcgaaggcttaggtttttggtcggaggacgaggccttggatttgatagaaggattaggcccggaaggcctcttcttcttctgtgatttggtggccatcggagtctcggagaatatgaagtcggaattcgcagccgccgccgacgaggaggagaaagattgcggtggctttggggaagggaaggaatggcggcgagaagggtttgcgagtggagactggacaggaagcttgtggagttgtggagttgtgggccttggattgggctcgttccaggcgtcgtctgacgctgaatttaaccagcccatctgacaggaggaaatttacctgaaacccagttactgcttttcatcatatttgttgttctaaaactcgtaaaaccccgctacaccgagtgaatttactccacaaacctttttgttcgaattccgatgattcccttgtttctttcaaatgattcctttgtatctttcaaataaagatatttgaaatagtaaaatgagaacaggagcgatataagttgaaaagaaatcggcttgagatggaaagagagaatatgtcaacttgtcaagcagatgtatcattatacagactcaataaacgaattcttccaccatttcacatttcataatttatgagttatgacgcttctgaacaaacagttcagaacaaaccataattcacaatttcacatatgtacaattgacaaggatagtttttgtatgtacaaattgctgatcatcgcgcatgcataatttcactgctttcacacttcacagtgccttcatgacgaatttggcagacacgacagctcccttggctgcaattttcagcacgtggcgactcctatacaacctgcacaaaataaaaggcaacagtcaaagaaagaaaggagatatctccgtatggacggtactgttgcatcttcaatgtcatttagctaaatcctactaaaaatagatcccctgaagaaaatcagcaatataacaaaacaaattaagataatgaaagtcaggtttgcattatgaaatggataggaacctcagcattgaaaacagaaataaaccaaaaagcagattgtaacaagacgtttacttgcaaaagcgacacaaatttagtatggagacaactttaccccactattgtgattccccatgttgccaatatgtaaagcacttttccagcctcccaaatactcatccatttccacttatcattaagggtgctcaatgccattgcaacagctgcacagatgttaaaagttagaacatgctacacagaattgaacagcacgtaaagcagactaagactctcaaagacagaatattttgtcaaagaaacttagtcatgtgatcaagaaatcttgtttattgtctcagtgcaatgaattactggtccaattaatttcatttgtgattggatgtgttaaaggggtcagtctcccataacatgctccaacattgagttcaccaagtactcgactagaacaatgcatacaaaaacttgttgtgataaccatatccacaccataatatagcactgttgtttagatccacaatgttggaaattagtaaatcacaacactatttcaaacagcatattgaagttcaagttctttcttggtcacacacacactgactcattgttttgaaccagttacctaagtaacagagtttagatgcaaataaacttcatctttatcaaatttaaagtaacagcatggagataagaagttagtatacccttttgcagctccactggtgatattgactgaagaatacagaacaacaaatagttagatcattgaggtagtatagagagtattcatcaattgttgaaaacaagataccttggactttggatcttcaagaatgcacctagcaataaaggaggtcataccatcaataatgtcatcatcattaacaagtacataattttcattatcaattccactgatttcctccatatttgccccgggtttatcacaggcaaccaagacccaagatccattcttcccgccaccttcagtgtatggaatatctgcaatatccagttctggttttgattcatcaatcaaacaaaaggttatttacattgttgttggcacaatgtaacgcaggaaacaaatagtcataaaagtatggttcacaaataaaatcgcagtgtttcacacagatgtacctgtcatgttatcaggagatagctctgtttgttgatgccttgactcatctcgaattttctcaagctgagccaagaagctagcattgttaactgctgctacaagacgattatgcagctgcatcatgaaatcacatccatgaaaagcaaaatcggtcagacattaaaaggtaaaacaaattgaacagtgatagaaataaaagctggataagggcatgtaatcacacaactgaatttctaagtcataagtgttttggtccatgcatattatcagtcagcaactcagcatcattgcatcacgaattaaacttaatatgtcctgttacaccccctcaaatggcatggattcgaatgattgttgttaaaaaaacggtgacctgataaattcatacaccgcaattcctgccaaatttcggatgctcgtgtttttatagtatctaacaaaacatcatctatgatcatgtcaattctcagaggattaaggttaatactcctaatctgaaaacataagagagcaacagggagttgcaagaggctcacatcggcagggcactcctgggaaacacagggctcgccttggagctcgcggaggatggagaggtcgtcggcgaggcgagcgcggaggataacgttctccgcccgcagccgctcggcctcctccccgtccaccgccgggggggagacgccgtcgtgggccgggccgtggccgcggcggtgctcgatggcgtagcgagccacctccgcgatctccacgagcgtgtgcgccacctccagggggatcttgtgcgccatcgccgccgccgcctcgatcggccgccggccgctcgatcccctggcctcgccgacgacgggaccgcgggaggagagggacgagaggaggacggcgaagtaaaccctagggccaaacacgcaacctgagcggagcacgaaaggattgtggtaaaccggggacaacccgtgctgtgctctgctcaccacagaagaaaagagagagaaaagaaagggttacggagtagtagtactaattaataacgggattcggtcacgttcacgtggcgccaagctgtgtctaaggagaaggaaatagaaaagattaggaagatacgtaaaacgaggtaagttattagcgtatgattaattgagtattaactattttaaactattttttaaaatatttttattataaaattttttttataaaaacgtaccgtttaatagtttgggaagcgtgtgcgtgaaaaacaatgtccctttctcacctaatctcctagaactaacgcacccaaatgtcacagggaccatcatagtaaaaatttctctatgtagaaagtggaaacgcactgaacgtgaaaattgtaggaaaaagaaaacactgtcgccacttttgcttccgtactccgtaggtccgttaacatccaaaatgttgtgcacaaaatagcgaatgaaaattttggcctttttcttctaacttacagtactggatatggagggtaaatgacacgtgtaaattttttattagttaattttctgcggaacaccatacataagcatacactcacatttattttagaaaaggttttgttacccggcctctacaaccaaccaaatatatgtagcatttttaaattaagaacttagcctattaaataagaaacttagccctcaaataacccgaatattttaaattatgaacttaactcggcctctacatccaactggatatatacttcctttttaaatcctcaaataacccgggtacttttttacatgtacatccaaccgaatatatgtagtatttttaaattaggaacttagcatatcaagcagagaacttagcccagcctctatatccaactggatttttaaaccctcaaataacccgggtatttgaacttagagccttgggatgctactcaagtcactgtaaccagattatatgacatttcacacactcacattcaacctactactatgaacaccttaacagatacatcgtctagaatcaaaagaatagttagttgtagacgcaagcacatgtattaagtttggaacttgaaattgagtggacatactccatcacaaggaccctttctagatgagctacgctaagttcacgacacggatagctgttaaacaaagtccaaaaattacatgaaaaaattagaggaaaaatttggacatgagaaaatagctttacttactactcccttaatcataaatgatttatattaggataacatttgataaaaattttaaaactttaaccataaatttcaaattaaaataagttaaatctaatagctttacaatattaggatatttcatttcaaggtgattttttttctgttttataaactgagcatttgagatgttattgatagtcaaaattttaaaagtttgatttaagtttatccaaaacatcaaatatttatgcctagaagtagtatattgtttagtctcttttttttttcttgccggcattatgaagcaaaattagtgatcaataagtattttgtggtagggcaaattttgaatgatgaactccactttcagtgttcggaatacaaccaaaatatcaagctaagtatttgtgggcacctgtgtctgcgttttgcaaaaaaaaaaaaaaaaaatcaagctaacattgtttgtttgttttctctaacaagctttgcttgtcgcttttgaagaaaattttgcttgcttggattaattgcgatcacgtcatatcggtgatacaccaatgcactccaaagtaatatcatagacacaggattcttaataccactagatcaagctttgctaacctgtgaagagattaaagaaaacatgagcatgttgttgggagaacatagggcaataagggatggggtagcttttagagggaaataaggattttgtccttaaaaaaatgagaaatgatttaccttcaacagcgaataatatgggagcgtatcctatgcacacaggccctcgcgtgtacacaccgtgtacaccaactaaaaattatcacaaaaaattctagaaaaattcatacatatactttcaatagtattacatctacgtgcaaagtcgcatcttcaaattcattctacatagaaaataacaaaaaagataaaattctgacaaaattgcaaccttaaaactgtcagatttttttttgttacggttaaaatataatgaatttgacgttaagattttaaccctaggtgtaatacaattaaaagtatgcgtataattttttttctagattttttggtgacattttttaagttggtgtatgcgtataattttttttctagattttttggtgacattttttaagttggtgtgcacgtgtgtacacatgagggcttgtgtgcatatgatatgttgccgaataatatgacagaacaagcaatgagctatcagaaggtcacacgaacagcccagaatacacatttcgctgacaggacactacgcaagttagagttgtacccaggtgcatagctgcattatgcagtcccatctgctgtacattatttgtacaaatatattccagctatcacaaggctaggcacaaaattagagacaaactaaccaggccctacttgatacaatgccgtcgatcaatttacagtagctcatatacttctctgataccgagatttcagagaagcctgacctttctcttcattaggagcatttggcaccggaccaacaaaatcagcatccccactgcttggccagactagaggaatcagcttctgctgatatgcattcgtattatcgcatatgccaagctggatgacaaacgttactgtgcagcctcttcctgttccttcgctatccaaccagatgtgccctcccatcaaagtaacaaacctgagataggatttttcacattttcagttaagtcgccgagtttacagtgagggagtgagtatatagcagcctcagcacaaattgggttgcagaaaaaggagctgataggtaagaaggtggtgatgtatagtaaactacctcttgcaa

SEQ ID NO: 59124 - DNA, 40573 bp, Oryza sativa
gggggcgaggacgcagccggcgcccgcgctgcggaggctgtcgtgccagcagctgaggcgcgcgacgggggggttcgcggcggggagcaagctcgggcagggcgggttcggccccgtgttccgcggcgcgctgccgaggtcggggcaggccgtggccgtgaaggtgatggacgccgcgggatcgctgcagggggagcgggagttccacaacgagctctcgctggcgtcccatctccttggctgcggccacggccacggctcgccgtccatcctcctgccgttcgcctactcgctctccgcgcagccgcggcgccgccggatgatgctcgtgtacgagctcatgccgaacgggtcgctgcaggacgcgctgctcgggaagaggtgccccgagctggtgtccgagtggccgcggcggctcgcggtggcgcgtgacgtggccgccgcgctccattacctccattccgtcgcgcaaccaccagtgatccatggagacgtgaagcccagcaatgtgttgctggatggtgagctccgtgctcgcctctcagattttggcctcgcgcagataaagtcggaggagagggatgaattagagagtgctgcaattgagggcaatggaaatgagagtagcaatccttgtggcggatgtgatgatgacatgtctgttgctgatgaaaatgctactgctgttgctgtcaatggggaagacaatgctgccaagtcaccggaagatgatgaggggtttaccatggcttctcctgcagaggcagcatccacttcaggatgtgataagactagtgtcagtagcggattgaatggccgaagctgcaatggtggaggtgctgcagcatcaggagctgggaatgactggtggtggcgtcaggacaatggtggtggttctggtggtgtcaaggactatgtgatggaatggattaggtcggagatcaagaaggagcggccgaagaatgattggattgcaggagcatctgcaaccacccctgccacctcaacagagagaaagaaaacaaagcgcagggcgagagaatggtggcgtgaggagtatgctgatgagctaaccaagaagcaaaaaaggcgagcacttgctaagtcaaggagtgagattggtccaatggctagcatgcagtggtgggagagggactgtgacttagaggagaagggacgatcaaggtggagaatgatgaaaagctggagtcgtaggagcagcaatggcaatggcagcattgattggtggattgacggtgtgagaaggagcagcagggattgggctagtggggaattcgtgcccaagagtggtggagcagtgagcagcacaccaagcatgcgtggcacagtctgctatgttgcacctgaatatggtggtggtggacctctatcagagaaatgtgacatttacagctttggcgttttgttgttagttcttatttctggacgccgcccactccaagtgacggcctcacccatgtcagagtttgagaaggcaagtcttatttcatgggcaagacatcttgcccgtgttggccgcttgcttgatcttgtagaccctgcgctgcgggatgttaaccgtgaccaggcgctgcgatgcattactgttgcactcttgtgcatccagagatcgccaagtcgccgtccatcaagtgaggaggtgcttgaaatgctctctggtgagggtgaaccaccgaatctcccagtggagttctcaccgtcgcctcctggtgggttccgtttcaggtcccgcaagaaaggtcggtgagtttattttgttggttagatgaaataggtagtgttacttttctgctgctgcttgccttatcttgtacaccactaatttgtgtacactaccactaatttttctgttgaattgatttgtttataaagatcttgatggggaaaagtgacggtttcagtttcaaatcttaagaactaaggttcacataatgcaaaatgcataattgcagtttggcaatttatgtacaacactaacaaatttatccatttgatgtatctttgtacaaagatcttgatagggggaaaggtctcagtttcagttaacatttgataaggactcagtacccatttttcgaaatgcataaccgtggtttgatcactcctgaattgcaaatttagtatataaactatgatatcaatacattgctgtacagagatctttatgacagaaatggttgtaatttcaattcaagtttgacaagaactctgtccccataaatggcatacatcatacatgatgatagttggttaacaccaggaatgtggaatgttgtgcgtgctagaaagacagcttcagaatatttttctattttggattggaaagctcgcttcttttgctggtagactgggaagcatcttgcttttggatgtatagtgttttgctgggccctgtgatagtagctgtttatttcttcccctggacaacgactttctccaggcgtacccagttatgtgataacttttcatgttcacagatctcttccacttctttttgcactgagatggcattataactttattcagctagtatattctacatattgctgcaaacagcttagagaatgctatatgaaaagggcttctttagaatcttttgctagtgtagtgtggtcactggtcagaatttggtaaaagatggtttaggtatatgcatacttttcttgtgagatctgattgcttgatgccgtagagttgcccgtgctttatctacaatgtggtgtgcatttattgtcacctttggatttagggtaaccaattcaacaatgcttttatctacaaagtgatatacatttattaccaccgttgggtttatgataatcaattcatcaatgccttatctaccaagtcatgcattttattatgaccttcggaatgatgataattcggtcggtcatgccgtcagggtatccacatattatggactaaacaatgtataaatgtatttatgatggacaaataatacatataacatatactataatttatgatggagtagtataatttgtagagatatttacaagtttaaataatatcaatattaataacatggactagtgttagtgagctcggctacaattaaaatatcaagaggtggggtgaaagtaaaagaaggaagaggaatgcttcatgctttggcaaatatcccatagtaataattttcagatatccgtattattatattattatttgtacatgttagaagctttagtttcgtatttgtatctatgaaaaactatccatatttgtatcattatcagtatctgtaccattatcagtagacgattatctaatctgaattatatccgcatttgtttttcttcgaaacggactaagattgtgttcttttaagaggttcaggcttcagcacccgaagcgagataagccattagcacattattaattaagtattaattattataaacttgaagttaaatttatgtgatttttttataaaaagtttactccctccatttcatattaccccctccattccataatataaggcacaaccactttttttagatgttccataatataaggcatgcgtgcatgtagacaattaactatgaccacctctccaataaattattactttttaaaatcctacactcttatgctctctaattctattggatgtatgtattgtatttattaagatgataataattatttcttggtctttggtttagaggtggttatgccttatattttggaatagagggagtacttgtcgtcttaacatttacgcccctttacattttaatacctgttgtttctacattccaaagcacttttaggggtgatctttctttctacccttcatcaatgcacttttatctttctcattggcttatgttctttgaaaaaaataattgagatgtatttaatcagtggagatgtatttaatgaggggtaaccatgtaatctgccatatctccttggtttgagtgagatttgctagaacgacaaataatataaaacggaaggagcatataagaagttttttcacgaaacatacagttagcaatttaaaagatgtactgtggtaagctagtagctggagtagtaactaagcataaaactatccactctatttttatccctacgtggaagactttgatcggtcccccaaacatcttagacgtttcaaatgcctaattaagtcctcggaagttcacttcaggttaaaaatgtcagacgtcaataagtccagccaatggacatcaaacctagatgtaggctatgttcaatgggaaaataaatctcaaaagtaagaaaaagtattttgtttgattcgacctgcagtcgggtatgaaatgaagcacattagcactcactagaaaatactatccgagaggctaatttctgctaattgatgttatctaaggatgattttgaccaacgaaagcttggagagctttggatggacacctttggggcaatttataatgcactggagaaagccgcattatgtcccagtagtctgtttcttaatactgctgtcgctacccggctcagggggagaacggcagtgaagaaatttagcatgagcgaaaattaaacattaaacctgatcaagcagattattgcccatcagagctattcagcacgacaaaacaatagtatgacaaactatcatttgctaatagtatgacaaactatcatttgttgttacaacttacaagggggtatactagtatgaaaaatatgaggtcaatcaagaatatgtgttaagcctgtcacgttctgcaactgcaagcatctactaattttcaggatagaagggcaggcatgctaagctcgagccaaggggagcataacagcatacacaactctgcaggttttgtcattttatttatattcctctagaaggatgatgtacttctggccattgatcttctgcaggtgtgagattttcctcagattggcgagaaaaacttccctgtcctgcagtacaagaagaataaccaagacatcaacattttgcccatgcattgatttttgggaagtgtaatgactgtaacagggcattgacaacaaagtatttgacacaataacagaaatgcggactatggactcttactccctccggtcataaatatttgacatggttgactttaaccataaagtttgatcatttgtcttattcaaaaatttaatgtgaatttgcaaaaatataagtcatgtttgaagtaccttttaatattttattaaaacaagtcccaacaaaataaatgtaattataaaataaaatgtaataagaatggttaaacttcagggtcaagatcaattgtgctaaatatttattactggagagagtagtaatcaacaaaaaaaagtatgtgctccatacagtgcctttatgtgatgtgtgtgtcacgaagaaagatatcaagaaactcaagtagcatttgataaattcaaggccaaaaaaataaaaccttgaattccaaaacgtgcagttagaatatgacgtcatgctcagtactgtatttgtataaaaggattactagatgtaacagtccagaacagaacaaatcagaaagataaaacatcctacctctggacttcttagtcgaggcgaaaatctgggcataaaatcttttgaaaaatctcgcattgcgataggtgcatataaacgaagtaccaccctgatttcctccactgtaataggagatacatttgtatcacttctcgctgaggcaaatggttctgaagttggttccaaggaacacgaggtctcctccttcacgactatcttcttggtatcctgtaccaaatatatcattagagaaacaattcagtgcaatgtaattaaatggttaaaaacttcgttcacatgttttgagtgaaatgaagtaacttacaggctctatcttcggctttttaggggtagcacaagtttttgaatcatcacccctttgtctcctcttttgattggatttggaaacatgtggagtgctataaggatgtccgagaactgttggtttagaatggttgtcttcctgtggttcacttttgagttgatcctgctgtttcggagcaagtactggcgatggtgactcatcttcctgtttagatgaaacaactgtaagcataacatatattccacaaaagcatattatatgaagattttcaacaggaacaatgattaaaaattattacatccgtgtcttcatcgtcatcatcagactcgttttgtcccgcggcacggcggagcaacttctttagttccttaccagatttgctcaggcctacccctccatgtttctcattatcatcctatgagtagtcacaagttcatatttgaaaatgtattagcaatactgtggtaaatgcatcagcaactgtaagccacaaaatggtgtactagcaggatattgcacgaatgccatattgccatgttgactgataagtatgatccccgaaaaaaaaatgataagtatgagcacaagtgcatctatttctgtccacacctgcttaatttctggtggagcagggatttcaggatcagctaaatcacctccttcctctgggtcaacgtccacagcttcatcatcatcagtaaagatctcttcatgttcccaatcatcacctgataaatagcagggtccagctaaagaacttcagaagcccattaaagggctaacatacatgcattgatttacagtaatggtttactttattatacgtaacaattaataactatttggaataaatagaaataacaatgtccttatgatacataatttataaaaaaaaagaatagtatctagccagcttacccttttcaatttcatcatccaaatcaaagtctctgtctttactaccttcctcctccctaccctttgtcataggcacatgcgctctttcttccccactgcctttatcagatttattttcatccccattcttgttgcctttcttcaggtgaacctgatctgtttctccttcattagcatcatcgagctgcgtcacatctgaactaaaagcagcagctccatttgtagccgccttcatcatccaccgtccatacccagttgctgtgcttctcctcctgctcatcttctcttcagcttcttccaaagtcagctgtttgtactgtgaaattttactgaagttatacctgtaaaggcataccaaatatgcaagcattaaaagagtgattcctgtttgatggggctcacagtattgctattccttgtcaaaaagattttggtggtgattattgttgaaaatgaagtggaaaataaatcaacatatatatcgtgagtaccaggaatcagcgggaacagcgtgtacatccttgccatgcatcatcaacaaataatatgtcgaggctgcagattgtaagccctgaatttgaccttggtactgatagtcacctgtatcatcttccaaaatacatgactttctgttgctgcaattctcctgttatttgacaaatatgcgtgccacacgttaagaggatcaaaagcaaaaggcagggttaagttcttgagtttctatcagtcaatgaaaacaatttattgcagataggtctctttacatgtacattttccatgagataagcgatttaaagtttgtgccattaaggccatctaatagcatgcgaccaatcaatgatcttagatatttattgcttcgctccttgttgcttcgaatttatcgtgttatgcagatggaaaaaaaaaactatgatgatcatccatgataacgaattaagtagtacccatatattgccggtaggttgccgtccttgctgtccctcgggatgaagagaccagctgcggctccccgcattctccctatcggagaagggcggcacaccggtggtgaatttgccgatcgtatattgcttctctccggtggtatccaccaggacattgtactcctgcgcacgagcaacgggaacatcaaaacttcaggggaagggcaagcaattcccaaaacagccaagcggcggcggagacaatgccgacgcgcacggaaccaaaagccctagggtcgccggcgcacggggagtactaagcagtagtgcattacccggatgaggctggcgatgggggcggcgcagacggggcagcaatcgccggagcgagccatggcgctgccgcaggagacgcagagggtggcgtggcggcaccccgtgccgtggaggtccgacgacgagccgcagcgctcgcacgccgccttgagcacgaggccgtcggcggagacacccatgccgtgcgccgagcgcgctctctccgccttcgccgccgccgccgctgctgctctgctctccccctcttcgtagggttttggtttggttcggttccgttttgggcggagcgggggaggcgacgagagcgaggccgaggccgaggcgcggtggagtactggcgtgacgtggcgccggttagctagaaggggggaggggctccgagtctgtctcagtttggtggggacggaaacggagtcaaactgatctgaccggtgccccgcgcggcgacaaggtagtggaccgtgctgggctgggccggaccgtgttccatacacgggcttccattttgcagtggaaaaagtacgctgaaggtccctcaacttgtcatcgagatataaaatggtccttgaaccacaaaaccaaaccggatacaacgcatcctccaacttataaaatcagtgcaaactgatccctcggtgattttgactctgttttgtccaatgtagcagctgacttagagtgggacccatgtgagccccacccgtcagcctcttcttcctctttcctctcttcatctctcctctcctctcctatacacgggcggcgggggagggggggagcagctaggtgtgggcggcggacggcaggggagcagctggctagcttgggcgcgggcagcaagcacaggcggcggacagcgagggagcggctggctagctgggcgcgggaggcgggcacaggcggcggtgggaggagctgcgcagggcgggcagggaggagcgacacacgggcggtggttcctcgcactctctgccaccagagccgccagctcctcctgtgcgggcgctgacggacgcccgccgccatcatcaccatggccgctggacaccgacaccgatgtggagcggtcccctccagcggtcgcgcccgctccagcttcgactccaaccaggcgaaagagccgcggatcgtggcgccgcgatggtgcctagctcgtcgggaggtcgaggcaagccaccatcgccagactccccaagctcccgcgagctcaccggcgacaatgaccgcccctcttgcgtgttccttggtgagaaaatggggatggctggtcgagctcggtgacgacgccgcgcgcaccggcctgccggcccttctccccatgccccatcatcgagaagatggggacggccggtcgagcttggtgacatcgccgctcgtgcctgagcgccaccacccagctcctccccagccggccgccgcccgtgcccgccgcaccggtcttccacgcccagctcctctctgtcgtgcgaccggttgagctcggtgacaacgtcgcccacagccgcgcaccagcctgccggcccttctctccatgcgtcgccgtcgagaagatggggacggccggtcgagctcagtgacgccaccgccctcgcctgagcaccaccacccagctcctctcccgccgaccgccgcccacgcccgccgcatcggccttccgtgtctagctcctctccgtcgggcggtcgcccatcctcacccgccgtgcccagctcctctcccccgctaccggtcgctaggaaaaggaggagagatgaagtgtggagaggggggggaagaagaggctgatgggtggggcccacgctgagtcagctaccacatcggacaaaaccggagtcaaaaccgtcgagggacctagtttgcactggtttgtaagttggggaatgcgttgtatccagttttgtggttcaaggacaaatttataacgtgataacaagttgaggggccttcggtgtactttttccttttgcggtcgcgcaagcctgggcggcatttcgcatcttggcccgagcatgaaagaaatttgcaagaattataggatattgtgtgctccataaagggaaatttgctaggattataggatattttatcctatatcatcttattacaaatgctcattcctatttaattttgttacaaaactaccctggtgcgcacgtgattaacccgatcaacatgttttcttaaattatgagttaatagtggtatttacaaaaattaaatatgtctagagtatagtcttgattttttttgttatttcacaaatatagtcgttcatgagagctggaacattgtcatgttgagtttctctatatgaaaaaaaaataatgaaatatgaagaataagtctaatgcaagtacttcataattcggctaacttagcttgcagtcttcctacaatagcgataacaaaatgatttggttaagcacgtgtcgactagggtgatttttgtaacaaaattaagtaggaatgtcaaaattcaagtgacttatggggtggttttgtaattttcccttctataaaagatgaatgaaggtgaggaaatgctttttttttttgctcgattatatggaagacgcacatgcactcacaccgtgactaaaatggtttaagtgaattttcttcaaacattaacttcctccacctcataaaaaactaatttctgattatgaatttaaatgtagcctgctttcagcttttaaattttatatgggacgaaggaagcatgttttagtaactccagaaaaaaaagtatgtttcaataacttatatggggcggggtagtagttttccgccttggtagttggtagtagtatacagtatatttaaacacatttatcacggtcgaagcgggcaataatacacagagtacacatctgatactctgatagagcttggcggatcgaatcatccattttctgaaggaacaagctatcgacttgagtcttgcaagcaagtcagcaaccaatgtctaatggaacggctcaacttgtgttatacgggatctctctttaactaccatacgctaaattaagcggcattattggtctctttaactaccatgtgcgctagttaagcgtccttgtttgtctttattgtggttaacaagtcttctcccaacggtgctctcagtactaacagagtgtgaaagccattaaacatatggatcgatccagccaagccagctgctgcaagttgatcgagtggacatgcttgagaattgagatgagacgctcgaacagtgcacgaaagcagcagctaccaaactacgcttgtcggctgatcaggctgcttgcgcgtgcgttttctccaagctgggcgtctggtggtggcctggtggagagcgctgtacgcgcttgacgctacacaatacactcgccagctgagctgagctgagctgctggccctgcgcgtcttaatagcaggattaagctgcagattgacctcgcaacagtcggagatgacatctacacaataatacaaacgttgccgatcgattcctggtgttactggtcattatcactcgttgttatcgttcatttatgaatttaaaaacttaactttaagttagttttaaggttttctcataatgatttatttttcaacattaacttttaaaccattaaaaacacatatttaagcattttatatacttattacaccatttatttcatattataagttgatttgatttttttaatagtcaaactctttttaagtttgaccaagtttataaaataaatatagtagtattttcaacacaaaacaaacaactatactatcaaaatatattttatgttgcatttaatgaaactaatttaatgttgtagatgttgctaatttttttataagtttagtcaaatctaaagaaatttaacaaagaaaaaaaaatcaaaatgaacttatatgatataaaacacagagagtattatttttctacctgatgtcggatgatgccatatctacagttggtgggttgcgtcgtcacgctgtgtctgcctacctgggccctggggaaaaatatgaggtattcctacaaaggcggcttagcgctatagtcaattacccgtgacctaatactttaatactactatcattccccatcatgcagtctgcataaagcggtgtttcaaccttcgcttgagattgagaagttgtgccatcttcaaagaatcaaagtcttcgacgtacctgtaatttttaacgtatagactgaaacaccgggtgagagcatgcaggtgaaactctaggttacgaccggcgcacgcagcttggattaggtttgggtgggagggtgcagccgtgtagaccacggggagacggcagaatttaaagcgtacaaaagcatttctttttgcgaatttgtggtaagtttgttattattggtacatgatgaaatctcaaatgacaaagtatagaataatttctaccatgttacaatattatacatccgccttgtggggtcagaagcggtaaagattagatccgaagcttattcgcccggaacttttgacagtgaacacatgccaaacaacccgatttgccggtaagtaaaaaggtactaccaagtaaaaagggaaaaaactcagtggagaaaaaaaagaagaaaagccaacgtgacaaccgcccatccagaaagcaaagataagaggtcgtgaggtcgtttcgtcactatagggagtgtacttggctatggagagtccatcgctcgtcactctcccaatctaatgctgatgctgatatgattgccaatgtgttacttcctccattttacagtataaaattttatagtattgttaatatttatttatatgctaataaatctagacatatatatatatatgtgttagatttattaacatatatatgtatatggacaatactaaaaagtcttatatcgtgaaacggagagagtatgtatacttcgagaattgtcgatactctcggtagataatgccatggcagcaaccaaccaccaccagtagtccagtacagtagtaccaatatcatagtggtggtagttgcagtcaatagcatggtctcctcctctcgatcgatcacagcctgctccttccggcgtgtacgtcgctgccggcgccggtgtggcggcggacgaagtcggtgacctgcgcgatgaactccgcggcgcggtcctccttgaacagctccatcgcgtggtacccggcgccgtcgagctttgcttccacggtgacaccggctttctggagtgcctccaccagcgtcctctgccggtcacgcggcgggtccttcatccggccgagcaccaggcagggcggcagcctccgcagccgcgcggcgtccacgccggcgagcatggtctccgggttgcagtactcgtggtcgcggtcggcgcccagcggcagcgcgagctcccagagcaggtcgttcgccgggagcggcagcacgcggtcgtccaccgacgactcctccgcggccgtacgcttcacgccgccgtggtgcggctggttgaggatcagcccacgcagctccacgccctcgtccaccgccgccagcgccgcgcggaacgcgatgctcgcgccggcgtggctgcccatcaggaacaggggcctgcagcccgcggcgtacgagcgcacccaccggaccgcgtcggcggcgtcctcgaacgcggcggggaggcggtgctcgggcgcgaggcggtagtcgacggaggcaacgaccgcggggatggtggccgcgagggccgtgcaggtgttgtggaacggctcggacgccgcgcggaagaggacgtacccgccgccgtggaagtacagcaccagcggcagcctgcctccgccgtcggccccgacgcatgggccggacggcacgaagaggcggacggtggtgccgttggcgtcgttgagtggcgcgtcgttggagtgcacaatgcggcgcgccggcccgttgaccccgtcgacgggctcccccgccggcgccggcgggaggagcctggccgcgccgttgcgggtgagcgagccgtcggggttgaaccggatgttgaggtacttgtacgggtccatttcgcgatcgagatcgagcaccgcgctccggaggaagtagtactgttggtggtggtagctaggcaactcgccacggagcatggcgcgcgcagcgcagcggatatatagctcgcgcggcgggggcgcgggagactgtatgagggagccgacggtgacggcgactcaaaatactactccttccattcggtgatagtttttcttgcatcgtttgaccacttgtcttattaaaaaaatttgtataaataaaaaaacgaaaagttatatttaaagtattttagataataaagtaagttaaaataaaataaataataattataaaatattttgaataagataaatgaacaagcagggcaagaaaaaatcaaaatcctacggaaaggagcgagcactagtggaacggagggcacgccgcggtggatcgcggatgatggagcagcggcaggatcgggtacctgacccggggacggggaaagggatagggacgtgacagagtggcctgtgtcgcatttactaatggcgccccatctaactccgcgaggtacgcacccgcgtccagcgagtggccgggaaacgggcacgcatgcaggctgtctcgcgtagcgtggagttgcgcggtacacggccaccgcggctgcttttccgccctgcacggcaggcggcccgcaaagttgcaacttgtgatctgcgtgtgttggatcattgatgagagttgataggagtaaatagaaatggcatgtcactccccttgatattttttttccaaagcgtaaaatagacgcattcacttgtaaacacgcgtgcagccggctgtatttgtgaagagaggaatagaaaagattaagaaaataagtaaaacgatgtaaactattagttcgcaattagttaagtattaattattttaatcttgaaaaaagaattaatatgatttttaaagtaaccttttcatagaaagttattttttaaagaaatataccgtttaatagctcggaaagtgtgcgggcgaaaagtaatgtttttcccttctcgttcaactatcaaacactgcatatagtcctataaacacacataaacattctatctttattggcacgttcaacaaccatagataattagatatcttattgttcacatatcacttcattaataaaaataattagtcgtaaataccaacacatattctaaccgagtgtagcttagtttgcgatatatatatatctactattataaaaaattgaagatgtttttgtcggtacattgatacgttattcttgtttgagtcggtttttaatttcgttcgcttttggaaatatagggtctgttccgctgcacgttacagcccttcttcacagccaagctgctgcttgtggatgcagcgaaagaactagcgactagttgccttcagctgcctagcagctactgtaacaagcagccgaacaggtccatagatttgtgtttgagtcattcttttttatatttgttcgcttttgaaaatataaaagaagtcgtataagaaatatcattaaaacactcacatgctaacttgagacgaaagtccaactcctaatcgcaactcatgattttctaaaaagaaaattcaagcgagtttctagagtaaattcaccctggctaaaccgtataacaataataagattaaaatggtcttcacacgttgcaacacatgggcaatttttttctagagagtgtgtgtataaagtacaaaatgtacaataaatatatattgcacgaatactacttgcgctagtgtttattactatactagcctatagctcgtgcgttgcaatggaaaaacaaattgagtttgtagcttagtaaattagttaataagtacttattagtttaagtaatagtataatttttttgttgaacaagtaagtgaatttaaaatttggagggaatcaatagtgaaattgggagaacctgttgaaaggtgatcgaatagtatagcttgtggggcctagatgttagtggtaggggtgtggaaatggacaccaccactattaaaatattttaagtagtatatatatatacggcttatgcataagagttaaaaataataattcaaataactttgtcacattttatttatactgcgttaaaaaggcttttttatgtcaatgatagttatgtttatttgatagagataagtgtcgattttttaggtcacgactatacatggtatggagatcgttggtaccaaggtatatgcgagattgagataaaagagatggagacaaggattttatacagatttgggcgccttatctgacaggtaatagccctactcttgttaaccgaagccgatgttgcttttattcttcataatcacacaagtacaataattgggataacctatctaactatcatcgacttggtggcatagatcaccaacatgtattcgatgacagggtagtctttctcctcgagtacgaactcatcgagatcggagatggcgctagatccctcttgtcggcctctgtaagcactagattgggtttgtctaggcttatctctgatgtcgatgtctggcggcgtattggtttgttctaacttgtgtgtcccctcccctcctaggggatgttcccttgtccaattagaactagggagaccaattaatatgaatacaatccgagtattacttatagttttcatatagaactttatttatcattccttatccggaacttcttctatatataaggtataattccatataaaacttggtatatagtgggccccgtctaacttagtcgattactattagttatatggtatccataatcatgataataagcattaaacgtgaagataacatcttaattgcattattcacataaaagatattgttcaaagaaattgcaacgtagaattttacagtatgtttatgacatgtttttgcagatgcaaatgaggcaaaagagaataacgaaagtgggttctcaggaaagagcatgaagacgagctaggtttatgcgtgctccaagagttaaggaagagaagaaaaaaaaatacctatgctattttatattattttaaatgataatgttagtggtggtgttcgaattgattccaacttcacaagctgacatatggggctataagatcaacgcatgtgaatgcacgtttttgcttcggacatggcattatatatctaattaactaactatgcaataaaattgtattttttgctgaaatttttatctctataacatccgttgcaatacatggtccttttgctagtaagagaaaaggttatacctaggagcatatttgaaccactaaaatgatagcttatactccctccatttcaaattgatctatatatagttttttttgaggttattcctaaatgatctacatatttgtattcatttattaagtctattcgttatttgtgcattagagtaaatggacattgatgcatgcatccatgtacacaagtatttataacccacatgcaatatcttgatttgctattggctaagaaatagtggggatggtacatacattgagtttgttgctagagtaaatatagtatgggaaagttattagcttttcttggtcttggtgtacctatgaaatatgtagatcaatttggaatggatgaagtattattaaacatatggccttcaaatgaaatacttgtgatagtatgataatagattctaatatctgaaaaatatggtcattacatgcttttacttcttgaatacacgatatagatgatttattgctatgaaaaaaacttttcaaatgacaatactatgtttagtactccctccatttactttggatagtaatattttatcttggcacacagaccaagaataagcaattctacttatcatccatttaaatataccactagtcattcctcgtaaacaagcgattcgttaatatttacatttctcgatgcccatgtaaccaatcttgtgtggaagaatggagagtcacgcattaaatttgagaaagtcattaagatgataggttgttggattgaaatatgcctatcaaaaataaatttttcagatttagaaatatgactatcaaagatagatggagagagtaatatttgtcactaaagttgctctatgtactgtaagagaagaaaaggaacaaatttgagtgtgatatgctcatatgttagatttgtccttttcaaaatataatatatatatatatatatatatatatccctccatcccaaaatatatttatcttttgattgtttttgtttattccaaaataaccgcatcttttaaacaatcattgcatcgggttttatgaaagtaagagataaatatattataccaatcctaacccaagacactagacatagttttcataaactccacatcatcaagaaactagtattagacactactctttcaatacaaacaccattgtttcatacttaaattctatactacttatctcatatgatatcttaaatgttgtgtgaaaccatgtctcatgcaagtcctggtttcttctctttccttatttattcacttggcacatcatctttcattctaagtggtaaattatttaatgctatcgacacatcctagttattgggttgggactggccttaggactagatagtgggagacaattgtattgatatttgaaaaaagtaaaaggtattttagttttttatttggtatgtgtagaagagatgataagagggagtaagtgtgagtcatgtttatgttttttttatgacacatattgtattaaactattaatgctgtcaagtgctataaacaattttcatagcaattgcatgatatttgacgaaacgagggtcgagggatatacccccctcgagtctcatggactggaagggttttctcccgtactaaagtttgttagtgttcactttcatgcacttctcattttaattttttttactgatatgggctgcaagcctccctttttctaaacacgtcactcttgttgaactcatcacgcatgactcgccgattttgcaccgagtcccattcaacaatcagcttgcgatatactgtagaagttctaattagcggctgaataaacacgggtccctatcgtttggcttatttcctaataagccaaaacggcttattgggaaataaaaatgaatttatagatgaaacttttataaatgtgttcatggtgacttaaaagccaatgttataaaagaaactatattgaaaatatctaaaaatcaatctcaaaattaagtttaaaaatttaaaatttagctttttctttgactgatttagccatccgatggcagccacgggcggcgtacattcagacttcaacaccagaggtgtacggtacggaggaaaagccacctcgccagcaacatgcccatcgcatcgcgtgaaacacggtgcatattgttcggtagcccctgcgagattttgtctgcaactgcaaagctccaaaagcgcactgggctgggcgagtgagtgtgccaaatgccagtgtgtgcttcgtccggtggctaatttagctgacctctgagactggccccagttatgcaactagccccgcaacttttttttttctttttcggtacaccgatgacaatcatgccaaggtgcgtcccgttccgtcccctttagctgaccttgatgaacctgatgtgggtatcgccggaacagagcccggatccccaccgtacctttcatggcatcgctttttggggtaaggacgggacatttccggcgtacacacctgcgcggctggtgggagccgtcggcatcggctgccgtccgtcccctggccggctctcggcaaaccggacgacccgagaagcgcgcagcccgtagctatcggcctatcgcgcgcggcgcactaggcaggcatcctagtttcaccgggttgcgctgtggtatgggcggtgacacccgtcgagctcccgacccatgcgagctcgcggcgcgcgctaaaaaaacgaagcgacgacgccgcgtcgctttcgggtatcggcacggaagcggcacgcgcgcgaccgcatcctcgtgaagattggtggcaacgggtttgaccgatcgggagctaagccggcgctcttccgctcttggacggctgggagaagttttatgggtgggtcagctcctggaacccggaagaagtggacggaatttggaatcggggatctttccgccatgtgcgtgtccagtcgccaccgaagaaaaaatagacgcgccgttttatccattgctttttctaaacgtgactgaaaggaggcaaaaaaaaaacaaattcttgatttatttctgtgtatttattggaggaaggctacagggaaaccactaatagaagatgagtcaaatgatacagcacaagcgcatcatctttgttgtgtccgcataaacttgccctctcggcatcggtgctcggtgaacctgtcgatttcttcagcttaagggcattagtagtgtgcccacttattttcgtatggtcatgtactccacctagacaaaaaagtgaatgaagccacgcatcacaaatttcaatctcccacagtgcaccatggtctcagctgataaaatcaataacccaccggttcggggtcccactcgtcattctaaaaaaaccaatccttatcttccttcccagcctccacacgcacgcggctacgcaaagaccgtcgcctcacttccttcgtgagcccttccctaccgtcgccacttcctccaacgccgacgcctcacatccctggctggcacccctcctctcctccccgaccggcgccccgctcctccccaggccgacagctgcgtccctcacctccccaggccggagcagctctccctccccctctccctccgttgttccctccccgcctccgacctctttcttcaccgagctctctagatccggcccgtggctcgccggatctagactcgagcggtgacaatgggggaagcagtggctgctcgacagcatcttgatgtggtaggcccgcggcggcctttccccttctcccctctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgcctcacacagggtgtggggtgtgggcatcgcacagagccacgaagcgcgaagccacgacccccacagtgcaccgcgccgttctccccacgccgcgcagcaacttttctgacgaagaacgcacgcccagttttggctacacgaacctcgttaggtcacgctctaatcccagctggtagagaatctcctacgtggcgtgggttggccaaatgccacgtgtgtgcactgtgaatgccctaacgaagatagtaagtgtcgacgggtgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttataaagagaataagggaacttgtcggatccggcgagattgtagtcgagttgattcaactagctctcgatgacttggctcctcgtaagctccggcttcgtaggctgtggaggttatgttggctctgagattcgatgtctaaaccccccggggggggcccttttatatcgcagatgaggaggtctcctcatagaactcggaggtatcagaccttatacgatatgccaacgacccagttctgcccgagtaggattcttcccatctatagattccgtgaaaggtttccttagaatatacaggaaatatccgcctgtgcgtgggtatgccatatcgatatgtaacgtatatcgaagggcaaatggtatgcctaacccgtaaccctgacagtagcccccgacttctgcttaaattgaactcgtgcaaccatttgcgacttcgggtgtcgagactgttgtcattcccggtgcgagaaccgcggagatagaccgtagtcgagcacgccatttgaagcccaacggtcacaagcgaattttaaactgaagtccaaaaaaccggcgcgcgtaacgggaccagaaatttccggcgggcatctctctctgttccctggaatttgcaccgtcggtagtgcgcctatttaaaggaattttgggagtccatcttgaagtccgccaaacctgttaaacacacaccacctccaagcactctttgccttctctgccgccgcaagaaaccctagttcatcaacctaggctcgctttccggcgaccttcgatcagcaatggacctcggcaaatcagcttccaccagtgcaacgttgaagaaactccaggaggatggcgctcttcctagccgtggaaccatggagagggaagcaggaggtactaatcctcagcccatcttgggtcgcatggttgcgatcgaagattatgttctctgcggttttctccctccaccttccgaatttcttctcctggttttgaatttctatggcatctctcgtctccatttgaaccccaattccatcgccttccttagcatctttgtgcatctttgtgaggcctacatcggggtagagcctttccttgatctttttcgcttttactacgaactgcgttggatggaatccaacagggtatctggttgcgtcgggttccgacttcgggatggcctgaagtcacgttacattcccttccagtggccttcttctcgcagcaagtggaggaatatgtggttttatcttgagatcaaggactcgaaccctgtgttcgtggttcccgaagatcaaccggacaagattccgtcttggaccgcaaagccccccttgaccccctctcttcagtcgtttatcgacatcatcgacgatctccaagaacggggtttgttgggatatgaagtcgttgcagacttcgttggtaggcggatccagccgcttcaggctcgggcccatccagcttataactattccgggctagaggacacgacctgggtttctcctcggggtatctttctcgcatttatcttgacatacttgtgttcgcattcctcttgacttatcaaaggttggttctcgattaacaggtctgagcggcgaaaccgtggagcgccgcatcggccaagtgatgatcaatggcccgaccacaacgagtgacatccctgtgcccctttgtgaaaagggggcggcggaacgtgatgaagccatcaacgtaagtatattcgatgaacatcccgcattctcctttcgaaatcactttatgacttgattgagcgtaggcccttcctttgactgatatcatcggatcgctcgcggaccatcaggtggcgtcatctctgaaagtgaaggtcgtcaaggaggcgtctgattctgccaccactagcggtggcaatgttccgacaaagccgaggaaattctcgtctgtaatcagacaacgtcgcaaggcgtcgaccccctcggtaatttattttgtcgttaaatcatgcagcaagaaggatttttccttactttgcgttgattgtcttccaggcctcggacgcgtctcccccacctccacgacgacaacgcattgtgacaatcggcgagaagtaagtagatgaattcttgaatccctgcgcttcttattcgattgttgtctaactcgtattcgtcctgtagggaggcgcgggcaaaggctgcgcgagccaagtccggaggagcttccagtgcgtcacccgtcgtggcctcgacggatgtcgtgcccgcagctgggagccgggaggcgacgcctagtggcccagtcagcaaccccgcggcaggtcgtgatctgccagctacagtcctcacctgggaggagctccaagtcgagatggggcgcctcctcgaagccggtgctcgcggcatcggccgcgagattgcggaggcgaggtcggaagcggcgacggcgaatgcgcgtgctgacagactagtgtgcgagttggctaaagcccgtgaagacctcacgaagatgagggagttggcggccggcaatgagcgacaacggaaggggctcgaggaccgaatgtcggaactcgggaacaacctatctgagatccggggctcgttgagggtcacctacactggccttcaccagctcaccggggaatgcggcgtcacgtccacaatcccagcgaatcccgatgagttttcgctgacctctctcgcggaactggcgacggcgatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctcccccgttttgaagagtaggacttcttgtatttcctagataatgtgtaaaactcgaactttgaccgcctttgtgcatgcgattaccatcccggcttactttggtatgctgacctcgggaacttttgtcctctgtagagatactgatgacgaggatgtctagcagcgcgggcagcccgagtcactggcagtaattccggtactcgagttagaaccatacgtctcgcctgaccatgtggatcaaccccttgatatagagggaaggatggcgacgactgcctcaggttagtagtcccttcaccccttaatgcccacctgactaggttagccatgttcccgaaagagatgtatagcttgacttagtggttatcacgtttagcagatctcgagggtgcccttgctagccaagatcgtcgtatccaatactggaagacgaagtttgaagtggcggagctcgagagaaccatgctggccgtgaagaaagagcaggttgtggaaacgctccgaggccgtgaggtatggtttaactcgtacttgaagagttgttgcacatccatggccagggtatgcagggagcttcgagtagtccgcggagatcccgaggagtcggcggccgggtacatctcgtggcttaatggggcctgtgcccagctcgatggaatcagcaagcgtatcgacgaggccttgaagcaggagtgtcgtcgatcgagccgatatgccggggggcacgtgttggcttgcctacgagatcatcgcccgcacctagaccttgaatatcttcgtgagggttttgctcgttctcggaggactccggcagagatagaccatcttgcaaggtcaatgtcgccgttggccgagaagatcttccagtctatggactggtgttggccctcttggtagtactcgtaccctgtgacaaatatcttaggaaaagatgtaatgtagcgaaagatttgtgaaaaaactgtaaggagtatttgtgaataaagaaatctatctttgacaaatgtctcttactcttgatgtcatgtgtaagagtgcgttctcagttaacgactttagtcagccgtttgagtggtacactctccctatcccccaaccttgtcgtcagaggaattttctcggaggataaggctcttggacctttgacctggcttggttgaataagctctgatcctagcccccagccgtgaagttggaaagttgatttccgatttcacagcttggttaatacgcacggcgagaactcttacacgaccagatcttatatggtctttcgtctctacaggatctgacaaggccttatcggttctgggcatttccagccgaagatcccttaggttcctcggaggccttgtcgagacggcgtaaagggacataaggacaggtttcaacgctaggtgtcatcagagtgagggatcatcgggcgaaacacgttgattgtgatatgggcctagaaatagcctttattgatactgtaagggtgcttacaggtatggatgatattgactcatacatagaatttacgtaattggtcaatgttccaagaatttgctaattcgcgaccatcgccgtctgcgattttgaatgcgcctggccgcaagacttgtgtgatcgtgtaaggtccttcccatttaggtgagagtttgtttcgccctgcttggctttgaactcgtcggaggacatagtcgccgatcgaaagtatgcgtgcacggatgcgcttctcgtgataacggcggagggtctgttgatagctggctgctcggacggcaactcgttcccgatgctcctcgagaagatttacatcgatatcttgctgcccctcctggttctcgtcggagtacttctgtactcgtgtactctgatgttgtagctcgcctgggagcatggccttagagccgtgcacgaggaagaagggtgtttccttattagacgttgtcggtgtggtgcgtacagcccatagtactgatgggagttcttcaacccaccttttgtcgtgtgacatgagcctgtcgtagacgcgagttttcatcccttgtagtactatgccgtttgccctctcgacttgtccgttgctttgagggtgagagaccgaggcgaagcatattttgacccccagcccgatgcagtagtcctggaaatcggcgctgatgaactgggagccgttatcagttatgatgcggtatggtagtccgtatccgcaaaatatccctttgatgaatttgatggcgttgtcggccttgatttcccccgtgggtactgcttcgatccatttggtgaatttatcgatcgccacgaataggaatctgtagtcgccctgtcctcgtgggaatggcccaagtatatctagcccccagcacgagaatggccaagtcagagggatagtttggagcgcttgcgtgggtagctttgtgtgtttactgtggaattgacaggattcacatcgctggaccatgtcgcatgcatctttaagggcggttggccagaaaaagccttgtcgaaaagctttgccgaccaatgtccgaccggcggcgtgtgacccacatatgccttcatgtatgtcgaggaggaggtgtctgccgtcgtcggtcgagacgcatttgagaagtaccccgtttggcgctttcttgtatagatcgttgccgaccatacagtagatctttgctttacgggttattttctcggcctctgtgtcgtcctcgggcaactcctcgctgctgatgaatttgattagtgggatgcgccagtcgtctatggtttcgatgtcggcaacggcgcgttctgcctcggtgatgtccgagctaatgtcgggggtgttcgggctgacttcgctgctaacctctttcaccgatggcttcgtcacgatatcgagaaaagtgccgggctcgagcgattctcgtctggacgcacgtcgtgctaggtcgtctggctcgacgttgtccttgcggtaggcgtgtcggacctcgatcccatcaaactttttctctagcttcctgacttctgcgagatacttggataacttggggttagagcatttataatctttgtgtacctggttcgcgactagttcggagtcccctttgacgattagtcgcttggccccaagtgtagctgcagctcgtatcccggcaagtagtccttcgtattctgcagtgttattggtcgccctgaagttgaggtggattgcatgcttgaattgatctccggagggagatgtcaagataaatcctgcccctgctccttggctgttgagtgcgccatcgaacgccattgtccctgttgcattgtcgccttggttgtctgatttgttatctggcatagtccaatcggcaacgaagtcggtgagtacctgggacttgatggttgtttgtggcacaaagtggacatcaaactggcttagctcgactacccatttcgcaatgcgatcgacaacgtctttgtttctcacaacttcaccaaaagggaaagaggagacaactgtgagtctgtgggcttgaaaatagtggcgtagcttccttgatgtcatgatgactgcgtaaagcagcttttggatctgtgggtatcttgtctttgcgtcgtggagagcttcgctgatgtaataaactggtcgctgtactttctctctctcgacaacaatgacagtgctaacggagtgtggcgtggcagaaatatagaggaataattcttcattaggttggggagcaacaagtacaagggggtttgataggtagcgcttgagtgcaatgaatgcctcttcggctttctgtgtccatacaaatttgtcttgtttcttcaacagagcgaagaaaggttgtcctcgttctcccatcctagcgatgaatctgcttagtgctgccatgcatctggttagcttttgtacctccttgagtcttgtaggcgacttcatattctcgattgccttgatcttctcggggtttgcttctattcctctgccagagacaaggaatccgagcagcttgcccgatggtactccgaacgtgcacttctcaggattgagcatgaggcgatatcgtcggaggttgtcgaacgtttcccgcagatcgtcaatcaatgagtcgcctgtcttggttttgacaacgatgtcgtcgacataagcctcgacattgttgccaagctggttgctaagtgcaccctggaccgtgcgctggaaagtatccccagctgttatcagtccgaacggcatcttaacatagcaaaataccccgaacggcatgatgaatgctgtcttctcttcgtcctcttttgccatgctgatttggtgatagctagagtaagcgtcgaggaagctcaataactcgcaaccggctgttgaatccaccaattggtctattcgaggaagtggaaagtgatccttggggcacgccttgttgaggtcggtgaagtcgacacacattctccattttccgttggccttccgcaccatgactggattggctagccactctggatgaagtacttctctgatgaagccagctttgagaagtttgtcgagctcttctcgtatggcttgtttccggtctggtgcaaatctccgcagtctttactttactggcttggcatcgggtcgcaccatgagtttgtgctcaatcatctccctggggacccccggcatgtcggacggctgccaagcgaacacgtcggcattgtcgcggaggaaggtgatgagcgcaagttcctatttctcgtttagtgtcgccccgatcttgacggtcttgtcggggttggcactggagagtggaacaatcttgatggcgccgtctggtttcggcgtcttgtttgtcttggtcactttcttgggtggctcagtcgtggcgggtgggctgggcgtttgctcgactatgtcgaggcttcgcttgtcgcattgcaccgctagctttgcgttcccttgaatagtgattgttcccttcggtcccggcatcttaagcacttgatatgcgtagtgagatgcggccatgaactttgcaagtgcagttctcccgatgatggcgttgtaagctatatcgaattcagcaacatcaaaggtgatatgttctgtgtggaagttgttggcttggccgaaagtcacgggcaacgtaatcttgcccaaaggtctggacgatgattggggagtaattccatggaagagttgatcagttggtatcaactcgttttgcggaattcccatcgcgtccaaagtgttggcgaaaagaagattgattgagctaccaccgtcaatgagaactcgcgctaccttgatgttccgaatagtgggttcgaccacgatcagatatcgtcctgggataacgacggtcttggggtggtcttctttccgagaactctatcttctgctcagaccacttcatcttgggtgtagccccctgccatgtcgagcagacttcatgttccactttcttgtattctcgcttggaggagtacgttgtggaaccgccgaagatgtgtgagacgtggaggtcgaagtctggatacgctgagtccggttcgtgaggagctgtctcttcgttcgtctcgacaacgtgtactcacttgcctttttcaaatgccatgtgcttctcgagcgactttttgaaaacaaggcaatcttccagagaatgtctgtccgtcttgtgtatagggcaccatgatttctttgtgtcgctgctttgtgggtctatgcgtttgggagggttcgcgtattctgctgcgaggacttccgcttgagctttccttttcccgtttttgcgatttttcttcttgcttgactcagatgtgtccgtggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcgtcggtgatttcaggaattgtgtttctgcactcgttgaaatgtcgaacatattccctcaatgattcacccgaattctgtgtcaacgcgtgtaggtcgtcttcgatcgcgtggcgcttgtatgttccttggaaattgacgatgaattgttgccacaggtctgcccacgaagagattgagtagggaggaagatgcatcagccatgaacatgcagaacccttcaacgcggttggtaaatagttcgctaacgcgttgtcgtctgctccggcagcatagagtactgtggagtagacttgaaggaactcctctgggtcggtgctcccatcatacttttctattgctccgggtcggaatctttcaggccatcggacatcacgtagggaacgaccgaaagccctacacccagcgttgggggtggtgggttgccggtggtcgtgtgtccttgtggatgtctgtctgacgatgaggaggacgcggatgatgacgatgacgatgggtcgcttggttccggcatacgattacgaggatgatggcctggatctcaggaatcctgtcgtcgtcttccgctgttgtctcggcgccgatctccatcatcatcgtcgatacggcggcggccatgaccagtattgtctagcacccgtcgttcgcgattgttgtgattgtggtggttgttgtggtcccggtcctcgtttgagcggtctcctcgatttccgttatcatggcgccatgaagagacatgacgccgagagcgattcacgttgtctcgtgtgcgtcgtgcttcccagcggccgttgatttgatctcgaagatcgccagtgccgcgaggagaaggggtagcttgttgaggtgattccctccgttccggatcttcaccattggcctcgctagttggtggctgctcctggtgtgctgcggtagcggcttcttcaaacgcgttgctgaggttagtcaccgattcccgtagtcgttctgtccaacgctcgaggtcaacgttcagaacaggatcgtaaggagtttccctcagtatcgcttgaacggccctgatgtgctgggctggagtagtcgattgattccccgcttctgtgttggcgtgcgctgacgtgccgatgtcatcgatagccaatacctcccgcggcgcactcgttgtcgatgacccatagtcctcgaggagatgtaagaccgatggttcgtgaggatcgatatcgattaccccaacgaatcgatctgaagttggagtcgctccttgttccttgccgttatccctgatggggacgtatgacttaggacactgagctttcatggcactgagaaagactttgcagctcgagaggtcgtgattctttgtcttgtgaataggacaatagacatcccgagttggagaagtacgctgaattccacgttctttgcaggcgcgaatttcagcacggacgttgaggaaaacccatcaatcttgcagagtgtgtttcttggttttgtggataggacaccaagaccttgtggcttcggaagtcatctttgttggctcatggttcatgtcggaaggacaaggtttggccatatcagaatccttcttgagcttggatgccatcgatattccgttctccgtctcgatgggaggatttttcgacatggaatcgccttggtttgtagccactgcgttctcgtctccggtcattggaggaccggttgagatcggcgtcgtggtgtaaaccgggaagacgatttcgccgacttgagtccataccagcattgttgaagcagggagtacttggctgaggctggtgctaacgttgttgtcgacgaagctagatgacatagtagtagaaccttgagtaccaaagccccctacctggcgcgccactgtcgacggatgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaataagggaacttgtcggatccggcgagattgtagtcgagttgattcgactagctctcgatgacttggctcctcataagctccggcttcgtaggctgtggaggttgtgttggctctgagattcgatgtctaaaccccccggggggcccttttatatcgcagatgaggaggtctcctcatagaactcggaggtatcagaccctatacgatacgccaacgacccagttctgcccgagtaggattcttcccatctatagattccatgaaaggtttccttagaatatacatgaaatatccgcctgcgcgtgggtatgccatatcgatatgtaatgtatatcgaagggcaaaggatatgcctaagccgtaaccctgacagtaagtgacataacatggcttcaaatttcaagtctcggagtatttgacagctctgcttctaaattctgcagataaaaaaaccactctgtattgaagcatacaaccagtggtattattattaaaatttatataaaaaagtagaaatgttgactattattttagaaagaaaaataacacgctacatctttttgttgatttgagaagttcagttcgagaggtttttatatcccgataaatatccattaccttattcgctacgatttgtattcgctctgtttttatattctataatatttgattccgtttttatatccggggcttccgattcgattatgatttcgagaaaaatatggaaacgaaaacgatagtgttggtttccgtctgaaacgacagtgaatcaagaataaaaatatagggtgagctcatagtatatgtcaatagaacaaaaataaaatacatatcgttgtgcaagttaaatttagtgcatacatgatcaaataggaaaggaaaaagtctatttactctcttgactatggccttagacgaaataacccctaacatttaatttgatttacttaacccctggttctcaaatcctgatactattcacgtttccaacataatgcaaaccactttgttgatgtggcacatgggctagtgaaaaatgacgtcatcttcttaacctagtgaaacatgatctccaaaatatcctctgatctctagcaactacagcttgtccctatgcaggtatgacatccagatttgagaacccagaggttaataagtgaaccaattaaacgttagggggttatttgttccaaggcccatacttagggggaataaaatgtatactttccgataggaaaggaaacacataaaaaacaacggagtgccttgacaaggcaatatggatggaaaaagaaaacagtaacagaggcactgctctttatgcaaactataacaacgactaattgtaactgatgagcgaagccacggctgaattgctcgaaaagtaattataagtaatatagcttacttgttcatcgcacatttaccaataaataaaaaacctacagcacataaggctcaatctacctgagtgaaaggttaatctcacaacattaggagaatgcgccacgtcatacaaacattattagccgtccgatactaacaatgaaactttgcaaatggtaaaaacaaagtgcttgcatcttcgtgagacctccaaactttcaggagaagcttggcaattcaccgtgagaaccccgatctgagaagcccaagaaagaaacgttcaagaggtgagggaaagaagaaaaataaagaatttttaaaaaataattaaaaatctactttaaattatctggactcaaataagtataatacattgaaaaaaatattcaacgattatgcaactgtttgttcttcatgattggtgtcttttatttctataattttatttgaactgcactcattccgagcgttaggctgtaataattggttgtaactcgttgaataaagtccaagatattatattacattatctaaaacaaattctaatgaacactctataatgttgataattttcgatggaatacaatgagaaaagggcgagtatgagattagcatttatgctagctcttaagtctagatcaataagagggtaatgcaatagagatgccaggaaaatgatggctcaagctgcagtgaacaagatggttatccatactccaattttaaagtcaagtatatatttttaacaagttattatagaatggttagagtcgagtgaatacgccacttcatgaactagctttttctcatggatgataaatcccctcgtcggtagacaaaagagtagaaactagaaaggaatagagtgactcattgtgtcattcaccacaggtccacagtgcataagaccagcaacaaagtatatcagcagacaacgacctcctgcgctgcatgttggctcgctcggcgccattaggggtgggcaatttccccgttggggcctgggatccggcggggacccgcccctacggggacgggggcgggggagaattctcttccgcgggtgagtggggacggggccccgcaaacttccgaggatgaggacggggatcggaattaacccgcgggtgactcggaggggccgccctggatgtgagttactacttctctaaaagtagctcattgcaataatgtagatctaacaaacccattcaaaattgacatatgaaagctcaacaccctagttcccctcaaccataatccctttctttcttcaaccaacccacacaattgggggctattgaaattttatcataatattatttagagtattgcaatatttttacaaagtattagctccatccgggtgatgcggggccctggtcacccaccgggtcccctgtgggggcgggaacgggtgatgtttttcacctgactttctttgcggggacggggccaggatacccgcatgagggcgggggcgggggcattccgacccaacccagccccgccccgttgccacccctaggcgccacggtggcctgccccctggcggcccatgccatcgcggtgttacatggcaggctgttgctgcaccgatgcaactgttccctcccagctcccgcagtcgcccatccccgtcgacggccgagcaagccgttcaaccctcccacccgtaaatcatatgggatcgctaggccggacctaatactataaacaagatggtgtgggcttactatattaaattgatgaattggaccatgtaatgtgtaccgcttcgcctttcttcccccaatcgcagtcactcgacacactcctgttcatcttcctcaagcagccaatgcatgtttatctatcctcggctgctgctatgagacatgcttaagtctaatgaagcctactttactcctatcataactggatggtatggttaggccgatcaatttggctactactaacaatctcatgaaatgtcgacgtataacgaggcttcaggtaacatcgcccgatgaactatggttagactcggctaaaaaaagataatgcaaataatgacatcaattttgcttaataataaagcatcatatttttaactggttgtgttcactttttttctcactatgcaatatatgatgtttacctcttatctgtatgcaagtatattggtatcttccctaattccatcttatttatttttttcctttttcttatgtgttaacttggattaatatttttgttataattaaatagataataagttgtttttcgatttttctcatatacaacaagtatggaacattgtatgattttcaaattatattatataagtgtatggaatataatgtgtaagattaaaaaacttagtataagatttgacgttttcttgaaaacgtggcaccataagtataggtagtctcataaatattggctatccatataagaggactaccataaaaataatatagtcaaaccatttctcaactaaacttgtcaacagaacttcgagagaaggtaagaaaatgaggaggttagttaccaatcccacacaagggaaaatattgctcacacgcattgtatgacatatactcccattaatcaataatttactaatattattaaatttcacaacgtttaatgaaaatttgttcttttgtgacaatgtggtgcgagactaaaacttgaacaccatattcttctgttgtttcttattctttattgttgataataatatagctggaaccagccactagcacttcacctgaatactagcagctagttcatgtctatgtgctctatattatttatggttttaaatgagttagtactaataattgtacttaatgatgatattgtatgcatagaagtagtattttagaacttgagatatattttttctaaacataatttagaatactccgaggaattataatgtagagcatattatatttaatgatacatatattcattttttatggataatttaaatattgacatttgttataaatccaatgatcgaagtatactataaatattgtataagtgactttcactatttactaattacatgttgttagtttttgtctatactagtttctttctataacagactttgacgatgggttgtgtttttagaattttttaaatgcgtttctttaaagggatggagctatattttaaagcgagtttgattgtttagaagtaaagaatacgaatgtgcgttttttttccattatggttgattttttagagaaattttccattattttagtttttcttaaaaaatggtacttactatgaaaattccttattatatttttagtatattgtctatataatattcttatgaaaaaagaaaataaaaaatcgaactatggaatcaaccgtgcatattatataatatcccattatagttacatcatcccataaaattattcaattaaggaaaagtaattagaagtattctctgcagatgcaataaaacttccatcatagcgaaattaatatcactaatactaaaattatgattttttttgaaattataaatataaattcataaatattaaaaattttattctcattaggatgttatattgcgaaaaaacattttaagaatgttaggagtgattacactgcacttatacctcataattggtattattaataagaccgataatacatatgtacccattattagcataagacaagagtaaaccatgtttgttctaataaaaactcttaatggtttgctaatattgaggatattagtataaaaaatttcagtttatggatgttttgtaaattggtttttatttatttaattaattataatatgaaatctaaactttgactgcttttaatctaaacattatcttgtgtgagaactcattataaaactaaggcagataaaacgacgtttgaattggtttatatatttttggaatttaggatgtaactaaaatggggtgttgttatctccggcccagtcttccggaagtgctcataggggtagggtgtgcgtgtgtgcgttcataagggtgagtgtgcgcacgttgtgagcgcctgtgtttgtactgtgtttctcaaaaaaaaatgtcgaagatagattttattaacataaaatttgctccacttagaattccagcactgtcaaactattgttttactcgtgttatagcccgagtataatatatactatgtcacattgcatggacatatataactgaaatgaaacgttattatctccttaaatgtccacaataaattttattaacctaaaacttgcttcacttagaattccaacactgctaaattattgttttactcttgtcatagcctaaggctaacatgtactcagccaaaatacatcgacatatataactgaaatgaaacgtttttatctcctcaaatttctaagatagattttattaacctgaagcttgctccacttagaattccagcactatgaaattattattttactcttgttatagcttgaggctaacatgtattctgtcaaattacatggacgcggactccacgagaaatatcatatcttgccgtggtcaacatcacacaaagaataagcttcaaatgtgtatgtccggtatctctattctcgcccctgttcgtttctgtgaagtaaatctggaggttaaattcccgtcaaaaaaatctggaggttaaaacacgacaagaggatatgacaaatgttaataatgcatcaaataatccaaatggcatgtagcctaaccccaagaatgtttttagaacacgatgctttacatatgtctagaacacgaatcattaaaataacgtctatccatgtcaaccatgaaacaaaacgaggcaacaatcacatgataggatccttatagccacacgccaccactaatttgcaagatcgtgatggaaaccggtgtaaatatgcagggagtggagagttcctaacggtttgacgaagtgaatcgaactatacatggtcaagttgaggaagctcaccagacagagaggtaggtggtggtggaaccatggaagaatttagtgttgggccttgttgggacgcaagtccctagatccatccgctagatcccaagcaccttacttcactagctctgtgatagtttggtatacatgtcattttggagaaataagataactagatagaagtactgctttgttcgcttggatgccttttaatctagtcttatttgctatgatatggcccaattgaaaatattttagctattgttatgggctgagacctcatgattggggaatggtgtgaaattaacgagtaagacaatgtggttttcattgttaattacttatcaacaaattcatatgaatgatctgatttttgtttgatggtcagtggtgcttgaaattaataaagatgaagattaagttgacacacgtaaaacaagaaagctattagcacatgatttattaatttttaattattacaaatttgacaaatagatatatttgatattttaaagcaacttctatataaaaagttttcgtacgaaatgcactgtttagtcgtttgaaaagcatgctaatgaaaaccggggtaaaatctaaatattaattagaaaagtgagtttatttcaaacatagcgatatatacttggttcacttatctatacatttagttcccacctttgacactttattttcattctagttttgtcactgggtggaacttggccttggcggctgacagcttcacccaaaacccactcgcctgactaacgggatgcctgccaaagccaataaaatgattaagaagaatgaataaaccaaaccagccaatggagaggagggttcatgcgaggcactcgctggaaggcctgtttggaaaaacgtgagacttaaggcttgtttggaaggcctgtaattggcccaatgctagtgtaaaacacaagaccgtaaaatcttttccgtgtaggctaaaaagcccgtttggacgggctgtaaatcataaaacattaggactaagttcaccagtagtccctcaactttacccgagtctgtctgaggtcccctaaccacgataccagaaatatgtacccctaaaccatgtaaaaccattcaaaaaaaaaaggtcccgaggtagtatagaagtctggtttcgctgacgtggcatcttactcagcaaaaaatataaaataaatatatgggggcctatatgtatgtgagagaaattggtatgggacccacatctctcctttctttttctttttctcttctcttctcttgttgattctctcgagcagtcgagcgggcgcagcgacggagggggggagaggcagccgacggtggagcgggggcagcggcggatggagagggggagagatgcggccgacacgatggtggctactgtcggtgactagaacggagggggctccaacgtcgatgaccgctgcttcgaggaggaggcgcggggagtttagatgaaggagatggggaggttggcgatcatggcggggatgccggcaagcatgagtggagagggaggcgacgaggaggttagcgagcgctcggagagggaggaggtgggcgccacgccgcacctctccctcgcg

SEQ ID NO: 59125 - DNA, 49519 bp, Oryza sativa
cactcaggtcatccttctaagcccgattctccacttccccctccctcgcccaccccgaatctctaaccctaaccagtcttgcgtgcgacttatcgtgacgtcacatgatttcctcacctcgtgcgtgtgcgcgaattaggattcccgcctttccggatgaaacataggcattgctcgaacacgtagagggctggtccagctggtgatgagctggtgacattatacaactatggaaaattacaagagtaatgtttctattcccgtctatcagtgatggagtcggaaaattttcagagcctaggcaagctaaggattgataatgagcaaagatctttcatacatgtaagattcatcatggttccttgtatcaacaaagcaccgtgtcattctgaaatttgaggaagagctagctataagtaaagcacagatgatccaaattcaatgcaaatgcaattgattaaaatcaagtatattatcacaataaactactcactaataaaaaaacaactcctatactcgtgctggttggccaattactgagtttgctagtactgctccttggcaaatcaacactttatttgggcagcaaggataaccactcgattgttgcatggagactaaatgatcataattttttttaagaaaaatgataagatggattaatatgtaatatataactctacaaacatataagttaaaattcaatttctacaagttgtaaaaaaatagcaaattatactatacctagtaaaatagcaaatttgagtatgtatattcacagtcaaatttgttattttttataagttgtacaaattaaagttgaacttatatgtttggaaagcgatatattacatattaatctatcttatattttttaaaaatattttataaccattgttgacatgaaaaatgagtgtaccttgacccgaatgtttaaaagagtttccctagcaatgattgcatgtaatttcaccagcacaggagagatgcagcactaactacatgatagattttcctggacgccgtccccttttgtttccatgctgtccgtaagtggaaccacatggaaaaatagggggacaggcgccgggctgtcgcccgtacgggaaaacacattatctgtgcgggcggctaagccaaccgcacacgaattttcacccgcacgggcccaccgcttttaaccgcgcccgcgcgcaccatctcccactccgcccgctcctccacctccctctctcccactccactcctctcctcctctcctcccactctcctctcctctcttcccctctctcttggccggccggcggcgcgacaacatgcggccggcgcgcgacccctccctctccctcgactgcgggagcaagcggcggcgggcgaccacggcggcccctcctcccctccctcccctccccttgaagatccagcagaggggaggcatgggggtggtggatccaacggtgcgcgcccctcccctccttccccttgcagatccggtggcacgcggcccctcccctccctccccttgcagatccggcagagggggcggtggatctggcgacgcgtgacccctcccctccctccccttgcaaatccggcggaggggaggcatgcatgggggcccggcggagcagcggcatgcgtcagcggtcggcgtggagatggggtgatggcgtcggcgatcggcggatctatctctccccctccttctctctttgttatcctctttgttatttgtgattctttgtggtttgtgagatgcatttttggagttcatttgttgctgtgagatgtgttcttgtgatgtgacagttcatttgttgatgtgagatgtgttcttgtgatgtgagatcattgtgtgtcgatgtgcgactacggatccggcaccggcgacgggagcgggtggcggatctatagccggcgacagcggcgggcctcggctaggcggcggcggcggattagggttaggttttttttcttttttttttgattttttgtttttctgtgttggcagcgtaagctactgcatgcgaaaatcacgattttaccagacgactgggtgtgtgcgggccaccctcccgcacgtaaaaatcgtttagcccgcacgaggtaatcggtattgtagtagtacatgccgaggagcctgggcgctgctgggccgtagatcaacctctgttgacgagggattgcgaattgggcgatggaatatgcccccaaactttttatattttaatctatactaatacatcaaaatatattaaagggtattttctctacttttgaaaaaagtttcaatcttacttctttatttattaatttcgctagaataggcttgttagtgttcagtgacaatcatgtctacgtaaaaatgagcttaatttggctcatgatgacgatatgaataagccttgagggctttaaagatttcatttgcctgcttaataaaaattaatttaatgtaccaaggtacgatttttcttccaactttcttttataaaatatacttctgatatagatagaacgtcactattaatttattcttttgtttcttagtatttttttaaacatatggcctctatttgtgtttcacacgggacctcacattcttaagtacaaccctgtgtttttagttttgaaaaagtgaaccctggcacatacatgaattgtctacgcagagagatcgacgatcaacatgatgatcacaagatatcaaataattaagtcacgagaaacaacaaccttttattcaacactgtatatttcgatcatacaagccggatagccagtctaccaccaaattaagctagcacaacgatgctatacacagctggtagtcgattagaagcgtcaagctacaggatcccaagatcaaagtaattacgagtaacatactacagtctacagtacatgcaacataaaatagtttagggtggagtaataggcgcctagtgcgtgcatacatgcttatttaattagccggccactggctaggctttgctgcatttaggggtgaaaatggataggataatatccgatccgatccgctccaaatccatccgtaacgagaatatggtatgggttttttttttttgaaatccggtggatatagatgtgtggggatattatgatgcggatgcggatgcggacgcagtatctctaaaatccagcagatgcaaattatccgatcttcctaacggattatctgataggccgtttgccggataatccgaaattatcaactcatgtaactactctatatgttgcataaaacatgagccagcccatctaacgacccaattcatcaattaacctagctagactctttagtttgagactttcatgctctcatctaacacttcgtagctacatttttatattatggacatcatatatttatgttgtttagcagttaagtatataattatttcgatggatcgtttattgactatttattgtagtcccttgcattgctaactcgatgttgtattgattgacatgtaacatctgaaaaatttaatccgtttccgaactgtctccacaacatttttaacatccgaaataatccgctccttataccatccacacccgcttgaaaatatggtttagactatggtatgaccactatctgtccgaattcgctctattttcacccctagctgcagccgagagcgaaggaagccttgccgcattctccgaggattccatccgcataatagctcctaacggtgatgggtattcctctagccgtgggagtgccgcacacgcatctggtggcgacgtttgatccggagctctgagatcagtgagcagtagcgatcgaagttgggaccaaagggcggctgaaattgtagagcataacaaaagcagtcggcgagacttgacacggttcctgcggcacactgcgtagctggagctggtgggggtggggcattggtggtctggccgctggcgaaagccaacagtagagaatcaatggcgaggaagaacactatgggccagtttggttgagtttaagattctgagaagcagctggttggtagcaagcttctaagaacccttaatttccaggttctgacttctagctcattttatgaactatacaactacaacttcttagaatttggaccaaaagatggattgtttaaggaaggttctaattctaagagaagctgcaactccttcaaagtgccctacggaaggatctgaaaggtgccactgtggagtgatgatttatagctagcttgaatgcttgatgatgcctgcaacgagttacgagtagtatagctagcttttggtggtgagagagacgtaggtgttgcatgcattttcgtttgtactttgccagaccgtgatacttcttctgaagctagtgttgccgtgcgtacgtatagattgtatatgtggagctaatccctcaggttgttgatcgcctttgaaagtatcgcactgtgcgtgaaccaagatttctacgtcgcccacgccaatagactttgtcactttgttagcttcgctagccggccgcaccctagctataaaactacaagctagctgctcaatcgtgtgggaaaaaaaaccgtagtgtagctggtgttcgagcacgtacgtatatatatgcacatagtccgcagtcaggagtaataatcgagcctaagtcaatcgcccagtatattaatcatgtaaatgcactactgcagatatcttaattgataccggttgaaaatcttataaagataccggattttctaaccggtgcgtagcaggcgacacttatgtagagggaaaataggtgttagtttaagaatgaccggtacctttgaggttccacaaataaaaaaaaatatcggtttgattcaagcgatgcatcaagtagctcccatcacccatgagatcctcatccaacaacaaaatcatgaaaaagaaatcatagaaaaaaaaaaaccatgagcttctaaacatagatctgtttcccaggaggaatatttatttaaagaatttcagacttatttgcgtttcccaggaggatatatgtgcttctaaacatagatctgtttctaattaggaaaaaaacgttcagatttcaaaattgtccactcaaagttactttcttataatttttcagaatttcggcactctgcagtgtttttttatttcttggtattttctaaatataggacccctctatttgtgtgtcgcacctggatctaaaaatttttaggtacaaacactttgttttttattttgaaacagtgaaccctggcacaaacatgaattgtctatatacaaaagatgaccggcatgactttctttttttttttttacgaatcgaccgacgccaattttatttaatagagtaggagaaaaaatttacaaagaaagcaagacctctgtacaagctaggcgataggagcctggttagtgactaaggtaaccaagaagctagattcctagctcccgctcgggtctaaaaattttggcctcctcatttatcttgtttattactcactccgttccaaaatatagcaatttttagctatgaacatatacacatagttgtccagatttataactaaaaatccttatattttgagacggaggtagtaggttggacaccggaaaaaaatataaatgacaaagtataattgagcaccagaacatcgctcttttgatggtaatggatattcctccgaccatgagagcgctgcacacgcatctggtggcgacgttgttcgggagctcggagatagccaagcatgcagccaggggtggaggtagagtatgggagggaggtggcaagaaacccggtcaagaaatttttttagctatacctcaccaattttcaccatgtgtgcaccccctaaatacaaacttagacacctgtatcagcttaaacttaaactaaagttaagtaaattaagcaatagacaccctcctccatttcattctaactctacccatgcatgtagcggtcgaagttaggtccaaagggtggctaaaaatcatagtgcataaccgatgcagacggcgaggctccgcttgatacgattccttcgttttggtaggtccagatgcaaacgtggcatcgatttctcagaatttgtcgacgtgtgcgtgccgctcgggctgaataccacggtattgcattgtgaaggcctttagtgaaggcgatggtgggggattattggtagtctggcagctggcgaaagccagcaggagatcaagaccaaatggcgaggaaaaacggcatggtggacttggagggcgccattgttgtttgctttcgatgagtgaacgcggatgacgatttctaggttgatgttaggcattgagatgtgtagtatttatagcctaggaggctaggaagcatcgaatccgtgcatgatatagcggttggtaccttgggcatgcatgatgttttgtctatacgtactttgccagaccgtaatataatatatactgcaagtctttacttcttctgaagagtacgctgtacacgtttatacagccactagtttcttttttgccacacaatcaatccgcatatttgtcaaggacttgatcaagtacgtatgtacagttgattagaaacagtgcacgtgcctaactcagccagtacatacatatagggctacaagttcgctgaaagtatgcatgcgaagctgtgaaactatccaggagtcatctcaatacttgtgctgaagatccagttcgatcttagggataattgggccaggtgaattagccgattgtgtgcacacggatgaaatgttgaagcaggaaacacgctggtgcggcccatggaacattgcacgagggagtgcaaatgttctgggccttggcccttggggtcataggacaaagtaggaagtagatcttgatcctaagtgaacatgggggatgtggccgtgtgggcttggcaccaaagattttgattttgcactcagacctccacaaattcgatccttacgcattaataatatttgtggacatcaaaatataaaacgtggtgagtgcagtatacagctacaagcacgactgcaccacaacactaaccatgcttctcagagtttgattctctaagtagcgaaaaaaatagtgctccaatttttaaaattcccatttcaagttcccattttgttttgtaaaaccttcccctgctagaagcagctacgacgaacttgggcgctagtgaagttcaagtactgaaccactagacgataggggcatcactagacgatagggccgtatacccattgataagttgtgaagagtttaaccataggtaatctcttacccatccggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggagtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcctacttcacacctcggaacgcactgttcttatagagagaaaggggctttcccatcttcttaacccgaaatgaaatggctgaggagagggaggttccttttggggtacccccgggaagagatccagtggagacggggtgggcctgtagctcagaggattagagcacacgggactcccggatcactatggccgggagaatccctctcactttaaaacactagagttttgggtactaaaaaaacgagtggtttctgggctcgcctcttcgaggggcctccgctcgtggacaaactctttccgggtcttacccaccctcgagtccaatctcgggtgggcgcttagatataccctattcactagaccggaatccaatccttggctagccttcaatggctaatgctgaaccatggaccggttgacagacaaaggtctagatagccactcgtgtatccactgtgtggttctgagcctgagactatgaaccacatcctgatcgcctatgcatacttgtgacatctctggcaacatatgatgctttgcagccggaatttagggtggtgccccaaccaatcactcggggtgtgtttagttcctgaaaaaagttagaagtttgaacaaagttgggagtttgaaaaaaaagttagaagtttatatgtgtaggaaagtttttaatgtgatatgatgtgatgaaaagttaggaataggggagaaactaaacacggcctcaatctagttggtgtggtggctcagtacaaggaagtttctgcccaagacgtggaagcgtggcttcgactcactcgtcatcctgatgatatggtgtctttggaaggagcggaacgccgaagtgttcgatgacgtcctcactttcgtgcaagctctgatttcttccatcttgcaagaacctgtctctggatgcatggaagagtggggactcatgcaactcggtttgctgttggcctctcttatttccgcggtgatcctgttcctttccctcgttggctttgtggctggagtttttttttagctctccataacctgtgctccaccctaagtaaattccaacctcttgggccactactagtgtgtttcttttttcgtttttgctcttttctaatacattgatcagcaaggcctcttacgtgtttgaataaaaaagttcaaaagggctaatctctcgatcgattgcctagcttgacaagtattgtactgtgcgtgatctaagacatttgctaccgctgtactgtgcgtgatctaagacaataacgttcacgtcaagacttttgttagctctctaaaaaatgattttagatcatgtgtagcaacaaaagaactagtgtcaaatggaggtgttggaacaagcacgtacagtcgatcaggagcaatgtatgcgcctaactcgatccggctgtagtatgtaattgatggggtcatccttttattaataaagttctttaacatcgagggcctccctgctgtatttatttaaagaaaacattgatggggcacatacatacgacgcaagtttgctgagagcattgaaacagtggagaagagtcttccctcttcagtactgtgctgatcctgtacgcagatgtaatgtatgggcgtgcgcacaaagtgtcaccggagcactaagttttgtctgggcccagggaagttggaaatacaacttgaaaaaataagcccatttaatggccaagtgaacatagctttttacaagtactacttccatttcatattatataggtcgttttgatttttttaagtttgtttaagtttatagaaaaatatagtagcatttatagcacaaatttaattttattaaatctaatattgactatatttgatagtttctttgttttatgttgaaaatattgctatatttttctataaacttaatcaaagaaaaaaattaaattagaaaaaagtcataacgacttataatataaaacagaggcagtagtatatttgaggttggaagtatttttataccagcaaagaaaattgtagcagctatctcgatttcgtttgagagctgttatcaaattttaagcttctgacctctgccattggattcaccatttccggttcccatcttcgtgcattcgccttccaatgggggaacttgtgtagctgtgtacatgaagaactggtgaagtttacatggtggaacaagtcttctcttttgtcttgggggaggggggttagcaggagttaggtaaatcattttcagaccataatataatagcactctctttattttatattataatttgtttttattttttccagtcaaacttctttaacattgtaaacgacaccaaattagtttattaaaaataatatttaatatattttgataatatgtttgttttgtgttgataatattgctatatttttctttaaacttaaatcaaacttaaataagttttgacttaaaaaaatatcaaagctcttataatataaggacgaaaggagtagctatcagtatgaagagggaaacgaggaaatattatcatacacctgtacccactatatttcgattttgtaggcatgcatgcatacacacagatcagtacaaaattaattcttccaggctagcacgtacgcataataacgcgtaatatgatcaagtcatgtgtgtgtgtgcgcgtgcacacacatatagcacagtcccagatcttataactttattattcttaaacatacatggatattaagaccctagcttatagctacctcaatgaagaacggcacgtacgcgcacgcacgctgctggcagatatatattgggtcatccaagtttaatacagcatatatgtagaggcaaacacgcaacatatatagatgctgcatgcctatatatagcatgtacatacatacgtatacttacgtatatatgcatgcacgctatctctcaacgtactgattaattaacacaagttacagcggaaaccttgccgcatgcttttaggatgttggggacattgaccttcagattgacgagggctttcaccttgatggcctcgcaaaggcagaaagcggcggtgtcgctcgggaggctggagagttgcgagcagcactgctggttcaagagctggttgccaagagcaacattaaggcacacaccaagatcagctaacggcagcgggcacttgggaggcggcgctggtgatggtgtcgggaccggagttggtgcgggcgtcggtggcaccaccagggctggtgctggggctggagtttcggtcggggttggcgccgtggctaggcatgggctatggccatgtagcactagtcccccgttgacggcagaagccaagaccaaaataactgatgcaaagaacaaggcagagttcattgcccgtttgcttgccattgttggaatatgtgtgtttgatgcttttagggtatgtgccttgtagtatttataggtatgtagcttgcaagttggtgtagcttaagtcaatagaaaacggaaagctttttgaattttggcgcactgattaacaaatacatttgtcagtctctagtttagcttaactccatacacctcattctcttctcatagtacaactcgtgccacaaactcgatctctgcacataatctcacatagattgcacacatgcgttgagtacattattcaatacattattcaacactgtatatttcgtacaagcctgatagccagctgtctagcacagcgatgctatacacagctggtagtcgattagaagcgtcaagctacaggacaccaagatcaaagtaagtacgagtaacatactacagtacatgcaacataaaatagtttagagtggagtaattaataggcgccagtgggggcatacatgcttatttacccggccgttggctaggctatgctgcatttaggccttattcggtttggaggggagtggggaaataatttcacaccataatagatgtggaataaatcccctccaatccctccctcataggaattaaccgaacaaggacttaggggtgaaaacggatcgcataatatccgatccaatccactctgaatctgtccacaatgaggatatggtatgggcttttaaaaatccgatggatatagatgcagatacggatattatggtgtggatgcggattatccaatctttctaatagattatctgataggacatttgccggataatctgaaattatctactcatgtaaccactctatatgttgcatataacatgagccatgagccatccaatgtcctaatttatcaattaacctaagctctttaatttgaggctttcatgctctcatctaacacttcgtagctacgtttttatattatggacattatatatttatgttgtttagcacttaattacataattatttcgatgggtcatttattgactattgtattgttgtcccttgcattgctaacttgatgttgtattgattgcatatacatgtaacatccgacaaatttaatctgtttccgaactgactccgtgccatttctgacatccaaaacaatcctctccgcgtaccatctgcacccgctctgaatccacttaaaaatatggtttaggctatggtatgatcactatatgtccgaatccgctttgttttcacccctagctgcagtcgacagcgaagaaaaccgtgtcatgttctccgaggattccatctacataagagctcctgactgtgatgggtattcctccgaccgtgagaacgccgcacatgcatctggcggcgatgttgttctggagctctaagatcagcgagcagcagcggtcgaagttaggaccaaagggctgctgaaattgtagagtagaacggatgcaatcggtgagacatgtcatggttcctacggcacactgcattgctaaatctggtgggggtggggcattggtggtctggtcgctggcgaaagccaacagtagaggagtagtggcaaggaagaacactatgggtctgtttggtggagcttaaaattatgagaagcaactggttggtagttagtttttgagaatttgaaaaagctggtttcccaacttatggcttctagttcattttctgaattctataattatagcttttcagaatctggacaaaaactgtactgtttgggagggcttctaattttgagaaaagttgtagcagttagaaactcctccaaacatgccctatgaaggacttggagggcgccattgtggagtgatgatttatatctagcttgaattcttgcaattcagcaaataattttgaacacccaataacaaattaactcttttattgggtgaaacaacacgtgtgttcactctaaataaatctgaagtgtcagtcctagggtggtgaaaataaatgtcctttttcactctactagaatatgattctaatactaggttagccaggtgtgaagcgagctagaggcggcctggctgccccaacatcccaataaaaacacccctcctccctatatagtgttttgcctttagaatactataggtgtgttcggctgcaccacttgaaatatggtgcggccatctttcatagtactttgtgttagcgtagcagttatatggcttcattgcagtggctacaattatacagctgaacattgcagtggctatatttttgttattctctctgtccaaaagtcttggtcctatatatttcatttcatggttttttcaaatcagatggactacaaataagtctccatatatctaaaacttaaatgaaaggattgtctttccgttttaacgtgctaaatattctgattgattgcgtggcaaaaaagcaaactagtggcgctggttttggatcaagtacgtatatatatagttgattattagaaacagtgcatgtgcctaactcacccagtacatggggtacgtacgtacatatagggctaagtatgcatgagctgtgaaactactatcaaggagtcatcaattcttgtgctaaagatcccgttcgatcttagggataattgggatcgtacgtgcacacagtcgtgcttgtagattttggcttcaattaatatattccgattgcgtgcacgcggatgaaatattgaagcaggaaacgcgctggtgcggcccacaaaacattgcacgagagggagtgcaaaactactgcaaatggtctgggccttgggtcataagacaaagtaggaagtaaatcttgatcctaagtgaacataggcgatggggccgtgtgggcttggcactaaagattttgattttgcactcagacctccacaaatacgatcattacacattaatatttgtggaaatcaaaatttaaaacgtggtgagtgcggtctacaagcacgattgtaccacaacaccagcaacgcttctcataatttgattgtctaattagcgaagaaaatagtgctccaatttttacagtttccattttgttttctaaaaccatcccctgctggaagcaactatgatgaacctgggcgccagtgaaattcaagttctatccttgcatggctagccttcaatatggctgatgctggagctggatgatggaccgcttggcagacgtttagatagccactcctgtatccgttgtgtagttctaagcccgagactacgaacctcatcttgatcgcctacggatactcgtggcatctctggcaacagatgcttcttgatgccaacatttaggttggtgccaatcttgttagctagagtggtggcttactacaaggaagcttctgtccaaggcgtggaagcgtggcttcgactcactcgtcatcctcatgatatggcgtctttggaaggagcggaacgctcgagtgttcgatgacgtcctcactttcgagcaagctctgatttcttccatcctgcaagaacccgtctctggatgcatggaagagcggggactcggcagctcggtttgttgttggcctctctgattttgtggtgatcatgtttctttccctcgttggctttgtggttggagtttttttttcgttaagtagctctccataacctgtgctagctccaccctatgtaaattccaaacctcttgggctccactgcctagtccgactgatcggtctgtatatttcctttgactctttatctgcataccatctgactccgcgctgctctgcaatacaagcaacgttcaaatagggtctaactctacttgtatctgattgctctttacaagatactgctacctgttcgctgatctaagcacatcctgctcactgctgtactgtgcgtgcatctaacacatttgcgttcacgtcaagacttgtttagctctctaaaaagatgattttagattgtgtttagcaacaaaataactagtgtccgatgaaggtgttggaacaagcacatatagtcgatcaggagcaatgtgcgcctaactcgatctggctgtagtacgtacatacattgatggggagcgcacgaagcgtcaccggagcatgaaggggttgtttagattgatgtcatttcaaatcatactattttttttataaaattgttaaatatatgcatctatttagttttctaccaaactctagtaaatacataagtaatcctaccaaaacttggtaatattgttaaattgctaaaatttggtaaagtttattttggctacaatctaaatagtccggaagttttgtccgggcccagggaagttggaaacacaacttgaaaaagttaagcccatttaatggcccacttgaacatacctttttataagtatttcttccgtttcatatcacataagtcgttttgacttttttaagttaatttatctgaaagtttgattttatataaaaatatagtagcatttatagcacaaatttaattttattaaatctaatattggatatattttgatagattctttgttttatgttaaaaatattgctatatgtttctataaacttgatcaaagaaaaaaattaacttaaaaaaagttaaaacgatttataatataaaactaaggtagtattatatttgaggttggaagtattttgtactagcaaagaaaattgtaacagttaggtgccggaaattcccgatcgaccgggtgtcgtttccatttaaggggtaccgtttccgaccgtacctttttggctatttttaaattttgttttttttttcgaatttctttctgtatcatattaatgtcgatactgagtagtttaaatgataaatatggtcaattaacagccgatcgagaatcgttttcgaagagatgctacagattccgaccgtttcagatcgttttcacccttagtaacagttatctcgatttcgtttgcgaaatgctatcaaattttaagcttatgatatctgccattagattcactatttccagttcccatcttcatgcatacgccttccaatgggggaacttgtgcagctgtgtacatgaagaactagtgaagtttacatggtgcaacgagtcttctcttttgtcttggggaggggggtttcccgcaggagtcaggtaaatcattttcagaccatagtataatagcactctttatttatatattaagttgttttgatttttttagtcagacttatttaacattgtggacgacaacaaattagttttattaatattaacatttaatatattttgataatatatttgttttgtgttgataatattgctatatttttctttaaacttgatcaaacttaaattataaaataagaaggaaagagtagctatcagtatggagagggaaatgaggaaatattatcacatacacttgtacccactatattttgattttgtaggcaggcatgcatacacacagatcagtacacaatcaaatcttctagcacgtacacataatgatatgatcaagccacgtgtgtgtacacatacatatatagcacaatcccagatcctgtaacttaattattcttaaacatatatggatattaagaccctacctccatgaagcacggcacgtacgcgcacgcatgctgctggcggatatatatttgggtcgtccaaaagtttaatacagtatatatgtagaggcaagcacacagcatatatatatatatatatatatatatatatgctgcacacctatgtatagcatgtacatacatacgtacgtacgtatatatatgcacgctatctctcgacgtacttattaaacacaaactacagcggagaccttcccgcatactttaaggatgtcggggattttgaccttcagattgacgagagcattaaccttgatggcttcgcaaaggcagacagcagcggtgtcgctcgggaggctggagagctgcgagcagcacgcctggttcaagagcgggttgccaagaccgacactaatgcacgcgttgagattaattaacgccagcggacacttgggaggcggcgtcggagatggcggattgacaggggcaacggtgggtgaaggtgttggtgccggcgatggcgtcgggactggagttggtgcgggcgtcggtgtcaccaccggggctggtgctggggctggagttccagtcggggttggtgccggtgcttggcatgggtttactttgcccattccagcagaagccaagaccacaacaaccaatgcagagaacaaggcagagttcattgcctgtttgcttgccattgttgcctatgtgtgtgtgtgtttgatgctcttagggtatgtagccttgtagtatttataggcatgtagcttgcaagttgctgcagcttaagtcaataaaaaacggaaagctttttgaatttcggtgcactgatttacagatacattgtccgtttttagtttagcttaactccacacacttcattctcttcccgtagtacaactcatgcatgccccaaacttgatctctgcacaaaacctcacatagattgcacacatgcatcgagtacattcggcaaataattttgaacatccaagaattctttttttgggtgaaacaacatgtgtgttcactctaaataaatgtgaagtgtcaatcctagggtggtgaaaataaacacccttttcactttcgtagaatgcaatactagtactagggttagccaggagtgaaaagagctggaggtggcctggccgcccccaacatcccaataaaaaaaaccccctccctttatagtcttttgcctttagaatactatatttttttgttattccctccatccaaaagtcttggttctattttattttctgggttttccaaatgagatgagcttatttgtagtctccatatatctaagacttaactgaaagtgttgtcttttttttaacatgctaaattaaattgttgactggaacccaagcaggggcggatccaagaacaaaaaaattggagggggggctcaattacacagtttcttcaacctccagccatctaggagcctttagtttattattcatggtgaaaaaattgaagggggtgctccgggggtatccatgggtcttgtgggtgtagaggggactcgagtcccccctgcacccacgttggatccgcccctgaacccaagcaaccatcttaatattcattggttgcatgtatgcatattgtttcttagttttgttacatgagggatgagggatgagtcaattctttttggtcttgatgataaaagaaatatgacttagaatttagggttagaaaggggtgtatagtagttattctaaagtcacgtcgaattggatatgggtgacatagaaccaattcaaacacggataacgtaccaaaattttaacgaaaacattttcaatttttataataatagagatagagattaagtacgaagggagatgaccatgtgaatagctaaggagtgagagagtggttgagagcgagatttggtgaaaattgaattgaggggtggtggttgggtggggagagtagttcttagtattccgagtaattgtatcttatgacaactgaagacaaatggagtaaatagtaatccatattgtcaaaatattttgcaattattcatattggttacaacaaactaggatatagacattgagtgcttaaaatgcttcccgccttgttccagtccttcacatttattttctttaagaaaaaaaaactagagtttacttcaaacaaacattgcatggggttgaagatagaccatgtgttatgtacaaaacagtaagagaaacacagagggactgcctaacaagtatacacacatgtattcaacaaatggaacgttctctcagagacattgtaggatgatcccaagacttttggctcaaaatccaatcaatgttgcgtgcggttgggggttggagcagtcggtacgtcatgacaaacactattgatcatatacattgctccctctcttgttcccctccattgagaaaaaaaatgaaaaaaccacctagaaattactttaagtttaacattccacgccataagtcattttgttgcaaatgctcacccctatactcggttttgttgaaaatccaccctagtgcacacatgcttgaccgaatcaatatattttcataaattgtgaaccgtcaatgtggtcttcacataatttaatacttctagaagaatagtcttaacaatttctttttgagattctacatatagaattgctaatgaaagcttaaaaattgctgcacctagttttgctatatgcagaaaaaaatataaagaataagtttaatgcaaatactaggacaagattgactcaattagcttaacctgtggtggctctacatcagtgataacaagctgatttggttaagcatatgtgcactaggatggtttttacaacaaaaccaagtatagggtggatatttgcatcaaaatgacttatgagatttaagtaaaaaaatgtcttatatatgagatggaatatcaaacttcaagtgacttttgatatgttcttttttaaattttcccttaatggagcgatcgaggttggcagcgaacgcacacaaggacctgaagaaaggttaacaccgcgcgtcacctcacctccgtcgttgatgcatgtacaaaacctctcacggtcaagagcgaagtacatgagaataccgggttacaccacagagaattggagtttcctcacttcttccttttctttttttaaaaaatcattatattaaacattaaaagtacagtacatggataaaagatacatcttcagccattaaagttgattaaagaacttccatagtaggataaccattatgatgatataagtaagaaaaattttgacaaactgttttagtagaactattaatatttgtccctagattttttttaaaaggtagtcagccatcttattcatttatcttgaaatctatcgaatattgtagctccacctaaaattgatttactcttgatagaagaggaaacaagctccagggataactggataaggtttagttatataattctgctatcttagaagtagtacgtaccaggtcctgattgatttgaaatgataagttccttacatatgcaaattgtcagattgatatacctgcaagtttagcttgaatacaagaggtataagaaaagattttgcttgaataaagatagccttgagagttatggagtcatgaatgaaaatgccaaagcctgattgatcttccatccgggaggcatcaacatatatagcatctattttcaggcaaaacattaatagagatattaggattatcttccagagttcccatatagtcatcccttgcttcaaagctcaacattttagtgaaattattagacatgacatctgctgcattacatataatatacttacataggttcccattcttaatttccttttaaagtaatatcattcctaactttccaaataaacccagagcattatagcatgattttacgtagtattatcagatttaacagttgctagtaagcaagctagaatgtctgaaatactttgcatgttatctactatgagagttgatattgtcctctcttctgttgatgaggctttggctagcatcagggtttccaaaaccgtcggggccagggttaccgcaccccggcggtaagcacggttaccgcgcggtaaccgcggtaaccgtgaaaaactgtataaaaccgtacaaaatttatcaaaaatttaaattattttttaaatttatttgaatttaaggaggttaccgcggtacttatattaccgtaccccgcggtaagcccggtaaccacggtaaccgtacggttacctacggttaccgacggtaagtcaaaccctggctagcatccactcaaggactactaaagtatatgaaattaactaggagaagattttgattggttgagaagtaaatctaggtgaaaatattattatagtttagaaaaaaaatttaaatgctagaagttattttattttagaatggatagagtactctacgtccggaagcaacaggcttgaaattgaataccccgggattagattaattccccctgccgtgaccactagccgcacgtgtccctggcaacgaaaatgctagtcctcacagttttcttgttttagaagctactgatataaaaatgttttgtaggtaaaaatttatatttgtgtttacaaattaaggctgaaaaattgtgtttccaaattaaggctgaaaaatatattatgataaaaaaatccaaaatcaatcataaaattaaattttgagtaaaatttaaaatatccacctttatcaagttaaagttataaagttataaaaaaacactactgggcaaagccccggtagttctttcagtcaaaaaaattatagaaaatcgtatgtatctgtggcacataaccacatgagattttataagtgttttataaaaccctacctttattcaaatctcgattaatttcagcatatcctaaacaataattttttcaaagtagtgaagttaaaatatcaacttaagaactcaataattataaaaaaaagagatcataattcatagacactatatttttaaatgtaagtatacacaatatatatcgaagggttttgtaatactttataaccacaatgccctaatgttatgtgccacaaatcaaaataactagggctttataccacgtaatttaactataaatatagggttctatgaaatttactgttaggttttagctgcaattgagccaaaaaagacaatattatagaaacgattttttcggacaaggcccctctaagttgtatatgggccataactgtcgtgcctacaaaattcgctcccctgaaaagcgaataatgggtcgcccgcatgcgaaaatactaatttttgcacatacctaggtgcatgcggacgtccaaccacatgctaagataggttttgaccgcttgcaaaaatcttttctgtagtagtgagaaatcactgctcgtacgtatggggacgctgccagatcgagaaaccatgtacaagatcacctataaatccaaaatttcaaaccgatgatacaaaccatgtttggatcatatacagcgtataacctagtgttcagtcttaggccccgtttggtagggctccaaactccaactcccaactctcaactccaactccagagagagctagctcctataggagctgaagtgggtatgaaagtgtttggctagattagttagctccgcgcaaatacgttccttgttggcatttcgtcgaacacctggttggcgtcgccttgctactgccgccgccgctcaacccgtgcgccgtcaccgccacccgcctccgtccccgccgccagcggtcagcccacgggtcgccatcgcagccgtcgtcacacgtgcgtcgcccggccactgcccgcacgcctaccgacgccgacgtcaacgcagccgacgccgacgtcgacgcaaccgacgcccgtgcgcctgcagccgccgccgttgcccgcgcgcagccgccgtccgcgtgcctgccgtaattgttcgcgcctacaaaattcgctcccctggaaagcgaataatgggtcgcccgcatgcgaaaatactaattttcgcacatatctaggtgcaggcagacgtctaaccacacgttaagattggttttgaccgcctgcaaaaaaattttctgtagtagtgagaaatcactgctcgtacgtatggagacgctgccagatcaaggaactctgtataagatcaactataaatccaaaattccaaaccaacgatgcaaaccatgtttggatcatatacagcatataacctagtgttcagtctggtggacatttacacaacaaagtactaggcaaccatgtttggatcatatacagcgtataacctagtgttcagtctggtggacatttacacaacaaagtactcctagctagcatatataggacacgcatagtctagtggacatttacacaccaaagtactactgtatatgcccatgtggagaagatcttccgtgttgatggagtgtaccagtgatggagtacccaggcacccagatccatgataacatgcatgtgcctaactcagctagtacatgcgtggggtttatgcgtatatgcatgcgcagcaattttctagcctgatttttcttatagtaattaataagaaattcggtaccattagtagtcggttttgcacgttaaaggcgatatacccatatagggactttctacgtacgtacactttctacgtccacgtgtgggtattattaaccggtagtcaaaaaaattctactcctattagtttgagatggttcgtcgttaggagcttctactattaagaagctgaacataataaaaaaaatttcctcacttgatcttttttgtcattatacagaaatatgagtatataccccggtctggcctaactagcccgacggtggggtagaggtgcgatcacactggactcccaccaatatgtctgagagtaagggatgtttggttggttgtgtttctttgccaagctacaatttagtcatgtcacaacttcctaggcatgtgtttgtttcgccgtcacaactatatcatgccacactttcttaacctttggccgacttttttttaagataatagaagctttattaagactcaatcaattacaccaagatggtacaatccaactgagccaacccccggcctttgtataaaatgcacacatctaaaaaggaaccataaaagaaaaaacctcatctcaagcacaggagtgtgaaggaaacataaaattagtggttatcaatccatagactagaccaccacccatgcacctagataaaaaaattactgcgccacctggtccaaacatcatgataccactgcaatagtatcccggtttgtggagtatattccaggtgtgtagccaccgagtaactaaagtaataacctgcaaaggagaagacaccattttgttatcaaacaacaactcattcctgcttagccaaatggaccaacaaagagctactgcgcccatcaaaagatgatttcttatgtctttaggaacacgtaaaagccaaagcccaaacatataagttacatttcgaggagattttaaatttgaagccattcgaataatagaccacaccaagcaggaaagatgacattggaagaagaaatgttggatggttttgtctttatgacaaaagcaacactttcttactaccttgcccgacatgtcatactcttaaacttgtgctaactatgccacacttttgaccaactatttattggccacattttttccactatgccacaacttggctaagcttagttataacaatgtaggcatagggatggtaacgaggctacacctgtcgggttcaattatcctattcccatccctattaagaaggaaatcaatctaccccatccccgcactcggggaagggtttcccctatcactgtccccgcatagggttcgaggcacacccaccgaatagtaggagtgcagcaggccagtatgcggcagccatggcgcactcctgccgctgctgcttggacgcgtcatagcatcaggtcttgcttggaggcaacaatgacaacatgatgcgtatgaaaccaatgtggatgcattagccatggcacgacgcgaatgctcagcatggatgtggcggtgcaaatgtttagcatggagaggacgcgatgaggaggcgtggatccagtggcacggtgcaaaggacgagacgaggacacgggttggtcgcctggagtcttggcaggcttgatctagagcactcaagaggaggggataatatgcctagggtttccttactttctatacgagggacttgtgaattgggcctctcctaagtggacttataatttttatatggattgtgcgctcaagcaatatgcacatatgcctaccatactcaggggctcatgggaaattagggacggggggctagggaacgtcctcgttcccacttccccaatgcagacatattttgcccgacaacaacccccatgggtgatgattttatcccatttacatgccctatagagtaatccccaccggggttcaggacccctaccatccctagtcaggcatcaaccaaacattccctcaatagtacacaacgctacgatataggcatctagataggatctttattttaagaggcatccttaatttccataaaacattattactctctatataaccattgttgatcaaggctaaatatatagaatggaccaaaaattaattaaccactgtgatgaagattccatctaaacatacttttattatcatttagattaatctgcacaatataagcaaccaagttatgccatagcacaaggttttgacccacaaatgcccttcaagatacattgtgtgtaacagaattcaaaacaattgcaattgatgcactttttctacgaactaacttatatagaaaagggtattgctccttgaaagaagaattatcaatccacttatcttcccagaatttgatttgttaaatccaaccccccctacaaatcactaatcattccaatctcctaccctcaacttaataaaatcatcgattgtatactataaaaaagtatgtattaaatctcatgcccaataagagaagacatagggaacaacttcgctcaccatgctagcgatgcacgatgggataaatcactagtacagatccttctatctgtgacgggctctaatatgcttagaaatagcgggccgtcacaaggaagtcatctcaatcgggccgaaaagtgcccgattgagatatggtcgcacagacatgttagatgggtataaaacttaagcccgtcacggatgacacctatcagtgacgtgcaccaacttgaggcccgtttgagataacaactaggcccgtcacagatgactcatcagtgacgggctatatacttaatctctatcgagcattaagagatatgtgttatatattattcacaaattttacatatatgtgttatagtttataaaaccagataagagatatgtcaattttgtaaacaatgttactatcactttgtcgtatgaagaaatgaccaaaataaaagttttagatcttgatgagttattcaactttgttgtggatgactttttcaattgatatcatttagtatttgaaaatgttgtttgaagttgtcatattttcaaattcaaattcaaacggttcaaaaaatgttatatagaaaaatgaccaaaataaaagttatatattttgatgagttatacaactttgttgttgatgactttttcagttgaagtcgttcactgatctaaaattctatttgaacttttcaaactttgaatttcaaatttcaaattgtttaaatagagtcagatggagaaattaccaaaataaaaattttgcacctcgatgagttctacaactttggttttggtgacttttccatttgaaatcatttaataaccccaatttgacatcctggcctagggcataataggattaatagaatactcataccaacatgttacaattacttttccggaagccaatctctaaagaactttgacgttaagtgtgcttggtctggagtaatttcgagatgggtgaccgacctttctcatctgtgacgggctataattaatgcccgtcacagtcacagatgactcatctgtgacgggctatagttaatgcccgtcacagataagggtcatttggcgctagttgtggcccgattgagatagctcttcacatcagtgacttctagcctgtgacggacgccatgcccgattgagatggggcttaccgctcgattgagatgagggtatccgttctagtgaatcactgagcacataaaagctagatagaggtggcacgttgtaagagaaaatggacctttgaggagtattttgtacgaaattaagctataggcgggagattggaaaggacggtgacttgtaggggattatttgggttttccaaatattaataatgaaagtgcacatacttaagaacttgtcttttcataagtcccgacaaaaaatgagaatcaccagacattttcacaacttgtataattgactaattatttacatatttccttctaagtaaactctgccaaagagcatcctcatttatcaacatgaaaagcttgactacaattgttatggtggagcttgagggctgcattggacaaattctagggtagcgaggcgagggagctcaaggatggcggtctgggattgggtgcacgtacgtgagagatcgagagccgtggccagcgcacaaactcgatggcggcagctgggggtgagagcttgagagtcgcgaccttggggagttcaatgcatgcagtggcttggcacaagggcacggtggtggccaacacaactgtggcaactgcggggggatcgaacttgaggttggcggcaatgggtgacctcatgccatgaggagtttgagggtggcagccttttgcaatctcgcagctgctaaaattgaactcaagaagaaagggggatcgatggagctggccggctgccctgtccatgcctgaactcgattgcctaagatggagatgaacaagctagtggaaaatggaggtaacattacaggtatttaacttctttttttttttgcggggaggtatttaacttcttacttttgaaggaaatgaaaatgaaggacacttcatagaaattcggacggaatgctatatggaggaacgttaaacttaggtgatttttggtgatattaaaatggtttagatctttcaaatgttatatatgtaattaagcttataacttccggcgctacataactaattttgccctataactaacctacagttgacctgacccagtaatgatcagtacaccaaaaagaatctacaaatccagtcatctgttgctttttcatgaaatggtggatgccatcagaaaacattcatccatctatataagcttattatatatagtaattcatcagtagtaatttctgttccggtaatggtttgtgcgtccacaattagtagcataacgggaaaagaaattacaaatagtactgggtcaccttgctagttaatcggctatatattacaaattaaattaattagtaaattgtacatcccttaattagcttgagcgtccattacgtacatcggttaagttaatacgtaccacattaattaattaccgacacattgagcatttgatttgagcagctatagtagctagctagcacctcagcgatgcatgcatggaaccatatggatcatcactattcggagcttggaggtgcaggagggaagctagctgccgcaccgccatggcctgcaaaaccttgctgcccttcctcgctgaagctgccggcggcgccctggtccacatccggcgctgctccttgctgccacgccgggtcccacgccggaacatgccacgccggcatcatcggcgccggctgccccatcggcgggtagtagtacggcagccccgcggcggggccggccgctccaacggcgccggcgggccctcccgccgcgaacccgagcgcgctgccgggctcctccttggcctcctcccgcggcacgatgtcgacgaggaagtcgaacacgtcggtgcgcgcgatggcggcggcgacgtcgttgcgctgcagggtgcggcgcttgttctcctcggcgtgcagccacgagcggatggtgagctccaggatgaagagctcgcacgccttggcgaacagcacgggcgcctccgccgagatcatgcgcacgtcctcgtccgccttcatgatcttcttgatccgcgccagcggcagctggtggttcttgaagtccgacgccgacgcgcgctccgcctcctgccgctggtacgcccagaacgcctgcagctgcgcctgctgctgctggagcaggtggtggtgcggcaccgccggcggcccgcccgcgccaggcacgcccggcaccggggctccggcgcctgcggccgccggctgaccggcgtagggtagctgctggttgtccattgtcacctatatatacgtaccttaattacagtcgatttgtagctgtgtgtgctgtgtctgcatgggcaaaattacggcgattaatttacgtgctaggaacgaatgatcgctacatgctccacgtatgtaacaatggctagctatacatgcaaagtgtaaacgacgcttgtaggtattgtctgtgagagatcgaaggattgataagcatttctcaatatgtgtgcaaactgcaaaagtaagtagagattaggagacgtactctagagcttcgttgctccacatgtgcgacggatcaaacagatgagaactcgaggctggctataggtggcgaagtgcatgtgtgggggctacttatcttctatccagagatcatatcatgcatgaaaatgaagctaagcgcttgcaaacacacagggtgttcccaaaggagatctggaaggagagaaacaggagaatcttcgatcacaatgagacctcagtgcctggtctcctcgcagaaatgaaggaagaggcaaggatctgggccttggcaggagcaaagctactcctacagctcgtacactaaactgcttttcctttttctcctttacccttcggggttgtatttcttactgctatatattcacaatctcgtgtttggttccattcaaaaagttagttatctggtatatgataccagtaggatttgacgtggtccgacatttcttaatttcatatactactagatgtttcttatttttcagagatccataattttcctaaaccattacagatctcaccgaaacaaaagaggatcgaggccggatgacttcagaataagtcgatcatagcattatgatggctaaggattgtcctttcgttcaggaaaagtacaaaatcaaggaaaatgcagatagaacatagaacagtgatgactgataagtgaagagaactagctacttcgatgatcaacttacaaaaagctctagggagccagtcaacaagctgttttcgtttatgtagaagagggggaaaaagaactctggtttgcttttctagttcaagaaagaaagtgaaggaagaatagagaagaatgatgcagaagttgaagacactgcaaatgtaacagaattgacaaaaaaaaagctggaacaaatctaactatccattagaaaaaatgcaacaatagattcacgcatccatgcatgtcgatctcaactagttaattaagttcttaccagaaagcaaaacaggctagcctgtttgagtgaacgagctctactgcttcagatatccaaaagtatcagggtaaattaaagaacagcacagcaaaagtatcagatgcttcggcacgcatggggatcgatcgtcaggggaagcaggagtgcaggacacactcctcaccgtcctacccactgcctagtgcctgaacaaaatggccatctccactctcaactggggttcttgccttcttgctgcaattaagctgaaaaaaataaaatccatgaagtggacggagaccttggatatctgaagcatgcacgtcgttctcaggctctcggctgcttggaagctagctagaaacaattttttacagtgttcgctaatactttccactcctgcagtactgtcagcataatacccagtaaaatcgatgttactctgaaagttttagccaaaaagaacagtctgaaaagggataaacacgttgtctgcaccgtgacactgtccgtgaaaaccgatcaacgggggttgttgttgtgttgtgatttgttgttttttttggcttgtacctgaggataagaaaagatgaaggggagatccgggagagcgcgcattcgtggccaggcttggtcttttcggatatggatattatccgttctggaagtctggcagcctcacaaaattctacgcttagatttggggacgactgccccctgctactgctggatgcggccgatccatcgccgaaatctaaatctgcagcatggccgactgcacgttatgatttctggcgtgtggggttcacgtatccaaccactgctgatgaacactgaacagtgccacacgaggaaatatcttagcatggatgcatgaccaaacagatcagagatttaaatagtactactgccactacaccagaagcttgatgaagcagacactcagacagtcagacttcacagtcatactgttgtgagagatttttttcgcatgtgaaatttcgagtgtttctctaggtagtacgtagtacggagtagtaaaactccatgattgcaaagctgctgtaaataacctgtgttacagcttttcataagttttttctgcctacaataattacagtttctttggatcagcaaagagatctcatagttgatcacaccgtggtcagcttaaaatatgtagcatatgttcccagctcccacaaaaaggaaaatttctagtagcatgtttctgggccatgtttctggaaaagtacaatgaacaaagtcagaagtataacacaaccatgggcttaagtttggacctttttttgaactttaagttttgggccttaggcccaagtgaaaatgtaaattagcctgtactggaacctaaaacccaaaggaaaaagtacactgaaggaccctcaacttgtcattgagttacaaaatcatcccccaaccacaaaaccagatatattacatccctcagcttaacaaaaccgtttactttagatccttcggtggttttgaccccagttttatccgacgtagccgctgagtcagcgggagacccacgtggccccacatgtcaggatgccaactcatcacctctctgttatttcccctcctccccctttctctttctctctctccctccttctgctccccagcgtcgagcaccttgttgcaccgcacgaacaccggcgggatcaccagctccagctctgcatccttcgtcttcacgacgctcctctcacctgtcagctcgtggatctcctcgtcggtggtgaagagtcggtacaccgccgctagcctcgacatggcgctcatccacagcccgggcttgccgctgcccggccacagcgcccgccagttgtcgccgcggtactctagcctcccgtcctcgttgtcgactggctcccccgtccggatgtgcctcgcaaccacgcactccgcggcgacttggtgcggagccgacgaggaatggggtcgacctacagccagagcgccgccttcctccacaactcccgcagcgagagcacacgaagaggaaggaggcggggaggcaggcagcagctcgttcctcgtcgtcgtcgtcgttcggcggcgacgccggccgccggacctcctccccccccccggcggcgcgcggtggaggaagccgctgccggcgacttcgcctgtaacaccgccgccgccaccgccagctcccgtcgatctcatcctccacgccgtgctcaaacggcggaggatggggcacagtcgtgggcggcgcgcggcgggtgctgacgctcttgggttgccctggctattgctcccagacgaagggcaccatgccggggtggcggacggggccagagttgaggtcggccttctagtagtggcgcaccgaccggagtggtgtgcccaggtcctcagcctccgcctcgtcctcccgcgcctgccctcccacgtacgccggcacgccgccgtggcacgcccgtactgccgccgccacaggtttcagctcctagcgcagacgaagacaggcggtggtggggaagccgcggcttgcgccggccgcccgcgcgccgctccgttgcctgccgcccacgcgcggctcctccccccaccgcctacgcccgtgcagctgctccctcgtgcggcacccgtgaagaagagaggagagaggaagagagatggagaggggaggggaagaagaggctgacgcgtggggcccacgctgagtcagttgccgtatcggacaaaaccggagtcaaaaccaccgagggacgtagattgcactggttttataagttgggaaacgccggatatctggttttgtggttgggggatgattttgtaactcgatgacaaagttgagagaccttcggtgtactttttccaaacccaaacttacgcccaggattgtgatgtacttcagactttgtccattctactttagcccaaaaggttgtccctcccatttgacgggctatgtactttctacgtgtcccggcctgttttgagtttgtgatcgacctgacccgtttagtgacatgctatccacaactctgataccactcggccccacatgtcggtgacgctgctacctcccgcgaaacccagacgcttcacgttcggatccgaaagcttcgcagcccggggcaatcacgaactgccaccgcaccgtcactgacatcctggccccaccccgtcaggtgggggcccacagcccgcccccccaccggtgccccgccgcgccacgtccccgcataatagcacatggtcgacaaccccccgcctgtctccccgttcagcgagccagagaggaaacgaaccgatcgatcaggccgtcgctccgctcgccgccgcgcgacgcgacgcgacgcgacacgccggagacggacgacgagcgctttgccttccccgcgcgcgcgcgcgcgcgcacggaggcggacgctggtcggtttggtcgggtgcgaccgggaacggcggccatggcgcgcggcgggggcggcgggtgctgcccgccgatggatctgatgcggtcggaggcgatgcagctggtgcaggtcatcatccccacggagtcggcgcacctcaccgtctcctacctcggcgaactcggcctcctccagttgaaagacgtaagtccgtatatccgctacccccgtcgattcggcggctgttcgtggctgacaaattcgccgagagagggagggggattcggagtggtgcctgtcccgatcgtgtcgatctgaggcgggggatcggttggtagtgccccgtgctcgcgatttcctgggaattagcgggcgtttcccgtcggcattgtgaatttgggcattgagattgatgtggtgttacggcgtctacttgttcgcttcactttttttcgttgaaaaccgtgatattgtttgcttcactttttttcgttgaaaaccatgatatgcaggttttgcattggcgcgattgggtgacaatgttgtttggaacagaattcacgtagggatacattattctaatttcgatgcagtacagagttgtcttctctgtaatgcgcccacactagcaatagcaagtttaaagttacttttactctgttagactgttagtataaaattgtactcctgtattagtagatcatgggaaatgctgatatagtttgaccctcgcaattctggaacaactcaggatgctgcctttgttttttgtcctatcccttagaggttaaactgatgattttatttttttttcctcagcttaacgcagacaagagtccttttcaacgaacatatgctgcccaggtactttgctcgtttatcttttttttatcacttatgttatgttatggctgagactaattgataaaaagctttttacagcatgttgaaactgttattctccccttgttcttatatagccctttcagtaatgaactagagtattatctattgagatttaaaaattataagatgtgacattggtataaatgaggaaaaagtccaaatatccccccctaaactttgaatgaaagtccatctagtacactaaactttaaaaccggacatctaaccccctgaactttgtaaaactgttcatatttctatctaaagtttaggatggtatttggactttttaaagtttagggtgctatatggatttctatctatatagtatatctcatgttcatagttttcattaccttactgccttatgttaattttccctgttttcatgctgggatctactcgttgtgcagataaaaaggtgtggtgaaatggctcgcaaattaagatttttcaaagaacaaatgtccaaagctggcatatcaacttctgcacaattaactgaaatttcgttggactttgatgatttggaggtgtgtcaatcgaatggatttttcctgattgcatgcagaatataaatctagtattattttaacacttttgaataacagataaagcttggagaactggaagctgaactagcttgagttaatgcaaacaatgaaaagttaaagcggacctacaatgagctgttggagtacagtactgttcttcaaaaggtatgactctgttatcttcagtatactttcatgaatattgtcaacatcatgttgaacttgagatatagcgtgtctgttagatcttttgcaaaccacttgtttccattcctggttcctcacattgttgccagaacaatactatatgaaattgccactatcttaactccaaatgatttcacccatggggtaatgtgcacatatttttacagtacactctctctcaagtcatggtcgtactacacatgtagtacctaagtagcctgtttctctcgccaatctgctttttgctgactctttatttattattattttctttcattttcaggctggtgaatttttctattcggctcaaagaagtgctgcggcgcaacagagagaaatggaggcaaatcaatctggtgagagttcactggagagccctctgctggagcaggtaaaactatcatactgctcctccctgtacatggacattcatgtagtaccattgccatgatgtgcctcaagattgatgttgactttcaaattttaaacacacaacatcccatattgtagtaataactttaatcattcacaaatctcagagcactttggatttacaggatagtacatggaccatacatgcatatacgtgtgtaattgcaacccccaccttttttttttgttttctgtttgcctctctgatatgatcttggttacccttttaggatacgttaacagatgcatcaaaacaagtgaagcttggatcattgagtggtcttgtaccaaaggaaaaggcaatggcttttgaacgcatcttattccgtgccacgaggggaaacattttcctcagacaagagtctgttgatgaacctgtcactgacccagtctctggagaaaaggttgctgttatattttctgacgtttacagtgcattttttgttctttgtatattccaccatgttgtcctttcaaagtaatcttggtatttggattatacatctcggttcatttgcgccctgataaaaagaactttgttctatgagtgatgaagttattttttatatatcttacttcctgtctagtcatgaagttattttattatttgttccaactctaagtcttcattctttgtatgataacacaggttgccaaaaatgcatttgttattttctactctggggatagagcaaaagccaaaattctgaagatatgtgatgcgttcaacgcaaatcgctacccatttccagaagatgttgctagacaattacatgctgttcaggaggtcaggtcttggaaatgtgatttgttaatattctttgatgaaattctttctagtatttcgaaatttagatatagtcctgaattgctttcagaaggtagtgaggatgccaaccgttgagagaatcatctgcacgagttgccctttatggacattcttgtgctttgcttgtgatatgtccaatgttaccatccctattctgatgtcactgctgtcatttcaatttcgaatttgaaaaatgttaattaattattatagatttataatagctagactttgttctgtgccttccaatcattacttttgctgttggtgactaatgaaaatgatttgctgctattgcatcttgtttgcaccataaggagatatgtcattgggagaaacttgttttgcagttgtactactatgaatttcagtcaataaacatataaagtctatgcttatgaatttacaggtatctgcaaagatatcagagttaaaggcaacaattgacatgggattagcacatcgtgacaatatattgaaaaatatcgcgtctgagtttgagaattggaaccgtctggtaagctatcctcttatgtgataaattccatatgttagaaaattccgaaatccaccagtcaggtcattatttcagttctatatatatgatactaattagcatacaaatgctccaggcaaataaggaaaaaataatttaccacactttgaacatgttgagtgttgatgtgacaaagaaatgcttagttggtgagggctggagtccagtttttgcaacaactcaggtaattgatacaccaccctggtgctaacaatttattagcctactgtttccatttgtttatttgggagattattcttcatgtgatctcaatgatttacaactttattttgcagatccaagatgcgctccagcgagctactcttgatagcaaatcccaagttggttcaatttttcaagttctcaacacaacagaatctcccccgacatatttccagacaaataagttcacttcggctttccaggaaattgttgatgcatacgggtatgtttcagagggctctgagatgctacttttggtttctcttttggctttggaactgaaaataatatattttcttgtgggttgttccaagttgtttatagcaccatgggatatgagacttctattattgtccccccgcttttggtttcatctcagaaatgatgctcttttcaccattcttttgctggactcactattttcatgtgaaatcgacaaacttttggttcgcttaaagaaaagaaaggaaaattgccataattcactgttcctcttcaataggcaaagacatgccatcattccctgttatttgctcctcaattgtgcattctaagtgaaacatttccttttttgtttcccttttgtggacatgtctaccacgttgaaatcattgtgttcatattgtcaaagaagcacttaaacttgcaataggaatttccagaatttttgtgcttatgggaaatatattattttatctgaataaaattagcattgactcctgaaaaatcaataaagagcttgctgtttgtttgggccaaatggtttagttaggaactgctaactttgtattacatctgatacaggatagccaaatatcaagaagcaaaccctggtgtattcactattgtcacttttcctttcttatttgctgtcatgtttggagattggggacatggaatttgcatattggtttcgacactctatctgataatccgagagaagaaatttgcttcacaggtttgcatactggtcatcattttactattgtgttgacaatcattttgaggactttgttctttggaatatgtagtagtgatcccaaagagtttagagcaagtatttatattctgaaagccccaaaaatttacatatgtgataaagctgtatctgatgtctgtttcttattgcagaaactggagacataatggagatgatgtttggtgggcgctatgtaattataatgatggcactcttttcaatctatacaggattaatatacaatgaatttttctctgttccatttgagctttttggtaaatctgcttatgcatgccgtgatccttcttgtgggtaagaaaaagtttcaaacaaaaccacgtttttatccctttaaaaaagaatatttatgcctacttattgtttgtcttgtggatttagagatgctgcaacagaaggattactcaaggtaagacggacatacccttttggtgtggaccctgtatggcatggcagccgcagcgagttgccgtttctcaactcactgaagatgaagatgtcaattcttcttggagttgcacaaatgaaccttggaattgtgattagttactttaatgcgaaattcttcaggaacagtgttaatgtgtggtaagtttattgtctcgtgttgaatgcccttttatgtaacactctactttgagatgagattatgaccagattattctctattgctgctgtatgcttttgtaacaggtaccagttcatcccccagctgatcttcttgaacagcttatttggttacttatccatgctcatcattatcaagtggagcacgggggcaaaagcagatctgtaccatactatgatatatatgttcctcagtccaacagatgaacttggggagaaccaattatttcctggacagaaaacagtgcaggtccgtattcgttattgttatgcagaattgcagactatgacatgaacttgtggataaatactaaaattttctccatttcttatgcagcttgttttacttctgcttgctctggtgtctgttccctggatgctgatcccaaagccatttttcttgaagatggagcatgagcgagtaagttgtatatgatatttcaaattctattgctgtttacgtgttgaattactaatgtgctgacaatacttctgtttgattctatcagaggcatcaaggacaacaatatgcaatgcttcagagcacagatgactcagtggtagcggagatgggacatcataatggctcgaaccaccatgaggagttcgagttcagtgaagtttttgttcaccagttgatccacacaattgagtttgttcttggggcagtctcaaatacagcctcatatcttcgtctctgggctctcaggtacttctagacattcagcatcaccgcattactttgaacagccttactccctcatcatcccacttttgatctataacaatgcactccttgttagccactaataatcgattaaattgtattctttatacagtcttgcacactcggagttgtcaagtgtattctatgacaaggttctcctcctagctttcgggtaagaactaagaagcctccctctccgcctcctctccttttctccctatctatgtagccgctatctggagctcatttttatgtgccttcttgtaggtacaacaacattcttatccgcatcgctggcattaccatcttcatctgtgcgacagttggtgtcttgcttgttatggagaccctaagtgcattccttcacgccttaaggctacattgggtggagttccagaacaaattctatgagggcgatggatacaagtttgcgcccttctctttcgcactgatcagtgaagaggaagactgagtttgcgcaattattgcatctattgtagcgtgtaatttcttggggcgtccttttttctcaaagcgtcaagtatttatcacggaagaatcataaacctccagtttgttccttcatcaggaaagggactagcagcatcattttttgctttgctacgaatgattcgtggcaagatgattttttgggtggccgttggcacatcgggtggcatcacccttattttggtgtaaggctaataaataataagtaaattctgcactcgggttgccatttgggcaattagttttctgcacataaataaacattgtatcaaatgttaatattccattgggttcttttattgtcaataaagagtgcggcctacattctttaaaaggtttgtagaattgtaggaacttggaatttgtctggaggtttgtagaattttctacctgttatttgtgaacggtaaaggcaatgagcaattttgttaagctggcccgtttatatattattgattcagtagtctgaaatcaatgaaacatgtatgagtatttcccctagtttcatgcctaatctcatgctcaaatcagccctgtttttcataatcaatatataatacgaacggaaagaaaatatctacatgataaaactcttgcggtaacattgtcatccatgcaagaccaaagaaaagaaaacactacactgataaaccttgttgtaagttgtaacatccatgcaacgcaagccaaagattatcgttgattatgggaaaccaatgcctatcactagtgatgtactaagctcccaatttcgggaaatttattcgtcaatggtgggcacgctgctggcgctgcgcctggcgctgctgaacgggccagtgacggtccggccgacgaacttgccagccttgctgaggccggtgccgaacgctccgatgccgctgcccacggcgccgatgcccgtgccgaccagccccacgccggagccggcggcggtggcgcccgctccgggcgcggcggctcccgcagcgacgcccgccccagccgcgggggtcaccgtggacgtcacgccgctcgccgcgtccgcggcgccgctgacggccgccgtctcctccttggtcttccgccgctcctccaccgtcttcttctccagctccagcgcctcgagcgcctccgccttggtgaacgggtggtacagcacctgcgtattatcacgacggtcagcgtcgaacaccttcgcgtctcttgtcccaagaacccaagacgcgccgccgtgtggacatgagctcaccttgatggtgagcacgcccctgtccttcttgtccttgaccttggtcgtgtccagcgacgacagcagctgcaggttgatctcctgcacggactccatctccaggtcgttcaggggcagcttggctatgcccagcctcttgtcttgcttcagcttgtcctcgtcgaacacctgcagagcagaacaatttcagaccccccaaaaagaaactaaattctccatgtgttcgatcaaagcttgagctggggaaatgcacctgaaggatcagatgctgcgtctccttgtcctcggcgatgagcgagaacgtctcgttccactcggggttgaggttgtcgtcgatgacgctggtcttctccttgaacattgggcggatgtacagcaccacgtacgggtcggacttgccgatcagctccttgttcttgagcgactccgcgcgcaccacggtcaccgtcagcttcccatgcggcttcagctcaaggtcactgcagaagagctcgaacggcagacagatcaacaaactaggttcaaacaaaggcttttattttcttttttggaagaaaatttcctgtgacaaattcagttgagctctaaaaacactgcaaaattgggcagatcatgcgaaccttacgtcgacgtcgactccgcccagtgggacgacgattctgtgtggccattggagcatgtcagcgatcaaagatgccacggtgtcctacacaaggcaaatgaaaaaaacatcacatttctccagacataaacagttaaatttctactatttgacaatgcaggtaaatgcatcagatgacatacgtcgatcatatctgaaagaccaggcattgctgtcaggcttcctccgacagccttcagtatgtagtcgatccttggttttggctgccaaagacagaaaattcatttgtcaaatcaaacagatcacgaaaccacttcttaccatgcaagtgtgcatggcaggatcagctggttagaatgattataagaagctcacctctgccagaagagcaacaacaacagcagagatgcaaggtatttcatcacacaattggaagacgacacggatgatggtgtaaacctgaaggttcttgaactgtatgcatacagaacaaacatgccaaatgttactaacatgtttaactgaagtaatagtacagtaccactagaaaaacaagaacatgaattactaatgtgaccagtaggttttacaaatcatggctagcggttgcgatttgaatacctgaatgggaagtgaagcaactagagtgtcaactgcaaggacaatattaggatccccgccccaacgaaagtcgacgtccattgtaatttgccctttcttgaagctctgaatccgaatgcctgaacaaaacagaagcaaacagatcaagatgtcatccttggaggagaataaaatgcggtaagactgacgccaaactttttctctgaaaccttcaattttcggaggaacagtccccagggagagtttgctgaacttcagtgaggatatccctgccggcctgtaatcatcaagtataggctccaccgaatccctgatgaccatagttgctgcctgtaaccaaatgtaactgcaaatcagaggcggtgttaacagcaagatgatcagaagttacttctgtggcttgaaatggaacttcatttgaagcctatgtgattctctcctaaagttctctataagaaacaaattgaagttatttgtatgtacctcttcaacaaaaggccaaagcttgctcaattgtttgttgagccatttaacctgaataacaaagcaaaatatactcaaaacatggatgaacttaagcatgccattgaatactatgatgaacaatcgtatgcctaggatgttggtctcagttttctgaatattaaagatgctatgatgataaataggcacaccaaaagagtatcattgcacctgttcatactctgggaatgacacccattctgggagattttctccacatattttcttcacgtcttcgcggtcgagagatgcaagtgcattgacatctgcagcctgatacagaattttttttaaaaaaaaaaaagttagccacaaaccaatctgtttgcaccaaataacgtctcacttatcatcaccattttatatcaacagtatacaaattcaactaaacatagaattcccaatatgaatatactccactgcatcagtcatcatccccagaaaactaagtcagagttaaatttacaatgaggtaagtccctcttgcaaaacatgtacataacacaaacgatcataaaaatcatttctaaaaggaaacaatgaataacgttcttaagcctgaatctttcagacgattcaacacattcaaagcagatatatccaaaaaattttcttcagcctttcacgaaacccttaacactgccattcatgcatgagtcgtaacagatgtcaagaacaacagatgcaaactcgtcaaaaacaaaaactttctatgactgatgactcgaaatcaaggcgtgcatcacatgcgatgaatttatgagatctgtcatgtggttgtggatttgccttggcactgcgtttggcggcgcggcgagccatcgcgcgcgaccagccggcgatgagggcgacgccgatgatcattcccatcaccacccccgatatgaaccccatttctcctctcctccttcccccctcccaacgaaaaaaaatagagaatttgaaaaggagaagattagaagatcaaacaacacttgtcgtgcaacaattttttggatcaaattgacgccaaatctctctccaaattgttgatctgctgctaacgctccattgatttggggccgagtttttcgcgtgctaatagtgaagtactgcaacgagagggagagagagatgcagaggggcaaaggtgtaattacactacgtgctattggtgtggagatggctgtgaccgtgagcacaacggtgaatttcgcatgggtgcatcagggcaatgcacgctattcacgcatcaaacctagtgattagcgcgtctcaactcaagctggagagcgtaccatgaggtacgagttaccataaggtaccaatctaatctaactgttgtttagcaggggtatgattgggctaacaaaatagcgacatcctctgagccgccctcttctcccctcttccatctgccgcatcacgtcgtttgtgctggccatctgcgccgcgccgccgtcgcacatctaggctgccgcgccgccgccgtcgcatcgaggccacccccgggaatgtccgcagggttcgtgaccttcatgcctgtgccctcgccgccagctctcgcccgctctgttctcgttccaattcaccgccctcgagatcgctctaaatcatcaagcttgtccgccggcccgtcgagctcgctccgattcttcaacctctgtccgtcggtgcactcgagctggctggtgcttggagctccttctttgcagctccgtgatgttctgtttccacaataacttcaccaatgaatttaacctgggcaaatctgcctaagtgttcatccttgttgaaaaatctggatgagagaaacccaacatctgaagttcttgatattgatatagatatagtatgtatgcatgtttcctgttcaataagccaatttatctatcaactagaaatttcaattattcagaacgttgttttcacccatggctccatcaccagtcttaaaaaaaaaactatggctccatcgtcttgccctggacgcgtagctgctgcctgctggtggccttggcttcataccatgatgcaggggcagcgtccacctcctcttccatgcacaactgcaacagttgctgcggcggcgaagctcagctcggtgcctcggtctgcatcggcctcttagcacaatgaggaacaacggccaccatccgagaggtctccgccaccgtcgtccactcccatggccgccgcctccgctgtactagcgctgaggacgagggaggagatagggtagtactctgcccgcatccccatataggaccacctcccccgtggtcaccgccgccgggaggccgactgccgcatcgggttgctcgatttgtggcgacgatagcaagcagtgcgatgttcccctccaattcatatgcgaaagtactactctgcccttccaccgttgaaaattactcggtacctgctttcctagagacgcggtaccgcgaggtaccaagcctttgcaaccgttggatggtgcgtaatggacgacttggatttggtacctcctttcttcaaggactgtaaaaactctccaagctggaagctgaaggatttgtgacggtgtccagtattaccgactacttgggccaatggtctcatgggtcacggcccatgttcattagaggctgagctgaatatagcaggcattattgcagcttaattttctttttcaacgtgtcgatggagtttaaagtgtaaaatgcaccagcggtacttaaacttgtcgggaagtttcacttaggtccacgaacttgcaaagcacatatcaagatctctaaacttggtttattgtatcatcccggtctaaaaatgcgtttgaccgtggtcttgtctacgtggcacgccacgtgaacgatgacatggaatttttttttatttttttctcccctcttccttcttttttcaccattgtgacagcccctcccctcgtgccgcctctcaccgccgaggaaaaagaaggaagaaagagaaaaaagaaggaagaaggagaaaaaaataaaaaaaatccatgtcattgtccacgtggcgtgccacgtaggcaagacgacagtcaaacgcggttttggaccgggatgatacaagaaaccaagtttagagaccttgatgtgcactttgcaagttcgtggtcctaagtgaaacctcctgacaagtttaaggatcgttggtgtattttactcgagtttaaacttagggagaattgcaaaaccatcctagaaatcacttaaagtttaacttttcatttataaattattttgttgtaaatgtccatctcctactcgtttttgttgtaaaatccaccacagtgtgagcacgtgattaaccaaatcaatatgttttccaacaaaaccaaaaccaagtaaaggatagacatttataataagatgacttatagagtggaatgtcaaacatcaagtgtcttttagggtgtccttttacaatttttcagctttgtggtgtgaaatatttcaccatgttatttaatacaaatgtgtgcaatcctttttgcacatttttctctaaaataatttcagcactgctatcacaatttcttttggagttttaaagaactgtttaattagcatttgaatatattttagtttttggctaataaagtgcgactgccaaaaatgtgataaccaaccgaacattaccctatcgagttagctcgcctaattaagttgtggaaagcgtggaagaggtgacagggatcattgtggtatttttttagtatttgacactgtttggcaggtttcagattcatagtccgcactggatttgaaatttgtatgctaaattatagtggtttaaaattatatattttatctaaaatgaaaacaaaataatccatccacgtgttatcagcgcatagattcaaatccattgatttgtcaagctaaaaaaataccaaagctctaaaaatttttagatccgaagctgtgccaaatatgaaattcatatacttcaattatagctagtgaacaaactaaaagctccatagtaccagctacgaacaaggtttgtatttcaaagaacaaaaataaccgaaatgagtatagctcaactggttgaatttcttgacataactgttgacagcgagacgcttatcgatccagtctttcggatgtgtttatagggtgagtgtattccattaaaaaaagatgtgttcatagggtgagcgtattccattaaaaaaacaagatactactaaaagctaaatagtttgtcttcatctgaacaaagtatccaatcaaaagtaatagcatagtggtctattatttaagcccaaaaggtcatgattcctaggaaaattaacctttggtatccttcatcctttgtcctgttccaaaagatatgtacaagaaataacaaatataatatgatttaaatagaaatataactgtaaaaatagataattacaaaacatataaaaaatacatttgaatagaccataagtaaatcacagaaatcgaatgagagagatacactcaagccctctttgaagaaaaaaaattgtggatgaattttgtaggatttaaagtctataggattttttttcctatttggttatttgaaacaaaggatttgagctttcataatcctttgaaattccaaagaaatggttcaatacatgtcaacatctttggaagaaaagtagagctttaactttatattatgttttgaaaagactgaactagagaaaaatggaacacacgaatgtaagaggtgagagacatatgtctttattcctcatctcttctatagcctagatcgttgtattcgaatcagtgggtgtagtcatctctgttgccaagaagcttggagtcaccatcttcgtgggagagacagagatatgaggttggttactagtacacaaggggtatctctacacaagtacaaggtgggacgcatatgatttattttctttttctacaaaattacctcacttggatgccaacacttggactgagatttaaaggatcggattgcatgaatgcacgagcgcatgagattagctgtgtacctcataagttgcttcacatatactaggctaagtacccgtgagcggtgaatacggagtatgtggatgtacatgcatggtgaaacctttgaaaaaagaaattactcctattgttccaaaaagaatcaaaccataagaatgaatttaaaccataaggacaaagaaagtacatatgaagcgtcatagaggacaaaatccagatgaattaaaatcctctatgaatttaaaccataaggatgaattcaaacttacaaagaaagtacatatgaagcgtcacagaggattcaatctttgtttttctaaaatccagatgacaacttaacctttggtttctacttccctccaaccaagtccaaatttgaagaggcctttcaataattacctgctgttaaaatgatccatccaattgtcctgttcattttgtctagacattctccaattgtcctgttcatcttgtctagacatcctctacggagagaaaagtgttttgagttaatccatgctatttgcactttagtactagcactactactagtacattgtttgaagattgtaaagttgagagttgagaggcacattttgggtggtaatgtctctgcaaattaaatcgtgattttagaggaaaatacacacggcagcatatcgttgtcgctcttgaccgtaacctatatccaaacctacgttgacccgttttgaccccccttatcctttctttcccttttcatttaattcgctctcaactcccactccccccctccctccatccgatccgatcctgcctacaaatacgccccctccaacgacataacggatcacatcaggtcatcagaacactgccaggtgggccaccgtgtcgtgtgggccccggtggtcagtggggtagggctgtctcctcctggctcctcccctgatccgcacgccagtggtgggcaggtagtacacacgacgcatctgaggagaaagggaaaaaaatggcgaaaaagtgagttggcttttcgcctcactccccctctgcttgtcttttcccgcatctccctctcaggttagggccgagaccgagatgccgtcgcggcggctgctcgccgccgcggcctccccgccgccggctgcggaggagaaggccgtggtcgacggcctgcgggggtctcacggcgcgcggcgccacgccgcgggctcggcggtgggcgccggggtggcggcggtggtagcgctggtgctggtggcgttgggtctgggtctgttcgtgtggctgcggcgcgggaggaagcgtggggcggtcgcgggtggtggtgcggtcggctaggatgggggtgggggtgggggtggggg

SEQ ID NO: 59126 - DNA, 22262 bp, Oryza sativa
cgcgccgccgcgtcgccgccttcgagccgccgcgccggcgccctcgtgctgtcgtgccgccgcattcgtgaccgccgcgccgccgcctcagtgtgccgcgccgtgcgccgtcgtcgccgccgccgtcgtcgccactgccgccgtcgtcgccaccgctgccgtcggtgagccgctgccccccccccctatttgtcgccgtgccgccgggtagagagggagccgagaaagagaaaggaagggagaagccgagggagagaaagaagagggaaggaggagagaaaccggaaaggagagagagagaaaggaaaagaaaagagagagagagagaaaggagaagaaaagaaaagagagagaaaggaaaagaaaagaaaagagagagagaaaggagaggagagattagagtgggccccacgtgtttagtgaatagtaatccccttcttaatctttattagttgaatctattacatgtgggtccgggtggttaaaaatctaattatagaagttttttggtctcgagtttatgacatgtgggccccacttgtcattagctcttcctatttccctttagaaaataattcggtaggaaaaaggaataaacccggggtcccacttgtcaatggatatgtcttggattaaaaataaatcgtttatgaacagtagcttttcgtaatttctcggattaattcaaatttgaatctttacactagcataacttattcattttaactcggatttgagtgaaacttgaacctaaattcatataaattcataagctttccaatgatatataattcactattcaataaaatatatttataattataaattaattaatatcaaatgattagataataattaacctaaatagtgtgccaataaataaaaaaaatggatattgtacagtagcataattatctttaatatatcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattttgtaactaaactataaacacatatagatgaatctttaacttgtttaggagagtaatcacagagctagttgtatttggaccacttaaaaaaaattagttgataccatgtcatgtgaagtagaatatatatatatatatatatatatatagtcggttgatatccattagttaaccaaatagagccatcttaaaatcaacatgtattatatagcttacagtaaaaagaaactactcaaatatatgatccaataataagatattgttgcttacacatatactatacatcccattatagtggtacggtatagtattaatttgcgtgttgcatatatgaaattaagagggagtgtatgacaaacatgtatattagataaatactagttataaatattgacctcatataattataattatagtttaactgtaaattaggattattcattgtaaaattatgtgatgggataatctgtaaccataatatgattaacctaaacaactctaacatacaaagcatggataattattaaccttttacaatttattgtgacaagtaaaatatgttcataattaaagtaaagcttccatcaataaaataaataatacaaatgattcactgtaattatttgattgatcctaaatccatccgacaacagaacctctagtatacgaccattttatttagatagatgcatgtgtagccataatccttccatagccattagctagactaaaccacaaattagccagatacgtatctcattcatactacattggctagctcctaaatagaccaccatgataacagaaagattaagaaactttagcccttagcatgttggaacccattagcaagcgcgaataatatgagcaaccttaggttcaacctcaacaaatatattttgtttgtgcatatttgattgttgcttgaatattggtttttctcgcgtattatagactttgtgtatcggatagtcgtgaggcaacgtcagcaacttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtagagacatgagcgccacattgccatgatgttgatgacatgatttgtgaaaggagaaataaaattaaacaactattttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgagccataatttaatatgtgtgtgagacttctctttcccgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctattcgaatagccgtgctcgcggttaatgagcaccgggacatgtattacacttggctagactctaaattcttaacttgtgttggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttctgctgttgttctctgatagttgttggcctacctggccctaatgtaagtatttaactcttttagtctaaattcattcgtgatatgttgtgatccaactatgtatgtgtgtaccaactactgatccagggattggtacggataaacacagaagatttccgatttccaaaatcgggggtctacaccttagtaacgtttgataaatttaaatagcctgtactctagttgtacataattattctcatgattttattactatttcataattttacaagttatcttttgttttacattagtactttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctacttacggttcacgactcctttgtcgagaggtacgaacagtgtattactataacttagttgcgctgtactaatttttataatgacatattaatttgttattacaggctgcgtgaggccagagacgcacacttttcacttgccgtgcggtgaggtagcccctaccctacaggacgtatcgtacttgttggggctaccgctcgcgggagacgctgttgggccagtgaccgcgggtgtggactggcaagacgatctgacggcatgtttcgcactagtacagcgcgcaccgcatctcccgctcgagccgttggcacaccaccgcaacaccggacctacgaagaggtgactgcttcagttcaccgtgagtgttttttgtaccgaaatgacaagcgtactacatatttagtccacaagtaaggtgcctaacattttatcgaacgcttgcaggtcgagcagctacaggcagaggccgacgagtactcctacagccgctgtttggaggcgtacttgctctggctttttggctgagtgatgttctgtggcggtcacgggcacgcggtcgacaagggactcgtgcactaggccaggagcatcgccgacgccgcggtaggcgaggtgcctcagtggagctggggttccgcgttgttggcggctctgtatcgtggcctttgtgaggcttgcacgaagacggatcctagcgcgacctttggtgggtgccctctctttcttcctatctggacagctgagaggattgcgatcggtctgaggtggaccagcacgcgtacgaggagtcactgtacgcggagcgaccagaggtcaactaccctacgatcggtactctgtggtgccgtcgtcaggtacatcacatcgatcttctcgtattgttaagttaattgctaagttcattgtacatcacatcgaacgtctcgtattgcagcaccgatgggctcacgtccaggttaggcggtcgtatcctgagtttgttatggagttcgaccgccttctgccgattgacgtcgtgtgggagccctacagtgtcgcggctacccaggctcgtgcgccgttgggtcagtccacactctgcaccagggaccaggcgtactggatgactacggttccgatggtcttcgacatctgcgttgagcctcacgcccctttccacgtgatgcggcagttcggcttccgtcagccctttccagtaccgtttccgacgaccgtcccagctgttgttcaccggtaagatctttcactatgctttcagttgttgcattaaaatctacctgtccacaataatttgcaacatctgtcgattcacactaatatgacacattaattcgcaggtactcgcgcaagggtcagcagtcagctggcgactggcccgccaagttggcgacttttgttgaggactggttgctcgcaaccgaggaggtcgtggaccacgagggagagccacacactgaggaggcgtaccaggcctacctacgctggtaccagccacgcacccgtactagggtcaccttcgctcccttggagcagcagccccacgttgtgagcactagagacctctacgccaggcaccgggaccaggacttcgctcgtgctgtgagtaccctgcatcacaccattcctttatgttttcatgtctttctctttatcaaattttacgaatatgtacgaacaaattaaccatgcaggtcgacgacatcaaccgggtcgtcgttgacggttcaacgacgatccaacgtttaggcgcggggattccggtacccgtagaggagcacctgacgacgtacacgcagatggtggagtcgatgcgctcgattctccgagtgctcacctgtcgtgcagacgacgttgctcgggcagacgtagctgtacagcggccacccgtaccgactggtccccgtccagctgcgcacgttcctaggccgactccccctccgcacggaggtaagtatttttaaggatttttctgcacatgcctcgcacatatatgtgagccgtttcacttgccgattgcttcagggtttcgtgcaccgttcagcaccccgccttcctcggctaggccttctgttgtgccccccacaggtacttaaaaaataacattacttcgacaatcaatttacatgcattttatgtcttagcttacaagggtcccgttgtcgatgtgtaggtttcgcccagttcgctatgacgcaggccgcccacttctcccaggctgcagggtcagcgtctcaggcagctgcatcgacctcgcactcagcgcagttctggcagtacaccgggactttgtcacaggcagccggcacgtcgagtcagggtccaccactggaccatgctgggacctcgtcggaccgcttggtgccttccaccttgctcttcgacatcactgacttcgacttcgcttcaggctcgacagaggagcgtggtcgcgacgcggggcagggccagtagagcagtcttctctttgtttatttgcttcactttccagtactgtatgcttgtgtaatgaatacgttgttgttatatgtgcacgatacctgttggcgcatgcacgatacctttcggcgcatgcacgactactttctgccgcaccgatgcagcctcctttattcgcgtacgatacgagtatttgctcgccatttgccgcatacgactaatgtaactttcggcgccgatcaggcatgtaactttcggcgccgatcaggcgtacccaccatgccccgccacgttcacatgtcagggatatcactcgattttttgcgcccatataagtcgccttaacgagtgaggcctcacaatcttccagaactcagtcacattcagtactctcttccccacttgcttcattacaaatcctaccggctttcgtcaatggctagacgccggggtgttgaggatccgaactggcgtagcaatacttgtgtatacctactaccaccttggtgccagcgtcctctctgcctatgcggtgatcgatgccaactaatggcttcgaggaatcctgatattcgaggaaggcgcttttttaggtgccctaactatgatcgtgaggtattttattatctgcatatgcttattcattccgtatgggcaatcgttttattcttcgtaacactactctattcggcagacccgcactacggcttacgcatacatcgagtgggtcgatacagaaaatcccgttctcgacctaaccacttgtttacaagaaggtcgctggtatttcgcatccaaaagtactgagcaatacttacagagaaaagcggcttatgaacgacaatgtcgtgaacaacagagcgactggcaggtgctaactatagcactccctccatgggaagcccgtccaagatgcaggtgtggtgatcgttgtcaggttcttcattccataaagcctacaacattgggtcgaaggttctttgtttgtccaaatattcttgacgacgatttcatggtaagaatattttgattacatgaatcctttttttctcacaacatttactaactttgctcgctttaaatctattctttcctcccaggaaccaccaaggagatgtcaatacagagaatgtatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataactctccttgtttaagtccatataatgtttctacgaccgagactgcgataggcctatattaattatccgagtactaatacgtcgaataagttacaaaataataccttacttaacatatgaaattgcgaaacaaccaacttcaatacatttttataacaatattaacatgttttaccaataaatacttctttatttattattaacataacatagaaaaatcgtttggccgtactttttgcatctgggtcccttgccgccctctactggggcggcaaggggcccaaatgcaaaaagtacgagcgcaacctctttatggcggcaaaaattgcaattagccccttgccgccctctgtatgggcggcaagggggttattgcaatttttgccgacggcggcagacggcgcggtcgacccgctgtctgccacgtcagcttgtcgcccaccactggggcggcaggttctagttttgcaatttttttggccgatagattatttctgtaaatattaaaaaaaatctaaaaatgaaaaaaattctgtgcaatggcagaggatggtaggcatggtgcacatgagcgaaacctatgtgcgatggctgctttcgtcgagccactgcgcgattgcatcgcgctctcacaggtgcagttgtctgttttgggagcgtgattgtggtcttgtagacgggcatggccgcatggccgcaagggcatacattgccgacaaaacatgagataacttctgccaaaaataattgaaaaatataccgttaaaattttcttttcttagaaatatatgacaagcaaaaaggttttagaagagagaatataccgttgtcacgagggagtaaagcaaactcatgacgacgagatcgtatggtgaatctgcaaagtggcgatgacaacaacgatatcgcgggactttggactatttgccactctcttcaatagcacattctcaaatgccatcttccctaataactctaattatttgtgttgaaagtatgtcatgaggggctttgatcgaggatgccaaaaccaccacacctatgaagtgctgctcgacgatcaaggggttcgactggggtgaagccgagggggcaaggccgaaggacgaagctagaagggttcgccaccctgtccataggacttgtcgtcaagtctctgtcagaggcgaagccggaggggttcgaccatgagctagatgccttcgccaaacatgcctgagagtgcgggatggcccaagaaggccattcgccacacatgggctggcccacgaagcccgactagggccccatagctaggatggacactatgtgccctcactaatgtccttatcttaagggtatcaatataaattctcctatacacactaaaccctagtgagtatgagtctttactaagactataaaaggccctataggggcatgtaataggggatccaaaaaaatatcatcaattaataccttgttttactattcaaccactccaccgagagaaccacgtctttcgacgtgaagctattgtcgcttcgacaacaatttgccatcgtgattcatcaaattgtttctattttgccacttttaactgccaacacactaaaagaaacagaaaatgaccttactgctcctctcatctcctctatcttttcttctttcctcatctctcctatgttattcctctcctacgtgagaatcccatgtactgttgcagttggatggatggcgcgagcctccgcgatttgacggcgaggtctttgacgagcgaggatatgtcgaggtcacctcgaccacaagcgagatactcgcgctggagcatacaacttgacccatgccggctccctccccccctcctaaacatccatttgcaccgtttctcccaacatcacaggatctatgcgaagggcctgcaaccaagatgtactaccttggccccgatgacccattcgatgaaccatcaaccattgtcgcatccattgcttgtcctgctatccggttcatccatggcgctagccgtccctactgcttagcttgtctcacaccagagattggttcatgccatgccagagaggaagaaggtagaagggagatgaatgagagggtaatgaggttattttcttatagttttgctaagttgtcagtcaaaaataacgaaacagagacaacttggtggatcacgatggcaaataacaaaagttattgggaatgataacatttgagaatgtgacatcgaagagagagtggcaaatagcccaaaatccctaacatcgtgcccgacaaatgcgaagtggttgtttgcggaggtggacccggtgacgtcgccactacgcgctttgagtccacgagagtgtgggcccctatcatgtcctgataaatccaccccgaattaaaaatcactttataaaagaaaagaatagaaattattataaatctaaaagaaatctcaagcactaaacctctgtaaatattttctgctttaatgaaaatacattgctaggcaaatccctagcagctttccaggtgattttttttttcaaattgagcttggagtatttttcctaaaatctccatgttcaaaattggtccctcgatttttacttgatttctagagcaaaagaaataattttaaagcaacaaaaaccaaatttgtagttaattaaaatgaaaacctaaaaataaatctctccttctctttaggccatttccggcccaaagctcttagttgctctttcggcccgccaccggggtcctcttctctctctcctccttctcgggccaacctcctcttaaataaatactctctccgtttcacaacgtaagtcatatatatatctagattcattaacatcaatataaatatgggaaatgctagaataacttacattgtgaaacggaggaagtagctacttgttggttttacaacgccgtaatcttgttttgggtttttttttcttgtaactttccttgtaagtatttttttatgcttttgtaaaattacactattgggttaggcctggtagtattccctaaaaaagttttttttgttttttaagttaattaattaaacttgttcaatataccggataaaaaaatcccttttttctttgttaacatcaattccacatggacgcaatatatagtctgccggcctaatgaagcgatcaaacctccagactccaaagtccaaactcacctacggcctagctttgacagctacgtatcctatacgaaccatctcattattatgggaaactactctaaactcgttgttatgaattttttttaaaaaaaatagattaatacgtgttaaattattatactaacatgcaagatcaaattctatttctatttctatgagttgcaactgaaaaaaatttgactacaaatatacgttaactagatattatttaatttgtctttttcgttgcaacttatagaattcaaattttaccttgtatgtgtatagagtgatttatcgtatattaacaatttatcttgttattttttaaaaaaaatcataatcatttgaatcatatgtaaataaggattgagaatttagaatccccttaccattattaccagcacatcaacgcccgtgctgccgcacgctgagcaccgtgcacgagcgcatcgttccgacgttccctttctttcgtcgtggactccggctactcctccgctgccgccgccgccggcggaatgcacgtcgtgatctgcccattgctcgccttcggccacctgcttccgtgcctcgacctcgcccagcgcctggcgtgtggccaccgcgtgtcgttcgtctcaacgccgcggaacatatcccgcctccctccggtgcgcccctcgctcgcgccgctcgtctccttcgtggcgttgccgctcccgcgcgtcgaggggctccccaacggcgccgagtctacccacaacgtccctcacgacaggccagacatggtcgagctccacctgagagcttttgacgggcttgccgcgcccttctcggagttcttgggcaccgcctgcgccgactgggtcatgccgacgtcgtccgcacctaggcaaacactaagttctaacatccacgtgaaccattcatgagatggaagaagagaggcagaaccattgaagacatacgcacatgatagaattgcagagaaactcgtcccgcccaggcaccccggcgcccagcggtcgcctcctttgcccaatcactcctcattcgaacacgctcgagcgcgctgcagagaagctcgtccgctcctcgcgccaaaacgcgcgagctcggtcccttctcgcctttacctcccctccccttccttatcgcgacgtttttcggtctctgcttggtctgcaaatgggccgaaagcagctgaacatcgcgcatgagacgaatgggaggaggacaggaacgcttccactgaacttgtgccgttggatgtggaagcaacggcgatgcggaaagctacgtccctctgacgtagaatttaatacgtcgcgcagtaatgaagcaatcagcccgatcggagcaagcttggtaaacctccaaagtatacaaagtccaaacccacgggcggtactgcccatcgcatcatcaggcgtccgggcggtattcatcggtcgcgcccgcacatcgacgcccacgccgccgcacgctaaacccgcccgctcggccgctccacgcgcgcaccggcccccttcttccgtcatggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggttgcaccaagtcctactaatagctcaatctttgcactaaccttaattacataattccatcattgatgctacgttattcgccttaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattgaagcatctcaggatgtacacctgcaacagtgcaactacaaaatccttggaataaaatgatttttgttttgtagtccacttacccaaaatatgcaaaggccgaacggtggggaaaattctaatcctgatttttttttcatttttgtttttctttgttatttatcaatttgataccgcccagacaaagttgaaatttaattgtaaaactttttatagtacatggaacacgcacaacatactcatttcctgtagagtaatgctccggtgcaatctacttgcagtattctactccgagtagaattaatctcgaccgtttattttaaagggcaggtaagtaatctcctaatatcgtttaggggtaattttggtttgggatgttttcttcggttcgcatcgcatcaggtccggactccgtcgcatgcagacacctcgctattcctcccccggcctcgccgccttgtccgccccctccgtcaccgtctgtatcccccgccgtcgccgccttgtccgcctcctcagtcgcatcgtccgtctaggagcggacgagcgtggcagcgtccgagcgagcgacgatcttgagcaggagttctggtggtagtaaaaattctggcatgggcttcggcggcggcatcacgcacgcacgcaacgtcatttgcgtggcggcatcgtctcagctcattcgtcttcttgtcgttccgattgtttcatggattacatggatcgattaagatcttgcacgaccaactccgacgaggatgacatggtgattgatctatggattggaaaacgataatacccctacgcgaattatttttcctggatgaaaacacccctccacatttctacttccactaattctggtgggagtagaactagatctcagccctacaattaaatatgatcaagggcccaaattactttctactccgagtagaaaacaccggagtaggactgtttcctgtatgtgaaacttttttcgagattttccaaagaaaacattcattattcattatctggcatctcggagagggcgagaggcaagcatgatgcaagtgtaccatgctaataatactgtacttaggagactactgactactccacgcgggcgtcagtcgtcaaagttcataaatagccggcagcggaacgtctgattctttaattggtggagaacttaactttgcactcagcttgacaaattgtacaggcaagatatcaagatcacgggctttttcatctccaaacgatcacaatcttaacttaaacaaaccagggtggaaggtaggcaaagaagaaaagtacaaagttgcattgtgaagttgcagtaaaaaaatgtcggatgacatgcagatacagcaaatgcttgacttcctcggtggcggtgccggcctgccggcttaactaaagtagttccttccctgattggatctttcaaagtctccacgactccaaagtgcaaacatatatttgagcggttcagcccgtgctaaactggaaactgttttttggatggacgcccacctatttattacatatcaactaaacagttataatttttttaaaaaaaacaagatagattaatatgtaatatatcattcgacaaacatgcaaattcaaaatcgacttctataaattgtagcgaaaataacaaatttaattgtgaattaatttgttatttaattgacatgttagagtttaatacatatactagttagagtttaatttgttgtttttgttacagtttagaaaagttaaatttgaacttgtattttttggagtgatatattacatactaatctatattatcgttttttttaatttttttataactatttagttaacatgaaatgggtggacgttcatttaagatattagaatccatcttcatcccgcgtctgctcgatgatatccatgttcttgaaatagaatccagattgctctacctctgccttgcgtgttacaggaagaaagctgctatacgttcgaccgacgcgtacgactcaacggcggaatacacgacgtgagccagcagcccagcactgacttggttatatggtttgctgctcccactgtcccacagtcccacataatccacgtggaagcacatcaaagctcatatataaagcccaaacttcaggcatggaaaattaaatcaaacaaaaccgttgatgtagatgtttgtaaaaaaaaaaagagagatgaaaaatttagaggagaaagggaggagactaacaaagttcagcggcgaggtaggcgaagctgcgaggcagccgcccggtcccctccccactcgcggctacctggcacctctccgacctggcgtggcggcggcggctcccagctagctccggcctggcgcgggcgagggaggcgaagctgcgaggcggccgcctagtcccctccccactcgcggcggcctggcgcctctccggcctggtgtggcggcggcctggcgcgggcgaggaaggcgaagcggcaaggcggcgatgcgaccacgagggatttgggcgtcgggcggcaggaaacggagagcgtgggctgaaaacggaggctgcaggtgggccggcgcagcagaccgttcgattagatttcaacgctccagatcgctccaatgtcacaccatgccatgccataacaatgtcactgaatttgaatccctaccacacggtcatcaccgccggcgacagctattccttgcttgcgctgaggtctgctcgtcgtcgtgtgtgttcatgtagggaaaaggaggatgtaggaacactcagaaaagtaagaatggaaaaggaataggaggcgctgacatgtggatcctacatgttgattcagcatgttagactaagtcaatgagccatgtcagcaagaatcgctttcaaaaccaccgagtgattttgtatcagttttaacaatttggggttcaagatatacggttaaaggttacaaattagattagacctatatttgagggagtcaaagtggacttattctcacctagcaacacttgagtttcccaactcaatcctctcgttttctacgtgcacgtttttcaaactgctaaatgatgtattttttgcaaaaaaaaaaacctatacgaaagttgctttcaaaattatattgatccatttttagaaagaaaataactaatacttatttaatcacgcgctaatggaccgctccattttatgtgcaggaggatttgttcccaactgcatctaccgaatgcatccttattttgacaggtaaccaggaaggcaacaggcccggcctgctcctggccagcatgttagactaagtcaatgagccatgtcagtaagaatcgctttcaaaaccaccgagtgattttgtatcggttttaacaatttggggttcaagatatacgattaaaggatacaaattagattggacctatatttgagggagtcaaagtggacttattctcacctagcaacacttgagtttcccaagtcaatcctctcattttctacgtgcacgtttttcaaactgctaaatgatgcatttttttgcaaaaaaaaacctatacgaaagttgctttaaaaattatattaatccatttttagaaagaaaataacaaatacttatttaatcacgcgctaatggaccgctccattttgtatgcaggaggatttgttcccaactgcatctaccgaatgcagccttattttgacaggtaaccaggaaggcagcaggcccggcctgctcctggcccaaaactcgttgtcctaataccttcacgggccggacttgggcacggattttcggcccgtacaaaatgggcttttcttctacgcggcccgatcagacccggcccattcccaggtctgccgcggggaaatcgccttcgggcttcggcccctttgcacttttgcagaggagcaaagcttacaatagggcaacccaaaccaaaccctggccaaccccacctccaaccccccgcgcagccgaaggaatcctcgacggcgacgacgatggccgccgcgacggagaagacggccgaggagatccgccgcgagctccaggagctccagcgccagcaccgcgaggtcggtttctctccctctctccctcccctgagagaccaccctgtactcagcacgatctcctctccccgtgcgcagatcagcgagcgcctccgagacccccgcggcctccgccgcggcgcgcccgccgctgcaggacccggcgggccccgcccacttcgcggattccctagaccagtacggcgtcgcgattgcgtctcctcttccctttccctttattttgtattcgtgatttgatttatttccgtgttcttgtgttgcaaggctgtggatttggtggaccagtctgcgcctaagcggaggattctatctgcagtggttaaagtatccgcctaggctttggttttttattttccttagtcaaacttgtggtttgtttgtcgataaccctaatattctgtgcatttgtttggtgtcatgaatggaggtggaggatactgaagctaaggaggatgtcaagaaggaagcggaggcagaggggccggagggcggttcggctgctgctgaaggcggtgagaggagggatggtgggttcaggagggatgggagccagcgcatgccgaggagggtgagtaggctggaactataggggattgcgggttgagtttgcttaactgtattgttttggttgcaggagtttgatatgtcattgccagaacctctcccgagggaatttcccaaggatgaggatcaaagccttgtgaagaggaacaagaggatgctggggaagcttcttgtcggtacattagaggtaaccgattcaatagacatacaaaggaacaatccatgggtcaagcgataataagatatcaacagttttcagtgtttcctctccaactgatacacacaaaagaaaattttcagtatttgttaactagctttatcttgggtatggcaacctgtcaattaggtaggaatttaatggaagtactagtggcaagccacccttagtccccttcattgtgaatatttcaaatcagtgtaattgatttttccttgtgcttggtaatccagaaatttcagcaagaggacaaaaaactgtccaacacagaggcttatatgcgcagatcagaggttcagcgaaaggtactaacaatttctcttggtcttgggccaatctacatttaagcatgatttagtggctgatgtcagttgcatccactttattcacatgatgacatgtgctaattagaaatttgattttcatacatggaattatgaatgtaatattgctgttggaatttaactattgtgtcccgtgccatgacccatgaatgaaccaaacgatctcaataaaacacatacatcaacagaaaacgtcttgtctcctgatactacatcaatgaaatttagataagtagaatgcatttttcaagcagtgttatgtttttctgttcctgtggtcctgaaaatatctattcccataggaactatctagcgcacattcactttatacaactacctttttgttgctatatgcattgccctagtagaactttggacagtaccatgagttgaatggaccgtgttaaattctttttattaccattcttttgctggacttaggctaagtgatcttccattattgagatatcgatttcattctctagggtctcagttctttctttcaaagtaatctcgcatatactatggtctagccttgattttattctcgctattaggtctgatgtagcatggaatattgaaaaagattgcgtgaatgtaggctgatcaaaaggctcgtgaggaaagtgaaaggttgcggcagcaagagcgagagcaagcaatagagaagcgtaagcgtgatatggtaagctcacatcagtgtttatgacttgcatttatttatgattggttcacctgagttaaattgatgagtttatgttgcaaatggtttcctgatatgctcttgaatagatgctgcgtgctcgagtagctgctaaggcagaagaaaagaggttggagctgttatacatgcagtgggctgagcatcacaaaaagctgtccaatttcttaaggtcgctttacttctttgcatcattctgcacctttttttatccatgaatggggtccctttttgtttccttttgttgtgccactttgcaatatttttatctgtatttatcttactcttttatgaactggtcttattgtgtgctgcaggttatttttattcctggtccaaaagtatccatattgacaattaaattgagggaagatgcgtttctgattgtgcaaatcttgatgtttgatgttcataggggtttctatatccattttgctaaattacacattagtatctttttgaacattattgttgtttgtcaggacaactgcggaaccaccaatttactacatgccagctaaaccaataattgatgatccggctattgctgaggagaacaaggaaaaggtattttctgccctatataagtcaaagtaaaaacgctaagtttacaaatttttgaaggatgaattgcgaccctttatacacacctccatctacatgcaacttgggaggcagaacactacagatgtacacaatgaggacaaacttgtgcctactacaaataataaattgtctattttgctgctgtagtatttgtgtggcatagctaatttcatcatagggcaccatcagaatgccagttgcctgcatatatccagtcctgttggtttctgctctgtcatggttcaatcaaacatcaaataagtacaacggctaactgatcagccagctatgaaattgctgcccccctcccccgcattatgattattttggtgacatgatataaaatcttaccaaaaaatgcatatcgaatcagtaagatttctgggcacttgaaagtacgtggtcagtgctatgaatttgtcatattttacaaagctttatacttgaaagtgctctggtggtttgggtgggactggctgtattcgataactgtgcatcaatgctcttcctttgcatgtatggagcatattgatctaacctttcacgggatagtccttggtcaagtgcaacatattaagagaatgccacttccgcaagtcaatactcatctttcacattttgccatttacatcatatgcttgctagtttcctgggcttccttttttgtacaatctggggcaaccgatttttctttgtcctcttcatccatcatgaactcatattcaatgttgcaggcatttcaagaatggaaatctgaacgcagggctgagctaactcagtttcaaaagcaagtcgaagaacagtacatgtctaatgttgagaggcagttggaaaggatgcagaatgcgcggaatgcacggaggggtaatggtccttcaaacatgcaagaaatggacaaggagctggacacgcacagggcggagcatggtccaaaaactcgacgagttcttgagggtggcaatgacgatgaggatgatatggacgatatggccgtggaagatgagctgatggatgaagtccttggcattaacgagccaatcagcgatgagcaaaccaagccgtctgaagaagctgctgatggtgttccggtgtctgaggaagtgcaataggtaatttgttttgtattgttgcgaggtaggcatctaggagttccacatttgatatccttcagctgccctcattttctgacgcttgttgtatgtctgttgacgcttgagattttccccgctgttatcaagccatatattgttgcgggatgtattgccgttgagcgatatactctgttaatcattgcatcctttgcgtttctagtataaatcgagcaatttactgatgaatgttggcttgcccagcgacaggggttatcaaactgtcttaagattaccatgatggttgacatacgaaagtttagaactattttctgaaaaaaaaaatcacagttgaactgaaattcgttggagcttaataagaagcttgccgactgtaaagtaattccaatgggggtatatgttaattctttacaagaagatctagatgtgtggccgcatcgctgctatttattgttcagtctcgctcagggaaagccttctccaagaaacttgcaatatctatttactgttcaatcttgctcggggaaaaccttctccaagaaacttataaatcgtc

SEQ ID NO: 59127 - DNA, 4049 bp, Oryza sativa
tcctgcagccctcccctcgctctaatcttcttcccctcaacccgctccaaaattcccccgcctcccactccaaaaccgaaaaaaatcccgcgcggccgcgtgaagccgtgaatctactcctcccttcctccgcgcccgcgcgtcgccatgaatccgcaggcggagggcgatgcggcggcggcggcggcggtgctgggggcggacccggcggggctgacggcgctgctgggggacctgacgtcgccggcgaacgaggcgaggtcgagggcggaggggatgttccacgcgctcagggcgtcccacccggacgcgctcgcgctccgcctcgcgcacctgctgctctccccggcgcacccctccgcgcccatggcggccgtgctcctgcgccgcctcatctccccggggtcgcaggcgttcgtctacccggggctctcccccgccacgcagtcctcgctccgcgcgctcctcctctccgcggcgtccgcgacggggctctccaagtccatctcgaagaagctctccgacgccgtcgccgagctcgcgtccttcctgctgccgtccaacgcgtggcccgacctcctcaccttcctctacaagtccatcgcctccccatcctcgcctccggcgctgcaggagtcggcgctcaacatcctagcccggctggcctcccatctcgccgcgggcttccccaacctccacgccctcctcctctccgcgctctcgcacccgtcgtccgcagatgtccgcgtcgcggggctcaacgccgctatcagcctcatacagtctctcccctctgccgccgaccgtgaccagtttcaggatctcctcccagccatgatgcgcgccctcgctgaatcgctcaactgtgggaacgagggctctgcacaggaggcgcttgagatgatgatcgagcttgcaggtgcagaaccacggtttctccgccgccagctgcctgacgtggttggttctatgttgcaaattgctgaagcccctggattagaggatggtacgcgacaccttgctgtcgagtttgttgttacccttgctgaggcaagggagcgcgcgcccgggatgatgagaaagctgccacggtatgtgggccggctatttgcggtgctcatgacaatgctgctcgatgtccaggatgaacctgcgtggcatgcagcggtgtcggaagaagaggatgctggggagactgggagctatgttttcgcacaggaatgtcttgatcggcttgcgattgctgttggtgggaatacgattttacctgtggcagctgagttgctcccatcattttttgcttctgaagagtggaagagacgacatgcggcactggttacgatagcgcagattgcagagggctgtgctagagtaatgattaagaatctggagcaggtagttggtatggtgctgaattccttccgggatccttatcctcgggtgagatgggcagctatcaatgcaattgggcagctttcgacggacctggggcctgagttgcaaaataaactgcaccatgttgtcctgcctgcattggcttcatccatggatgatttccagaacccgcgcgtacaggcaagttattattgaggatttacacttaagtcatctgctgcacttctttcaatattcgttatcgtattttatagtgtaaactataaagcattggtggccctgtaacccacaagtatcaggctcagaggaacttggaagttaaaaagatattatcttgacatatatgcattctaaggaatgagtagaaattgctggaaactaaaaattatatttaaagagaagttcgtagactgattaaggtctaatgctcaaagctgtcgtacttttaatagaatagtacatggaaattttctcaattatattacatatgtatcagtaaggaatgggtctatttaacccctcaactatcgtgttggtctaatttcaactctccagttatgcaagtatgcaaccttgtaaaacacaattcttgaatatcaatacccaacaatctacaaccctcaacctcaccctagttgtttgatgtttgaagtaccatacaatgtgagtgattatgctagcctatgtgcacaggttattgtcgtgatcaagtttcatgatgcaatgatttagagaggtttgatgagactgctattaatgcctaaattgtttgtagtgtgtcctcatctgagatcacaactggttacacgtttttttagttagtggccattagtttgtgccacttgctttttctttgacatatacttacaattgacttgtcattaatacccatcaagttatcagctagacatgctctaatcattgttttatattccgaatgagttcaggcacacgcagcttctgcgattctaaacttcagcgaaaactgcaggcctgatattttgacaccatacttggatgggatagttgggaaactactgtcattgcttcaggtaatccttgcatttgatcatggagccttcattttgtgcagcataaacatgaaccttttcggaaattttgtttgttttctgatagactggaaaccaaatggtgcaagaaggtgctttaactgctttagcatcagctgcagattcttctcaggtacaagaggaaatatttttgaaggttttcgggccagcattcttgctcaaagttttgcaatcttattgtttcaggaacacttccaaaaatattatgatgcagtcatgccatatctcaagtctatactcatgaatgcaactgacaaatcaaatagaatgttgcgggccaaatcgatggaatgcattagcttagttggtatggctgttggaaagcaaaaatttaaggatgatgctaagcaggtaataatttgctagttgctctgatacattgtaatacgtttgaagaaaatgtcaaagcacactgtataaatgttatttatgacttgttctgattgtattgctgatgggcttatttgaatgctgtttgctgaattcgttgtttctttggctaacatatttctcttgctaggtgatggaagttttgatgacattgcaaggatctcagatggaggctgatgaccctataacaagttacatgctgcaagtatgttgtagcttaaatactattgccattttatgccatcactagtttgcttcagttttgcttattctaattgcattttctaggcatgggcgagattgtgtaaatgccttggtcaggacttcttaccatacatgaatgttgttatgcctcctctgctccagtctgctcagcttaaaccagatgtgagtgtcacatctgctgggccagaagatgaaaatggtgaatctgatgatgaggggtacgtttttgttacgctggcaacttaccataatgttgtcacattcccatgatagaatattgaaattgatgaattgttatcattgtaggcatgatattagtttgttgccctgtttcaaatttgcatgtatttgtcagatccataacagagcatttaatttgaatgttgatatcctgttgttgtctgattctatgatcttatgatatctgtaaaattttgtgttttacctggctgcctgcataaaatgcagtgttgagactattacgctaggagacaagagaattggcatccgaaccagtctgctggaggaaaaagcaacggcatgtaatatgctatgttgttatgctgatgagctcaaggaagggtttttcccatggattgatcaggttatgttacgattttttgtgaactctatgtgtacacgcacgcgcctatgtgaagagctccagctgaaccttgaatctgtacaggttgcaactactctggttcctctcctcaaattctattttcatgaagaagttaggaaggcagccgtttcaggtctgcaactacccttttcagtgtattctccattatttttagcatttttctcaaagtgacattgtgttatctccctagcaatgcctgagcttctacgttcagcgaagttggcaatagagaagagccatcgcaaggtcgggatgaatcttatcttaagcaactgtctgattacatagttccagctcttgta

SEQ ID NO: 59128 - DNA, 5387 bp, Oryza sativa
gcatcacttagcgatcatgcactttcctgttcagctttagacatggttccatcggtgttgcacagggttgcagcgggtaagccaagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgccgcgcgcgtacagcccatgctccaacgggctttgcttgaagccaagtttcttcagtgtgcagtctagcttggtgttccaagctctgggtgcttggcgaagaccatacaacgccttatcaagcctgtaaaccttgttctcctgtccatcgatctcaaaccccggtggctgaacaacatacacctcctcaatcagttccccattgaggaacgctgatttaacgtccatatgatgcaccatccaaccttcctgcgcagcgagagcgagcaacaaacgaatagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgttgccggttcttctccgctcaccatcatcagctcttcctggacctcacgattagcgagacctggcagcatggccggccccagcacattgtccatcgtgcggaaacggagtggtgcgtcgtcgtggtctgcatcaagattagcagctgctccagttggtggcgacacaaaatcaaccgccggcgcatcgccatgcaccgaaggtgttcggccggctgtcggtgagtctgatggcgttcgcggcgatgatgaagatcgagcaggcggctccccagcatcttggcgtgttcctgacagcgagccaggatggtacaccgtggtgtactcaacgacgaagtcggtgtcgagatcagcggccgcctcagcatcccagtcccactgggccgcttcgtcgaagacgatgtcacgggagatgtgaacacgccgagtagccggatcataggcgcgatacgccttggaccccggctcgtagccgacaaagatcattggacaactcctgtcatccagtttcttcaggttcggggtggtcgtcttcacgtgtgccacacacccaaacgtgcgcagatggtgcacggccggcggaacgccattccacagcgcgtacggggtcttgccgccgatacccttggacgacgacctgttgagcagatacccggcggtatttatcgcctctccccaaaacatacctggtagccccttcgccttgagcatactccgcgccgtgcccaccacggattggtttcgccgctcgacaacgccgttctgttgcggagagtagggcgccgtgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccagctgtagtcgtcgacgagtagaaggaaatagcggttgccactgggtgtcgccggcgtgatcggtccacagagatctccatgtagcagcgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagaccaggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagataataggtgttcgacagagtgcggtgctcaccattcttgcaggcaaagagaattgtgccccgtcctgcgatccggaccacggatccatcgctgagtcgcacgttcccggtgatgttcgtgtcgaggtcggcgaacgccatcctgctgcccgtcatatggtttgacgcgccggaatccataatccagcgcccgggatcatggtcagccacgtcgtcgagcgctggaaatactttcatctccacgagttccaccacggcttggtggggcggtgtgggcgtgtcgccctccggcgccgccgcgtcgaccgtgtcaacgcggccgccggtgagcaacatcaaggtgtgctcttcttcatcctcctgggcgacgtgagcctgttcttcgcgcttggacttgctcctacagtccttcgcccagtgcccaagtttgccgcaatttcggcatttgtctcccttgcgcgccgaaccagagttcgtgctctcggggctcgcagtcccgccgccaccagtgcgccctctcccgccacggcgcttgccgcggccgccagagccgcccgagtcaccccgctttgcctcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgatgactttatcagcaggttcaggatcaccgagggttgcaagctggttgacgatggttgtgagccatagagcgaaatcttccacggtctcgtcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggctcgatcgccgcccacaggcagtgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgacacaacgcacgcgtactgtggctaaacctgcaaattcgcagaacagaggaaacagagcaaattttgtgcagcgcttttctcagctgcttttctgtttacttacatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaacggaaacatgcagataactaatcaactaactaaccgtggcacacaagattactgctaacaaaactctccctaagcttgatgtgccgattatacaggaaacataccaatttgttcccgcagctcctgaaacttgattcgagaaagcggcttcgtcaggatatctgcaagttgcccttctatgccgatgtaactcggtgtgatttccccattctccacggcttcacgaatgaaatgaaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtggtgctcttgcgagtgtcaatgtctccagccatatcactgtcactgtaaccctgcagtcctctttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacatggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccattggcgcgcgcgtacagcccatgctccaacgggctttgcttgaagccaagtttcttcagtgtgcagtctagcttggtgttccaagctctgggtgcttggcgaagaccatacaacgccttatcaagcctgtaaaccttgttctgctgttcatcgatctcaaaccccggtggctgaacaacatacacctcctcaatcagttccccattgaggaacgctgatttaacgtccatatgatgcaccatgcaacccttctgcgcagcgagagcgagcaacaaacgaatagaatc

SEQ ID NO: 59129 - DNA, 36594 bp, Oryza sativa
tgacaccccaccccctaaattttttgtttaagtacgtgaacctacataagtgcaggatgtagggaaatacatatctccacgccaatcattggatttataggtatgtaatgtgcattctttgccaatgattagagagctccatcatcagtgtcaaagtgataaaccatatctaactgtcgggaaacttgtaggaatataggaggatagtaaggtaaattaaacttctctcttggatcagttgagacttgagagtagggcaaacctagacacaagaggcaactcaacagggatgagtggcccgaacaagcagcctttttttcttccacttataaacttttttttgaaagatttttgtccacttatctcagttctagtcactccctcctaaattttactatcttcttttcaaaatataagaaaaattttccccgttaaccattacttaggtaaaatccattatattctctgatggacgtagtacatataatataaaaaataaattaatactattaagcagatttctatactggtaatgtatttgttcacttgcatccatgtaaaaaggacacaaatattagggaatgatctaatatcaaataattagaagggtgaggtttcgaatacagatcgtctagcccaccaccttgtgaagctagccggaaaactccggggcgtttctctacatccctgtaaattaatcaacgcctggtagatcaaacacatttacgagtgggagaggacagaggaacaagacggtaaatgtgatcgcgctatttattgggtacattgatcccatctatcgattgtaatcagatgactgtggcctcatcgtttcgcctcatcgtttcgcttatacttatacttatcagtcaaaacttaaattttcaaccttaaatttaaaactgattttgaggttttttcattgaagtttatttttcagtctttgcttttaaatcactaagaacacgtatataaaagttttattcacaaattacttttttatttacaaatataccgtttcgcttttcgtttccacaatttgttgcggcggattccatatttccacggacccacgttgttgacagatgggtattctcctctccagggtcaaacaccgtaccggcgtaccacacaccacgaaccccgtttatctactacttccaccatctcattttaagtgtagccatgattttccgtgcacaattttgaccgtccatcttatttaaaaaatttgtaaaaaaaatttaaaaacataagtactatttatattttatcatctcataacaataaaattataaattataaaaatattttaaataagatggataattaaagttggataccaaaacttatggttatactccctccggttccataataattgacgttttggataaggttgaggtcaaacttttataactttgaccattaataactttaaaaatatttagtttgaagaaactagaacaacatatatagatttgtcttttaaagcactataataaaagtaaacatgcatttatttattatatatatattaataaaaaaagatcaaaaatatattttatagtccgtgacattgtttaaaacgttactacctccatcccaaaatgtagctatttctagcacagtactttgtcccaaaatgaagctatttttctacctaccttctcctctcaaccaatcacaaccattctttttcacctactttctcttttcaaccaatcgcacacattcttcaatcattctcacttactttcttaatacccgtgccaacctcaaaaatacttacattttgggacgggggaagtaattaaagagtaaagtctatcaccggtccctaaacttatatcgttgtgtcatcccggtccctaaactcgcaaatcgaccgttcaagtccttaaaattgttcaactgtgtcatcccggtccttaaacttgcagatcactcgtttaggtcctccaacttgttcagctgtgtcactccggtccctaaacttggatttgaatatcatctgggtcaaataggacggtctaaatattttatatttaaaaataattcataactttttcatgtgaactctaatgaagataaactttatatcaaacttgtagcccgcgacacgatctacaactttgtagttgaatttttttttattttaagtcatttttttcccaaaatgtaattttaaaattaaaattacaaaatctataaatatgcaataatattttgggaccctaaacagttttaattcaaaaacttttcaactacaaagttgtaggtcgcgtcgagagctacaattttgatataaagtttgtcttcattagagttaacatgaaaaagttatgaattattttttgatataaagtttttagaccgtcctgtttagggaccggggtgacataactgaacaagttggaggacctaaacgagtgatctgtatgtttagagaccggaatgataccgtcgaacaagtttgaggacctaaacggtcgatttgcaagtttagggatcagaatgacatagtggtataagtttagagaccggtgatgaattttactcttaattaaaatgaaaccgaagcgagtactatttaaaatgtgacggaggggcagtactccagtacatgcacagagccacagattccacggaaaaggtggcgccaccgccacctaacctggccgacaggcgtgaactggccatcatttcccggcccccaccctgccccggcacatcacgcgcccccacgcgattatcactcgcacccatctcatcaccgagtcaccggcaccggtcgcggacgcgtcgatcggtcccgaatactccctccgtaaaaaaaaaataaataaataaatcctggtttccgtgtccaattttaactgtccgtcttatataaaatttttttataatttgtatttttattattgttagatgataaaatataattaatattttatacgtgacttgtctttttaaatttttttataattttttcaaataagacggacagtcaaacattagatacggaaaccaggttttgtcttttttttttttttcgaacggagggactcggccgcgcgcgcactgccaaacctccccacgtctccgataggggagacgagacgagattccatcgcgcgctcgcgacgctccgctccccggtgcccggtccccatcaccgacaatcattgagacacgcacatgcagctaccgctgcagcgctgctatatactcccaatagttggccactgtgcgtgcgtggctgcgtgtgcttgcgctactgcttggtctcactgtgtgaacaactgctgccgccgcctgccggcggtgtgctccggccgcgcgcggtcgtgatggctgcacggcgagcgaactgcgcgctggtgctggtgctggcgctcgcgctgttggcggcgcgggatgctggtgccgcggcggtgcccaagcccaactggctgggcgggctgagccgcgccgcgttccccaagcggttcgtgttcgggacggccacgtccgcgtaccaggtcgagggcatggcggcgtccggcggccgcgggccgtccatctgggacgccttcgcgcacaccccgggtaaaactgcgattagtcgcttgctctactctacttttgctgtcactcagttttaactctgcttcttggcttcgaaactgtgattttcttttttccaaaccgctatggcagtttcggtattcaattacttacagttgcagtacaatacactacttagtgcccaaaaatatatatttcacaaatcacaactgttagtctactatacagcggccccgtttggatccggagggctattaaatagccctccggaatcttgctatttaaaagtattaaacgtaggttaatgacaaaacccattctataacccctaggctattttgcgagacgaatctaacgaggtatattaatccatgatttgctacagtaatgctacagcaatcagccgctaattatggattaatatacatcattagaatcgtctcgcaaaatagactaggggttatggaatcggttttatcggtaatctacgtttaataatcctaaatagcaagatttggaagggctatttaatagctcggaggatccaaacaaggccagcatctgagtaaagtactcaactcaacagccactagatgacagaatggtgacatacggctaaatgattatgacatttgtgaacgacagtgctacaattaagacacagcttgctagaattatgtgccaaattggaatgttgaacagcgaccaattcgatgtggaacgttgaccaatatctgtgcatctttatccttatatactccactacagtggtagctgaatactacttgagttttagtttaaactgacattcttgtagatcttgagccgtcaatcatgtgaattgtgatcaacttgtcaagctcacccataataatatattttttttattttacatttcaatgaacaggaaatgttgcaggaaatcagaatggagatgttgcgacagatcaatatcatcgctataaggtactagtccacagggtttacattaccgtcggtaaccgcgtggttaccgcggttactggccttaccgcggggtacggtaatagaaaaaccacgataacctccttaaattcaaataaatttaaaaaataatttaattttttgataaattttgcacggtttcgtacggtttttcacgattacagcggttaccgcacggtaaccgtgcttaccgccagggcacggtaaacccggccccggcggtttgggaaaccctgctagtacatcacaaagtcctctgcgttggtatgcctggcactaggcataactggttttttttattccatccggtcataaaaagtttgaccaaaccttatcctaaacgtcaaatattttttatcgaatggataaaccaaccatgcaacttttgaaaaaaaaagtagttttgtttggagtcctctagctaatttggtgcttttcctacttttacttccttttggggaggatggggctggggttgtatcttcctttggtaaatagaaagggcatgtgtgcccagatttgtctttcatcagataattgctcccccagatttgctaagtaaatgaaacttctgtacttcaagataacactacagatcacaaaacagctggtataatggcacatctctatgcattaataactgtaaatgctctaaaatatgcgtgtccaaggtcttacattacatgtaagtgtttccattctccattatctaaaaaaaaagtgtatccattctggaacaggaagatgttaatctcatgaaaagtttgaattttgatgcctaccggttttcaatctcatggtccaggatcttcccaggtacattgagtctgactcagattgtagcatgttgccctgataccctgcatcattttttttaatgacaatttgttactgccaaatatgcgcctttggtgtacctagatggtgagggacgagttaaccaagaaggcgtagcatattacaacaatcttataaactaccttctgcagaaaggtaccgcttgatctcatacttgaatcccctgcaaaagaaaaagatctcatacttgaaactttcaaacttccatggaaactgagtgctgtataactaaatatttccttcaaaccaagcaggtatcactccttatgtcaatctttaccactacgatctccctcttgcgcttgagaagaagtacggaggctggttgaatgcaaaaatggcgtaagtcaaattagtaatttatcctagctttttgtctgttaatctattagaactctcgtcatttgttggttattgacttattttagacttggttttaaacatagaagcacacatgataagtatgaatgcttgggacaaaattatcagtttcttaacacaaaaattcctgactaaaattggctccaattctagacaaatgacaattattatgaacgtgaaagttctattgttctgtcaaaagaaagctgcactgcattatgattattggtacctgttgtctagctaaatgcagcatcctgtatctctggcatcactagctgtataagtaacactctgaagtctggattatcttcatactacttgttctgtagggatctattcacggagtacgcggacttctgtttcaagacctttggcaatcgtgtcaagcactggtttacatttaatgagccaaggatagtagcacttcttggttatgaccaaggaacaaatcctcctaaaaggtgcacaaaatgcgctgctggtgggaactcagcaacagaaccatacattgttgctcataattttctcttatcacatgctgcagctgttgcaagataccggactaagtatcaggtattttttctcgacttgttttttagataatttaagctttattgaactcagtcaattacatcaaagtgatacaatcatactaagaacacttctgacctctgcacaacaaagatgcacacaaccaaaacacccacccacatactagtttgaaaagaaagaaaaaaaacagacaattaagggccaactgtttttttttaacggatatctcctactggccagtctaaatttgggaaatataatttcaaaaatgtaggcagctcagcaaggcaaagttggaatagttctggacttcaattggtatgaagctctttccaactcaactgaagaccaagcagcggctcaaagagccagggacttccacattggttggtaagaccataaagaatatcctctcagaaagcctattttttttagataatggaagctttattaatctcagtaaattctatcgagcttcattgaaaaagaattatcattgttaggattgctaacggttgcaatggtccaggtatcttgatccattgataaatggacattacccgcagataatgcaagatcttgtgaaagataggctgcccaagttcactcctgaacaagctagattggtcaagggctcggctgactatattggcatcaaccaatacacagctagctacatgaagggccagcaattgatgcagcagacaccgacgagttactcagccgattggcaggttacctatgtttgtgagttccttgcctcgcctcgccttgcgcttgtacatcagtatcgttgctagacatattctcctaaatattttatcccctaaattctgcagttgcgaaaaacggcaaaccaattggaccacaggtatgcagtaatcagttgtatccttctccagcttcagattcttctagcactgcattctactgacgtgaccaaactgataaattcagaagtaacataactcataaaacctttgttgatccatcgatctttacaggcaaattctaattggctttacatcgtgccatgggggatgtacggatgtgtgaactacatcaagcagaagtacgggaatccgacagtcgtcataactgaaaacggtagctctgaacttctcccatatccctccattcgattttccgctccatattgcacaatctgcgtgtaatccagaagtgatgaacatatcaacatattccatcttgtcatcaggaatggatcaacctgcgaacctcagccgcgaccagtacttgcgcgacaccacgagggttcatttctacaggagctacctcacccagctgaagaaggccatcgacgagggcgccaatgtggctggctacttcgcctggtctctcctggacaacttcgagtggctgtcaggttacacgtccaagtttggtatcgtctacgtcgacttcaacacgctcgagcgccaccccaaggcgtcggcctactggttcagggacatgctaaagcactgagaatgaaagacacgcagactgaagttgaagttgccatccattgatcatcatgttcagttctaggctgccgcttggatggcatcagagctggctatgaactatgtgatggaaataaaaggactgcaaattgattcgattatgcaattcgtgtctatgatcagaattgtggccgtctagtgaacttgtagaagtgtactcttgatgtgtgatcgatcttgagtaatcaatgtttgatcagatttcgccttataatttattagttgatgagatttggcttggtgattttataggaaactgttgtttgaagcgataggtttttgtattaaaaaaaaaggagttatttagccagttttctatgcaaaaattgaactgatctagcagcaacccaaaattaggcagagcgagtcctaaactacaagcgaaacaagctcattccgcggcaaacgcattgtggggcctcagcaagaaccacgtcgcagcatgcacgaaccgagcacgcgccattgtgcatgccagcctcgaccacacacgtacgcccgcgatcgcaagcacaccaccgcgccatcgcccgcgccgtacgttgccatcgcagcaccgccatggccacggcgcccgtcaagatcgtcgtcctcgccgccgcggtgtccgcggcggtggcgctcagcttcttctaccggttcaggtgcgtccacctgccgacgccgtacgtggccggcggcgggcggcggctgatcgtggtgtcgaaccagcaggaggtcggcgaggagatggacctcgcagacggcaacgtgcagctgctctgccacgggtacggcgagcacgaccacagccggtcggtgtggtcggcgcgcgccgacatccccggcggcgcggcggcgcgcctgtcgctgcccgccgtgcgcggcgacgaggtgttcgaggtgctgtgctcctaccgcggcgccaaccggtgctgggcgcacggcgtgcgcgtgttcgccaacccgggccacgacaacctcttctgctcggagcacgccggcggctgcgaggtgcggttccgcaaggacggcggcgtcgagaagcagtacggctccacctccacgccgctgatattcatgggcttcgtgccggacttcgacaacgccagggacggcgcctgcgcgtcgtcgagctgcgtcggcaggacgatcaacagggtgatcggccaggagagctgctgcgacgattcctgtgggggttgggagaaggcatcgcccaagaaatcatcatgaatccatccatgcaacacatgtagatcagtcggtaattacctgactttttgtatcatgtagatgtaatctaatcatacattaatggataggtaaaaaggacacctgaattgagtctcaatccaatgcaatcttggtacatgacaattcggtaatactagcgttctcttttctttaagaactgacgaacaaaacatagggcttcttttgaagtactccaaaaataaatagtctgtcaaaattcagaacttgtggcagttgcgttcctcagtacatcagcataggcaagggaataataggatctttaatcagagtcttcatagacgccctcatcatcagaaagctcatcaaaagaacgaatgtccagctgatagcgcaagatgccaccgatgccaccaaaacctctgcaaaactgtgacccctcctgggatttgttggtaacgaactcaagtgtgcatccgaactttttgtactcgttagcaaaccactccagaagggatgttttgtcctgaacttctaactcagcattggttgatgtgtcgcggaaattgctctgatcagcttcttgctctttgttcagatgttttattgcagtttctccagtagcactgttcttaagcacatatctgttgacatcaaggttttcccacactatcaatgtctcaacagcacccatttcaagagtcttaagggtgtcatcaacgccaaaaacgtacttcccggtatcttgactaatctcttcaaagtacttcccaatcaactttttctcctgtatgaacttcacattcgctagaatttcagctgataactcaatggcttggttgaaaccattttcaccaccataggaaacatcaacaacattaagtatcttggcttgaagacgctgatcaaacatgtcagattgactcagttctgtcttaaaatcagcagaaccagccaaaattagtccagaaacattaggctgactggtagctggattgatgaagaactgagtagcaagttcagccgtctttcggacatagttatgacgcttttccatccgaagccgagcaaaacgcagagcagattgccctcctcttccatgtttctttgggagatctacagtgaatttgtgaaggatctcacgagtattgccactcagtgtgccgaaaagagttccattaccatccataacaataaagccaaacttgtcatcggattccaagagctcattcaaagcttcggtgtggaatttgttgtcacagagatacaacgatgcattgatgggcttgaatggttcaaaatcaatagtgactttcttttccttgccatcttcagtaacaattgttcctgtgtagaggacgagtccatttggcggaaccttgttgtacagcttcagcctctgttgagctgatgtgatggctgccaaaacagattgtcgattgactctactcttgatgtttgaagcagtaccatattcatcacccagcatcttggtcacacgggagacttgatcacgtgggggcataatcagagagatcatgcttgtgccattgcctctagcagactccagtgccttgatcaacttcttaatcttccaaatctcaatattcttgtcagtttcttgaccatctgacatcttgacaaaattaggatgcttgattcacctgcagaataccaaattcaaatattagtaacaaacccgagagacagaattcagagctgtcaaatacaaggaaataacaaaaaaaaaaggttgatgaattttttttagactagaatacactatctagtgtctagtaaactgatcgtagctgctcccttacaaaacaagagtgctctatccaacgtcatccaagacaaagctattagcttatgaaagttgccacgcaataattcttaacactacaagcgttaaatccaatctgcaatttgtatcaatttttgtgtataatataaatgtagtttgtatttaagtggacataagccacggcaacaagccatggacaatcatacatgactacatgactggcctataaggccataacatgtgctgcttcttcacaagtgaagcatttacgacatggtggttagagcaaccataaatccataggaatggtcgccaatgacttgtgctcacaagaaataagaggaaaaccagttccttaaataaagaataggaaaaatttaaaatcagaactatccatactaactgagttactaggtttaacacaaagaaaataaacaatcatatcaaaatgtggtctgcagcaatcatttacttctagctgaaatagaacagaaaaatcattggtggtagtctctatatttataccaacatataatacagaaacaaaactctctccatacttggatggccattttggaacataggagtaagtcataaacaatcatttctaggtcaattgcatagtatggtaaacacaaaaccaagagttctgggtagacagaaccagaacaaggctgagggtcatccaaataggtttagcgactcaaaccacaattttgtcaggtcacgtcctgtgtcccttactcagttcctagtgatcatgagttgtttggtcatttcatattccgtaccaaaatgggcctttctagttctagtttgcaagcaacatggattagatttttggctggtaaagaattactcatcaaagttaaacctagcacatcaagctattatcaaagaattggaactttagtcaaccaatttagcttgaaaaggacagtaaggacaccatccaaaatggttagtgctgatgatgctaattggacatttgggacaattacaaatcagtggcggatctaacatgggacatggggtttcagttaaacccccaaacttcttgcgaaccatcaagctgttattagtactaaggttgagttaaatttctagaacagaagctagggttaacgcaaattcgagaaaaagtgcgtgggtagagagagagagatgggaaagaggacgtgcgtaacggatgcggcggaagcagcaggaggaacgacggcgaccctatgcgctcgctcgcgcgatggatggggatcgacgcaggcggcggtggcggaggatgtgctcaccaggatggatgcggcggaagcagcaggacgaacgattgcggccttcttcgctcgcgggatggatggggatcggcggaggcacagggggcgggggcgggggcgggggcggcggtgggcaagggcaaactgacgaggggtcagggtaactcacgcacgacagaagagtcaaaatggcgagggtaacttagtaatttctcgcatcaattcacccggattgcacacccatcccatctccaacctagctagacggtcgaaatctgaaaaatgaaaataatatccattcgtcctaatctcatttttcagatggagtctctagtttaacccttgagacggtagattttttttaatagaataagattgagatggtggataaataataaatatgtttggacattgtccaattaggcatggctcaccgaatgagtcgtgttgtgtcgatccacgtggtaaggctggagcctaggcatggtctagtgagatgtcgggttatgttgtgttggcctggcacaattagggtacatgtgttatgtggagaccgcttagcccaaatttgatatataccgagaaaaagaatacgaacagaggctattacatcctactgcacaaactccgatgaagctctagtgaggtcctccgctcaccgatagcatattcctcttcctcctcatcaagcactgtcgtggcccttcactttctacttccttcacaccgagctagtgaacgcctaatgaccaacatgcttagcggttgtgctcacaaatgtggttggccacgccaccacattgtcatgtaggcttacatcgatgagcgtctaccactgcttcctctgcctcgagcccctagcttcttctattcttacattctcctttcttcctagctcctgctcggatggcattatggtagtttctcaattggcggttgttcgccagtcgtcggtcatcatcgtgccgcatggaccatgccatgtcgtgctattcctgggccatgtcgtgctgtctcactacatgcatttgtcatgtaggcatgtcgagccagatagcaatccaagcatggtgtggctagacgggtcgtgccaacgcaacccatacccaaacagatcgtgcgattcctggactgtaaacggcacatgcgtgcctgggcggataagaaaagacctagcccatttgacaacctataggaggatttagcaaactcatagtcgttcctctgtttcttcggatgaaatcaagtaagacaactcagacactccaaaataatttgattagtgttaaattaaagggaactttaaatttttaaaaagatattcccttccatgatagcgattacactccaaccaacactaaacttacatgaggttggatcaaatcgaaccgagctgcaagggagcggagacggagcgggagcgggagcgggagacggagcaagggttttacctagaggtagggtgtgcgagggaagataactatctaggcaggtagacggctctcgtctgacgttccccttcggctacctctagggctgcaaagagagccatattcttccactactacactgcaagtggaataataccaataataacgggacaaaaggaagtggaatggactagtgtctagtggtggcaatggttagatacttttcgattgcagaaattttacagctttaaatctaatttctctaaaattcttcgttccaaaataagtgataacccaaagatggatctccagtatccataacagccgaaagatatgagaccagaagcaaacataagtatccacttcacaagtcagattgtcacaacttctgctacatactctatgtgtctaaaaaaacaatttaggctaggcaagaatgagacatagcatagcataatgaatctggacatgatattattcagatttgttgtattaggtatatcctttcattgtctaggtttttttttttatcggagggagtactttgttcgccgacctgcgaacttgggttctatcacagccacaaatccaacatatgccggtggagaatggaggctgactagccccgtgcaaaagtgcattgcgtagtcaacgtggatttgtggatcgcaatcgttcctttccagcgacaaaacagcacaatttttgagctcacatcgcacccgtccacaatttttgagctcacgtcgcaatcgttcctttccagcgacaaaaacagcacaatactggattcgggtcaacgtggtaacgaaagatacattgatcataggccatagcggcggttcattgataatagcggtagcttatcggaaggtaggaattttacagcaatcggtgaaattatcgtcgagatgagatattcagatacacccatggtgcttgctgtagtacagagacggaaaatggaacaaaatatccagaaacggaaacaaaactgcaatacaaattagcatctataaaatgctttacatcgtctatggtctgctaaacattttcaatatgctgggttaataagcaatatatatctaacgcaactaccaaattgatcccaagtactggtcaaacatttgaccctatccctgcacttttctctacttcatctccaggtgtctggccaatacacattcagttccaactagcaaaatataccaaggtgaatgcaggactattcaccagagcttctaatatggctatagtttatcatcctaatacctctttcagactccccaggaggaaagctggttaatctggggcaaagtttgctccctcaactaactcaaaacttcagaaaatgatggtcatctgctattgaagctgccagtttgtgtccgggtaacataggagaggcgtgaagaaggaatcaaaggggcttcttcatcaacccctgcaccttctgacgccagacttccaacagtggtttcatcattagaatccatgaaattgtcaggcttgtatatgtttgaaatcttcttatcctgcaaaaagttgaacatttcaacagttatgtgacttgtaagtacaagaaaaatgagcaatcatttggttttgcctattatcaaagttacgccaagtaaagtattaaacaaaattggaagctccaatactatatttacgtggtatctgatttgttgacacgggagaaccaaacttcatggagtaataaaatgttgtggttaggtggacaacgcaacagccacccatatgatacaaattggaactgcaattgctatagtagtggaagctatggtactaaaaggtaaccatttttagacaataacttggtgttgtgtgacaacaacgcaatgcgtaatagcagttttttttatgcaaccgataacaagggcagagacaagcaaagaacaagataagaaagtcataactggaacaatattgtactataaagtagtgatacatcatacatgaaagatctctatggatgaacatgttcaagaggaagaccacaaagaatcaagatatctaaataaagtaagtgcagagaaagtcgtactctgaccttcgtagctctgtcaggagcgatatcagctggaagttggttcgctctgacatctttcatcttcaaataattgtacatgacaacgccagagagagctacacattaaagcaatactaattaagaaggttaatcacaaacaacatatttgaaataaaagtataagcaaatttcacaagccccggatttatgtccctttgtaactcaaaagaacatgttagtatgttacacatgttaacataaccccatgtttatgctatgcaatggaacacaaaaccacaggttaagattatagatatagattctacttctagagaaaattgaatggataattaccaacagcatatccaattatattgaggcttgtaataatagattcaggaaagataatggttgagagggcaatgagtatccagtccttcagaactcctgcgactcggatggtgactgctcctgttcttccaataactagaaagatggatatgttcaatgcaaatgcagcaactgcattaaagaaaaatatccagtagttgaactgaatttgagaaacatccatttctggcttttcaagtaaaaaccaaggaacaaacaggaagatgaaactgcaaaacagaagaatacatataagaaattgcagagagtaaaatggcacaaacattttagtgacatatagaatatgcaaagcttagttgtatggagacaaaaacagtgcataataatcacagaggctacagaagaaaaaccagtgagtgcaaaagttgaggcagcaaatggttgttcctaagtcctaacaaactactttctgcttctcaacaagaaaccacacatataagtcttacagacagatgccataaacctctcgaatgctcttgttgcctaatacatgcaatctaatacgacgaatatacatttcaaatctgttcttttatttattcattcaaacaactgaggttagaaactactacaaatgaagaacagtgttctcttcataaatgtcataggaaaaccaattgtgttataagttttagtgatttttatttacatgtgtacattacaacagcacttgcacaataaagtagcactagcaccatttggttgtacatattatataaatccaagtcattaatatcactaatggaacctcaagaaaatggcagtttacatgttttttataagagcaaactaaaaaattctctttgtttttcgtacaagtattctgtaagactttaagagagaagtcgttatttcattcaacggtagttggttgaaatcatatcaagcaagcaaacttttcagatatagttgcaatacctgcaaggggctatataatataggcttgtgatagggtttagagttaaccccttcttttgaaggaggacctgtgtcagaaccagcctgagggcttccgcaaaaatgcctgttacttggtataatgttcctatgatattaaaatgaatctcgccatatgatgaaactacgacaccaacactgaccaagaccatgttcaagaaaagatcccatcttaatttgtcagtaccacatagaacagccattataaatgttgccacaggcactgcattacaaagtaacacaaatcagtaccagaaatgataaattgatttacagggagtttcatggtaactcactcaaggccttgagcatctgaatgaaggcgactgaaatatacaagtatgctgtgtttccaaacctgtaaaaataatcaaatcaattaaagtattgttagaattttatgcaagggaaactcattcttcatacacatgattcaagataactttacaggagaagtagcaaatttccaaatattcatatacagtaaatgctgtatgggggttaataaaggaaactaatagtatagttcacatactgagataagatactactgtccggtattaacaaaaatagagtttgcatactgtgccccatttgcaaaaataaccaaagtattagaacacattatacacatacagagcatgcatttgttaattcacatcgcaattacacataatacacaaaccattctattcaagttatggtatacatggcaaatagtacacacagaacagctaggtttgaaaacaatctcaatagcaaaaactttatcaattcaaagcaatcaatcaggtcatcataaaatatcaaaactgcaagtatcatgccatttgtgtaatgttgatagtcagctttagatcaatgcatttaacattttaggcctacatatatcacatacatgagtgcatatgctttcaaagccatgctttctcatacaggagataataaagaagtgatcgaggaaaaaaatgaaatgaaagatggttccatatcttgtctatgtttagcttaccaaagacttgacgcgaagaaggcactaattggaatcacacatgtggcatatctgcattaagtgaaagaaatgactaagaatcaaattccacacagtgaatgacaaagttaagtgctcttacatttggaatgtcatcttgactggtgcaacgacctgcatcaccaacatagcaagatgactccattagctcttacaggaaaaaccaaatgacagcaccagacaaactacaaacttaaagcttcaatacagaaactaccttgcctattcttgcataagaacagtttctattcgacaatcaacactttgtatgccatttggttgaaagttacaacaagcaagtaatccagtgtgcatcgaacatggaaggaggtaataggaaaattggcacaaagaagcataccttaaacacacggacaaggaagaacgttacgactccagaaaacgccatgtgaatcattgtaagggtaataggaaagggaaatttgaagtactttggagaaagtacccactgcaaaaataggaaaaatgagagcattaagttcatagtcagcgtggcctctcataattaaacatctacttacatccaagcaagcatatagcaccgcaaaaaaaataatatgcaaagccccagatctgcattatcagcatccatcaccgacattcgtcaaatccgttacgctttgagcccacattatactacagatgacagtgtgctgtaccaagaaccctgattcacctaacaaccctaaaatcctacagaaagcaaagcattgtaatagaccgtccaccaaactaacggatatagcaattaaagtagcactcactcatattgcagttctccaaaccacattagaagtgaagtcgttcaaggagcaaacactacacaaaagacactgcgaacaaaatggacctcagatcatcgcattcctcgatttcttctctagcccagagcaaacgcaaaaaagcaaaagcatacacgcaggtagagcgaatcgcaaccggcatttcgaaggaggagaagccctaccttgttgaacaggatgactcccgacgagaggcagacgtagattagcaggtagaggtaggtcagcacgagctgcctgctgatcatcatcgcccccgcctccggcgcccggttcacctcgcgttcctcctggggttcggttcactcccggggccaggcggcttcggcggccgcggcggagggccggtgcggcggcgagtcggcgcggcggtgggggaggagtggagtgggcgcgcgaaccatagatctgggacgcgtgcggcgcctctctcggattggaagattgggggaggaaggaaggaagggatcgagagggggagggggtcagggggaggactgaaatgagatggtgggagacctggcagggtcttttctgcaaaaagtgggattaattagcgcagtgctgtttcgggcccacatgtctgtcactgatccacgcgtttctaatttattgttttctgcttgactatgcggtggttaggatttagggggataattgtcgtggtttgcaggcctaaaaaattgcgtacgggtttggaattatttttgttttgttttgttttgctccctaccttttgcagcgtgcgatgataacactggatggagtaaaatttcataggttagagtgaatttcacgttgaactctatgtattttgttaccataagtctcaaaatatgaaccgtttaactcatattttcaatttaggccctcctttttttcactttgatttttttttctcaacattgttttcatctagtagacgatgatgattttggcatggcggtggaaacaagagaagaaatgtatccaatttgaaactaaaaggtaagaaaattagatccattgtaaaaaaaatggaataaagggaatccaaggtttcttttaactaaagaaggtcgaaggtgaaatctactctaatttaaatatgcgtgtataagactatcatgacgaaactatataatactccctccatgcacaaaagttacacatattactattgtcacaaagaccaaggagaaattaaattacctttgatgttataaaatcaaagagtgaatgcaagcatgtaatcaatgagtatttagatgactccttggattctaataaaacatttaatttatctcttcatctaagtcttgaatgcatagagactacaaataggaataacttatttggaaaaagtcaaatatgaaataggtctaacttttgtggatggagggagtaccaaataatggattgagcaattaatatttaagtgcccatattcaaccaattttatcatatttttatgggaacataaaactaatacataaaatttctaaaataagtagattttctgtaaatcgattttaagtctataatttgtaatcttatggcttatacatctttagtctgcgaaaagtattttaccttaaaagtttgtgacaaaatcgataaaattttaccaaagtataagcagtttgctatattgttataacttatcccttaagacacgacaacccattttgccaataaacacaagacgcaaagacgtgccaactccacagttgatagtccagatcaaaagttttcagagcacatcatcttccacgtggaaaatccacacatgacaacgccatcaggagatggaagaacatgatttttttttccactgtccgtcaacaatagagtatgtgtcacactgactggactagatactctctgtttcggggtgagaggttgggaacctctcaacgtgcatgtaaaaccagtagcgtagctagaatttaaagtaaatgtggtccatttatatgtaatatgttaattaaaatagtggtcaactatacaatttttattatattaactagcacatatactataattttaaatttttaggtggtccatggaccacgatgccacctagctggctacgccactatgtaaaacaggttacttattaacataacatatgattagttaggtgttatctgaaaaacttaaaatatatattaatataatttttataccaactttcatgtatattttttctaaaaaacacgttatttagtagttcggaaagatatgcacgcgaaaaacaatggaataatggttgggaaatgggaagactcccaacactatcatctggccgagttcggttaccacctctccccaacctttacttcctcattttccgtttacacatttttctaaactgctaaacggagtgttttttttaagtttttttgaaagttattttaaaaatcatgttaatattttattttattttatttaactagtgtttaatttatcaataataaacacttcattttatgagtggggaggtggagtttcaacctccgccctctaacaatagaccagtcggcagagcaactcaccccatttccccttgtaattttcaggtccattctgtactgtagtctgttataaaactagccccaaaatcgacatcggtagctaaacgtggaagaaaacgccataggagatccaaaacgatagcgacaccgaggcacgatatttggtaacggagttcagccgtagcctacatctccggggcactgattacgggcactcctccccgatccagcatatacaacgtatcagagttacaacgactcacggccggtcgccgccggcagccgctccctctcgctatgctaagtcaccatgcggttacaacaggcacggccctctatttatgagagaacctaggatagagtccgactcatactctagtcctaatacctattacaactccaagtcctaaactgtaatcgactatgtacacatattcaacacaaactctaacacagtctgcaggctacagccacacactctggatttggttagtctttgtccttactactagtatgactgaagatattctatatatctatgcttaaggccataataatatatcacttcttcgccgttagctagctaatctacatagactaagtagtgtggtcgttgtcaaacattaattaatcttgtagtcaaaatgtctactttatacaacgtacccaacggagaacggaccatcgagcatcgaatgagggggtgtttgaaccggtagaacatccaaaagagaatctattacgctagagcccttttccgccctcactaggaagttggaacacagaaatttcatgataattttataggatttttatcataatgaattctcgtatttagaggaggccaaagaaagaaccatatgaattattatattaatatatttcaaataggcccaaaaaaataaagcaaattaagagcctaaggttctcttgggagctgggaggtcgcaggtttcatcttttccttaatgtcatagtcatagcactgaacatggtattgtctctaagttgtgattcgtcgacaaaatatgagcagaaacgccggagagaagagagtgagttgcctccccgtgaacaattgaattaagcaagcaaatcaagaaagattattgaccgtccattcaattaataacacataaatcatccaacaaaaagtatttcgaggtaccgatacgttacggtaccaaattgttttcgatcattaaatctaacaatgcacatctatccaattagatctaacgaacgggttacatgaccgaggattagactccatacacaattacacacaagttttccaactaccggaattcgaaccagagcgagagtgcagcagacttgcaaaactaaagaaatcactcctttttataataaaaaaaatcaagaaaaatcactcaaggagtgcaacaaaagtaagcagcagtgacgtcggaagcactggcctccgaatattttaccgtccgactccgactccgactcagaaagggcccaaccgttccacataagctaacgaccgggtaccgccacggcccactcacgtccccccgctctctcgtcgtgttcaagtcgcgagcgcgagtttctccgtaagctacaaggacttgacctgggaacccgcctaattgccactcattaatccttttcttttcctcggtcagtttagagtacggattagtagactgaatccactaacccctagcgctgttgcatattaacaagctcataaattcttagccccatacgcatagaaggagtagtgttgcacgctcgcaccggtgcacgttggtggatcgatcgatctccatggcggcgcttcaccaccaccaccaccaccacagccaccagatcaaggcgccggcgccgacttggctcatcgtgaaggctaccccgccgccgagggacggggccaagaagctggccgcggcggcgtactcgccgctcctgctgtcgccgtccgtgtggcagaaggcgcaggacgccaagaagggcaaggcggacggcggcgacggcgccctcccggcgtcaccgaggatcacctgcatggggcaggtcaaggggaggccgaggagatgctcgggcgcgcgccgcggcgaccgtccggccgcgagggccggtagctcgggtctactggagcggctcacgctggggctgttcgggcggcggcggagggggaggacgtcgtcgcgggcgtgctccaaggtcagggacgtgccgacctgctcgtcggcgcagtcgcgggggaagatttattgcggccgcggcggcgcggcggcggtgtgcacgcttgacccgccgttgccggtggtgatcaggcggcccgcggcggacgacgaagcgccgacgctctgggagaggcggcgcggcggcggcgggaaggccctggagactctccggttaacgtagatcgctggctcgctgcagagttgcgcttggcaaccgcagcccgccggtgagtatattgacagaggaggccaaagacaaggaggcaacggacgacttcagccgaaggctacggatgcggatgctaatttcctaaaaatttgtccataataccatgtatgtttacagtttaatcatttctttttgctaatttgtatagttgtatctacttgtatgttgatcctactgtccattttaaaagtcttgtctctacgatttggaagctcgcccctttttttctccccacatatcttctccatccccttcactaaggcatctcctcccaaggtctctaggacgctcccggtggctctgcctccgaaacactcacgtacttgctcccgccatatcagtcctaccatgggtaggatgttgggagcggcgggctgcaatctaagtgaatcattaagtgtattatcatctctgtcaattctttttctctatagtttctacaaatagattattttgctggtttgctgatttttcctacttcagatacaggaacaaaaaaaaaagaagagatatctttgtttccaaggagatgactgaatcgaacccttccaattgttgtatgggaacacatatttgatattcagactaattgtttcgtatgcttgctggattggcattgaattgttaataccatatcatcattcttgacaagtctttactcatgtgcagcactgacaacacatattcacagtatcaagtcgtccaaattagccatgataaggtacagcatagtttgatttgcatagctccttactgtcagcaaagttgttctattgaatttactttctttttagtgaacctgaaaacgtcgataaggggcaccagccaattgctgattaaatttttgcctttgtaaactcatattcagattttcaatgaatgattcatatcaacctatctggttttctgttattaccacaatatttatgaccattaattcacgatatatattggaaaactatctacttcgcgcttcagtttgacaaattcagaccttattatataagctataatgatgagtaataaagggcaagagctgaaattagcatttctatatcatactataatggaagcactaagaacatatcattcagctttgataataattagaaataaaaacatttgtctaagcgaaagatgttttaaggtgcaagaaagaacatacgcatcctcacaataattcgtcaatttaattcagcaagggacagtgcttctcacttattgagttgaaaaaaaatatatatctagaagtgctaaactcatgctggcctcatgtcaaaatggtgttagttcaatttcaattgttagctgagtcacacaggaggaagcaggctgctcaactcaagatggaggaaaccattcttttgtgcgtgtgacaaatatgtagattctataattagcctcttatttgatcctaccatgggtggaggagattcctatataaaaaacttcagtacagtcacagttgttggaaacagaggcacagctcttccgcaaaaatatgctgattgtggaattcacgaatttttgtttgtctgaatagtgcaaaagaacataaacgagataaaggaaccacttaatttcaaagccattgttaagtctgaacaatattattagtataactttcaatagaaggtcgattatatgttccaaataggacatggaactttgtcaaagagctttgaattgatgacgggttggctgaatactttagcactacatatacatgcaatctctaatgttgtactgattaatctttctacaaattcttgaaaattcaaaaagaaaagtgtcaattgctacttggtgtttttttagcaagcactcttttctgaaagatctacaacacaaaaaggggctctcattcatgaagaaagagcgggacgcactacccttgggttttactgcctctcgtagtcctgcctcaggaacttcaggtattctcctttctccacctccttagcgcatatttgatctgataatattgctgccttgctggtatatatcactgaagtatgtctcctcctacaggagaagaggctgctgcaaaacgtacggcagttccaggtccctctgcagcgttacatggtccttatggaggttcaggtgagctacatacttattgcagctaactaagcaaatatgtcatgttcttcttgtggatgatcagtttgaagaagagaaatgagtggattcactgacagcaagacaactacaacactgccgccaattatcttaaaccaacgatcaggtttaataagagtttctttgattttgagtgtaatagttgactgatttcatcttgcctttttcacttgcaagctcaactaatgctctttgttaaaaccatgtttgatatgtaatggtccacgtatacatgcttcttaaacagacatcttcagtcgcgcaaagtgcgaccgaagatgagatgccctgctctccagaatcaagattatcctgaaatcaactgaatcagactaatgagcatgtggcctttaccgtttggacagcaaaggcgccaatggcctcggtggcgagtgcctgcccgagtataattaactgtacaccattttgatctgttgagttaagtaccttctctaaagcatctaattatagtaatatttgttattaagatataaaagaaataccaaaactaattagtacaaataatatgcaaatacatttagaacacagtcagacatggatacatttagaactactcctttcgaactgataatattagtcgttttgaataaggataaagtcaaattttaaaatctttaactataaataatttctaaaatatttatgttaaaaatatggaaaccatatgtgtagattagttttaaaaagtacttcaataaaatcatatatttgttgatattcctatatatactaaatagaaaataattatcaaagctattttttttggataccgtgctcttgtaaaaaaggacaagtataatcaagccggagggagtagttctgtttgtacttcacttaacgtgaaggtgcgctaggccgccagttgggcctgtgctagctttcacaaaagaattaggcccaaaatctaaacaacgcccaccaacgggaacaagacggccgacgaagggaaccgattgaaaactatggctggctggctggctgcctgcctccttcgccgcataggactcgcagtcccggtggatccccaccgaattaactcccacgagcagccggtccccgcgtcatttacaagttcaccccggtagccgcccgaatggggaagagacaagcaatgccggccccgctacactcgggtcgtcgaatcagcgagaaaaatcgacacttgcactgtgtagaagcacacagttttgtgttttctggatagtaggagtatttttcgatctgaaccaaacaagcacataaccaaaacctcaaaacatgtgtagccaagttggctagctttcaccgagtacagtatataccctactacggatattggccgtctgaattgttcttcagctcattccaagacgtcaaatgctggacaaattcatcgatgcacctctcttcgcgctccctgtccgccacgatctcctgcagcttccgggcattggcgaagaacgtcttcccctcttcctccaccacgacggcgcggacggctccggcgacgccgcctcggtcgaacgacccgtcctcgtcgttcctcggcaccgccactccgagcttcctcccctcgagaatccgcgcgttcgggccttggtcgcctaagatcggcagcatgatcagcgggtgcccgaactggagcccctcgacgacggagccccacccgcagtgcgtcaggaacgcgcacacggcggcgtgcgccagtatgctcacctgaggagcccaccgcgtcgtgaccagcccgcgctcgccggtgcggcccaggaaccccgctggtaggacgctgtccgcgtcgacgccggcgggcttcctcatggcccagaggaagcgcgtcccggcgaggtccagcccgtgagccagctcgcgcagcaggtccgcgctcatcggcgcctcgcttcccagcgcgacgtagacgaccgacttggccggctgagcgtcgagccactgcatgattgcgtcgtgcttgccgttcttgctgacgccgcgggcgccgtccggccgtggcgggagcaggccgaacgggacgaccggcttgccgtagaacctcgtcaggatcgtgaacgcgccgggctccagctcggggcagctccgcattgcgacgagcttggacctctgcagcgtcaggctgtagcgggtcatgatggacacccccgaggcgccttccgtcgcgaactcctccgtggcgcgcttcgcctcgaagctcggcgccgccgtgcccatggaccggactatcgcctcgcgctggtccgcgctcgactcggttggcggagcagacgaggccacgacggctgcggagcaggggaggatcatggcgcacggcaccccgcgctcctgagatgccagagcgacccagtgatgcatgagatcggcgagaacccaatccggcctcttgccgccggcgcacgcggtgtcgaggaacgcggagaacggcgcggcgagcccgtcgaacgccttcctgtgaagctcgaacttgtcgaacgggacgtcgctggtggcctcggcgccgtcggggagcccgtcgacgcgcggcagtgggagcgccacgaggtcgacgagctctgccagctcggggcgaaccggcgggaggcgggcgaggttgcgcggggtggagacgaaggacacgcggtggccgcgcgcggcgaggcgctcggcgaggtcaaggcaggggagcaggtggccgaaggcgagccacgggaagatgacgacgtgcagcggcgactgcgaggaatgggcgtcgtccattttcggccggcgcgcaccggtcagcactcaggcgtcagcgtgtgtgtgagaagtttggctctgatgatccagtcatgagtgtatagggagtactccgtatgcaaatcgtgctagttaaaggggagaaaacgaggaaagattcccgaacgcgatgcgtattgtcgagcccagccgagtgcgaggcagccgggactactcatctcctccctccatctactacctccctcaaaaaaaaaaaaaacttttatccagattcattattttaggaggaaacccctccttagagcaggtataatagagtatgataagccagcgatacaagcatccatattatagaaatcataggtggaagagagagaaaaccggagagagaaggcagcgggcgccaatgcaatcgtcgagctccagcacaggaaacgatgcaaagtcctgagaaccagccctcagtcctagtcctagcttttgcccaatgactcaaccattactccatcatagcaagttcaatagtagagttaactgccggctctaaaattcaccacatcatttaagagataactaaaccccagtagatacatcaattggctacacccatgctttaaccaaggcatcctgtcaggtgttggtaacttctgcatgttcaagttctaattttctattggttgtcccgagctgcaaggggccagagtgcctaggcgcttgtgcttgagccagcgactggattgtcgtccgctttgctctctttgctttctctctctctatcatatatgttaaaatattagataagcaggctattagcccactattgtacctgctctcaaagattgggaagaaggaaacaagtctgattaaaataataaaaatcaactgcttagggatgtgtgggtaggtaacttagcagctagttattatacgtatcatctattggtaccatctattacttacgtgtacaaattttcagcccatcaacgggcgatactattaaacttgctcttagagcaggtacaatagcaggctattagccagctgtaaatatattttaataagataaaagatgagagaagagcagcgggctacagatctgtagccagctgtagcgcggactccaagacgcaatgtgtatatgacaggtgggaccatatattaatagtatagtaagtaactattgtatgaattaactactagattaactataaatgaattagagctagtgctggactatactattaaacttgctctaaattgagttattttggtatcaaaggagattttgactttctgagccgtgcaggtcgattacttgcttgtgtgggccggccatcggatgagcgcctcatccacgcgtcatgaatccgcgtcgggagtcgggactgcacgggctgctgtttggaattttttttatttataattttttttattaaaagttttacaaaaataattttccattttgaaaattgacggaagtagtcgcctaccgccgccctcccagagggcggcgaaaatgacgcggcagccggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctgggggagggcgattttatactgtgctctatatttttgtataaatatcaatagttatcaaatctttttatattgaaaactatacaagattaaaatctccaagactggtaaaatacaattttattattttttaggtcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgttgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggctaacccgtcctgcctgtacaggtgtgacctctggctgctctgagtgtgcgcctctggagctcctccaagctgagaggagcctacttccgtcaattttcaaaatggaaaattatttttgtaaaacttttaataaaaaaaattataaataaaaaaaattcctgctgtttgcaccccgtctgcaccagattttttttccgcagattggcagctgcggtagtgacatgtgggccctgggccgcacgttggttacggccgaggagttgcttcttcgggaccgaaacctatgtgcaatgggattttttttttcatttttagatttttttaaaatatttacagaaataatctatcggccaaaaaaattgtaaaactagaccctgccgcccatctctgaggcggcaagctgacgtggcaaacggggaaggaacgggcggtgacggagggagggtttttttgcaggaaagcccttgccaccctctgttgaggtggcaaggggcctgaatgcaaaaaaaccagtcggggccggtcattttgcaggcggccccttgccgccctttggccgggcggcaggcctcgctgcctataaaaggcatgctggccagccctcagccctcattcctcccccctcaaatccagtgaaaaaaaaagaagaaaggggaggagaagagaagaaggggcgaagccctgccggattcagacgccgatttcaggtaatattcatatatcctatatgtgactatagagttaaatattgtgtattttttaaaactttgtttgaataaatgcattatatttttagggttttatctgtactaatctagaagtgcgtattgtagatatcggtaactacgtagatctgctagtttggaatcaatactttaccgttgcattggcatacacaagaagatattacgttgtagatgtttattgcatgaaagagtaatatgatctagttatttcgttgacagatatgtcgaacaaacaaatattccaagtttaccatggcccaggaaacgtccgttacgggccaactggggtagatctgtcagattttattgtatcagaaaggggaattgatagaccggctgagaggagtgtaccttctataaaaggatggttaatgaggggcttgagagttgatccatagacaagtgacataacaatcaatgttatagtaagtcgggcaactgagggtttttattgggaactaatgccggttcaaaactctcaattgtggagatggtatgtggaaaatgcattgcaacgcgggtggcctctagctatggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtggagtggccgacgagggggaaactgtcggtgccattgtggatgaaatggagagggaggattctgacaacgagcgtgtagaggaaggtgattcgtcagatgatgagacggatattaatccagcagaatgggctagtgaggatttttctgggctggtcgtctctgaagaggatagtgtgagatgggagtacaaagaaaatgaggttatccagggagcgatttatagtagagcagaagatatgaaggaggcggtaaaacattttgtagtgtcacttcatagagagttttgggttgccaagtccaaccggtcgcaatatgaagttcggtgtgttaaggaaaaagatggttgtccctggagagtgcacgcgtataaggggaaatggaaggattattggatactgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctaggagctcttacgcagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccctggtgtttgggaagatgtacagagtaggtggtgaatgcatcatatgggagctaatttctttcttcaagcaattcaagaacaaggagctcatgaacatgttcaagaggctatgtaatcagaactaggagaaaaaaatcaatgagctttggaagagattagatgagttgacagccaaatgcagtgatcagcgtgcagcggctccatcgaccgccgttgctaaccctcctcaagctcttggacctctcccaacgaatagtccaacattggttagaagaactggattggagattcggaaattttctcagtagattatgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcagttattttagggatcggttccaagcagttcttccctctataccgaacaacagcattttgtttggaactttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgacacatgtcattgctcttatgcaaagccgaagctgctccacaggccatgcacccatgtcattgctgccgcaacggagtgtggcataccagatgcagtatatgtgtcacagtactttaataagcaagcaatatatcatacatggagcggcgagatttatgggttcggcatagctggggagttcacagagactaacgatgaagtactcaatattcctgacccatcgaagctccgaggcaaggctggaaggaggaagactcgtcgcatccacaacgatatggacgagtcggaggctggcagggtgaagcgttgcagcaaatgcgatgaacgtgggcacacctacaagcactgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctacgtggtgtagttcttatgttctatgttggcatgtggatttgcttgtaatttgtttcaaacttatcgatgtgtttatgttttgtcgtgtaatgtcagacttcggcatgtcatgtctttaggtctcgtgatgtaacgtcagactaaggcacctaatgtctttaggtatgctgatgtaatgtcggacttcgacacgtaatgttatgttatgttatgttatgttatattatcgaactctacatatatgttaaattgcacgtcatcgttatgtacccttatgtaacatcctgaaaattcaagacaatgaaaatcacgaaaattttgaactttttaaaacttttgcatcatgctggttgttatgattgctattgcttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctatgtatatataatagaattacgggagtatttaattcgatatgtagatcgattttgcaccaagttcctaattgcatttagggattgaaatttgatatattaaacccctccatataaaataaactaacatataaataaattgagctaatgtgctattgtgttaataacggtctcattagaaaattatagaatctttaataaaccttaaatattggacaatattaaattttgggcaaattcacatttgaacacttaatacggtcacctaaatgcttaggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttcatttatacaaaatctaggatttatagaatcaaatttacacaagaaataggctaaaatggggattaaataggaaaagacactattcatcggccgccaggtgttcgatgtggtcccctaacccagcccctccgctttccccctctctctgtcgcctgccaccgcgccgacgtcgccatcgccgtccctgccccgcgctgccgtcgccgtcactgcctcgcgccgcgcgccaccgctgccacgccgccccgcgcccgcgccccacgccgcgccgcctgcccgtcgcgttgccgttgccgcgccgcgcgccgtcgccgtcactgcctcgcgccgccgctgtcacgccgtcctgcgcccgcgcgtcgcgtccgtcgtgtcgccgtcgtctcgagccccgcgccgccctgtcgccatcgccgcgcgccgagccccgtgccgcgccgcgccgtcccgtcgccgcgtcgccgtcccgtcgacgctccgccgtcgtcgtcgcgtcgcccgtcgccctcaccgcgcgccgagccgtgcgccgccccgagccccgcgccgccgcgccgccg

SEQ ID NO: 59130 - DNA, 5043 bp, Oryza sativa
cggcacgcgcgcgcggaaagcaacgtgcgacgcggcggtttgagcggcgcggctcggcacgcgtgttgactcgcggggccgagcggctgcgcggctccaggtgcggcagggcagcgggcccgggcggcgcagacggcgcaggcgcggcacgggcggcgaccacgcgggcgcgcgcacgcgagcatcggcgcgcgggggccgattttggggcggggagctctctagggatggcggtggggagagggagagcgagggggggcgctcggtgcggcttacgcgcacgcgcgcgcggcgcgcgggcagagcgagggagagagggagagagagagagagagaggggaagatgggccgagagagattcggcccatcgaacccgagggaggcaaaatagacttttgcggaggaattgatttgggaaggatttggattcgggattgaactcgacgattgatctgggatttaagatctgagaaagcacggacactagacaacaagcaaagaaacagatttcgcaaataggatttttaagagataatttttcccgctaggcgccacgacggaacgggcgctacagtcggctcggttgcgggctgaagaacaaaatgggctgaaaaaggcccaaatagaaaggaagatttttatttaaataaatgttgaaatgatgtttgtattattaaaattagcaattaagttcggaaattccaataaaattccaaagagcgtaattaatcgtggggaatttaataaaattaattccaaccatatcattttatttttcacacttactttacttgtaagctagtaatttaattattatacacctagctacttaaaaaatacccagatatcttaggaaatttgtatttcaattaattacataatgtaaatctttcttaacttttccttaattttctggtctttatatttcccgttgcaacgcacggatacttttactagtaacaataataaaattaaaatagttttcacctattgcaatgtacggatatttttttttgccattgatacatgagagccataaactatcttgcttgtgttggaggcttgaagctgtaacggataataataataagaagaagaagaagaaaaaaaaaaagagaaaggtggggcccgcaaggtaggggaaggggcccatgggccaggccagaagaggtcgggttcggagatccccattaccactagtcctactgtacttcggttacggaggagattttttttctaacaaataaactaataattattataaagggaacagatccccggtggggcgaagaccgaaaccctagccgccgcctccgccgtcgccgtcgccgtcgaaaccctagccgccgcctcctcccgatccgaccgtgtcgccatggccatgcgctctctcctcaccaagctgcggatcccggcggccgcttcccgccggactctcccgccgtttcgctcttcatccaccgcccctcaggttcgcttcgttcccctcgctattaacctaatcaatcccttctttctgatgatgtgcgatgataattggcccgttcaatcaccaccttctcttgtatctcgcggtttgcacgcacatgttctagcgattcacctctccgattagattagtgttattacccctaatgaacctttggacccttaatttcgttcattcaaattatcctatagtaccttgtgtgttttgttgtctctgtgttggttgacctaatttaactcaaaatcttttatttcccctgagatgaacaaaccccgatctctgttttttttccccttcgagatgaacagatcgagctgttttttatcagtattatctaccaataacaagtactagcatttactgtcctcatatgatactcgccgcgctgggcttattttcttcagctctattatgatcaaaccagtgactctaacttatgttagatgcaaacctcagttatttacctgtacctgtatatagtctcttccatctgagtttattaattattcgtagtaattggtttgtgtttgacattgcaccaccatctgactctctctgtctctcttgccttatatatataggctaagggtaagcttagcagcactgctactgcccaagatggcactccagttcctggagagggcaggtatggcgctgattcatggttctagttcagcattaatatctaataatcatttttctccttttaatttgccaacatgcatgtttaactctagagcttgcgtctcatggcttttttttttcattttccctctgcctgcaaggcgcatacttgaacagattatggaagaaggggacaagcgccaggggaagctgatgtggtatgaaatcattggcaacttcatcgcgttcaatgctacactctatactgtctaccttctataatatgaataggttcaggaacaactttattcaaatactgtgatgccatttggagacatttcaatgatgttcgttccaccatttcgaggagaattcacaaatctattacttcaacctcatcatgaaactaccactaccgcagcagctgagcatcagcttcacggcgtttaggttttttaaaattacatcgacatcttagtactgatgtttgaatattttaccatcgctagcacaggtgactgcattgcaacggaaaagctaaaattacaatgaaatcattatctaaatctcctatgaaaacacattcttcacggaatatagcaatatgtagaccaaatcgatcggtttattttaatgttgctcttgatccattacagatactcggtgtcaccactcaccaccagcgcgcaatgtagaacaagacttgctcgtattgatggttgtctttgacaattgacatgctaggtcaaggcatctaaaagagaatcagtttgcacctacaacaatttctttaggcaaaacctggcttagtaccattaattgcactcgagtattgttagtactgatgtactataacacaaagtagaaaaattaaggctgtgtttagattcagggtgcaaaattttggcgtgtcacatcggatacacggacacacatttgaagtattaaatgtagactaataacaaaacaaattacaaattccgcctgtaaactgggagacgaatttattaagcctaattaatccgtaattagcaaatgtttactgtagcaccgcatggtcaaatcatgtagcaattaggcttaaaagattcgtctcgtaaatttacacgcaatttgtgtaattaattttttttctatatttaatacttcatgcatgtgtccaaacattcgatgtgacatggtaaaaagtttttgcgtgggaactacacacaggggtgtgcctacgttatactaccggtgtcacaggacaccgggtagattattcaaatcctatataaattacactatattaattaatatattagtcaataattagatagttagtatgtattggacccccggtaatttttgttctgggttcgccactgactacacaggcctaagttttctcgtgaagcaacaaatcctgaattcctgtattacttaatccaagagatctccacgtaaatatgtctatcttttttaactcaccatgttgatcagccgccattcttgatctatcaagaaccttgtcatcaggatgtcctacttggagctcttgacgattgtttgccataccaccttagtacagtacaggtccttgaggtgtctttgtactgaacattacccagtacagatgcatgatcttcctagctacacggaccctgcagcctgtatcccggtcatgtcgtcgatcttgtatttgctttcaaaaaactgtatatacatacatgcatgcacagacttacattgtgaatatactgtgcatgatcttgtatctttgtattggagaagactgccataccatgcacaggattgattgattagcttggttttttttttcctagcttaattgccattgcaattaattcaaccatatattgcaattaattcgatctcctgaccatctcaacctgcgaggaagaactactactactactactactactactactactactactcgatcatctctccggcgctgtgtgtgtctctctcagaactaacgaatcgatctgcttgctatagctatatatatagacacacgggcgatcgcttgttttgcttcgcgggagtcattccacgatggcgcaaccagccgggcgaacgaacgaactgaaggaagcggacgttggaagcagatttcgacatgcatgactcgatcagtctgccgcgggatgactgaacagaagctaagataatttgattgggatgaagtactttaccagcctcaaaagaaggttttgtcctaaaataaaacaatggtacgaaaagtagcataaaagaaaataatgcttatgatagaatgaataattcatttgccaaatgaaacatggtatataagcaaaccttgcaacatcacacaggcaggcaatctcaggaatacccatgagtacatttccttccaccaaatcaccatggcctgccagatttgagtgcaatcaactttcagacatcttccaacatcttcacgctttggccagttcaacaaggtatggttcaagttcaatcagataaagcacccaagacacaaaatacacttcaagattaactaactattcactaagtagaaaatccatcgttgatgtcgcagtcatgcgatggctgctgctgcacccacagcttcacagcatctcccacggccagaagtgaggtcttgaagaacacctccagataactcagattcttgtagatggcttcagctggcgttgccccttcgaacctcacagccacaaaggtgcatacaagcacctgcatgcctgcaaagccaagtgatatagtcgactgtcgacgcctagtcttttcgaggtaacttgcgagcattttcccaataaggattctgtgattaaaaaaggaggagagttaggcctggtttacggtgtgtttagttcacatcaaaattggaaatttgattgaaattagaacgatgtgacagaaaagttgaaagtttg

SEQ ID NO: 59131 - DNA, 20916 bp, Oryza sativa
gagaaaaagtcaacggcgttatctattaaaaaatagagggagtatttgacatgtgtttcgcaggttgacccatttgcatcctaggcccaatgtgccgtagacaagttggtcgctggtatgtgtcaaacataaaaaagtccaatacaagtaaaatacctcagatatagcccccccccatacacaaagacggatatatcgactcattcaactattaaaaccattcaaaatggcactcttggccatttaaagacggttttctatgacatgacagtctagtcatcttaaaaactaaggctgtgtttagatccaggagtgaaaaattttatcgtgtcacatcggatatacggacacacatttagagtattaaacatagtctaataacaaaacaagttacataatccatctgtaaaccgtgagacaaatttattaagcctaattaatccgtcattagcaatgtttactgtagcaccacattgtcaaatcatggagcaattaggcttaaaagatttgtaattttacacgtaatctgtgtaattattgttatttctatatttaatactttatgcatgtgtcggaactagggatggcaatttaacttgtttgcccgtttactcatggataaaaaccctaattgtcagggttatagataccctgtacctaatagtagttgactaaatctcggcaggatccaccacataccatgtcctatacggaaacaacctgcggatataggaggagttctggataaggaaagacaaccagagttttacatggaaacgacaaggactactcggattgtatccatattggtttccctaattctacttggacaaggggacacctatgggtataaatacaaggccccctaggaggagaggggagacacccaccatggaagccacccacaatcaacatacacggaacaataggtcaagacagaagatcaacatacaagctaacatacgccaagacaagacgccggatatcgacttcagagataggcacggctagtcccctacggtgtctccggatactgtcaggagagacgaaagcgctatctctgatctcgccgagcacaaactcgaggaggaagactaccctattgtcgactatgagtcagaccttcaaaccgccatgtcgacaacagttagataggctaccccaaatattgtactggtatgattatggtgaataagagcaataccggcttcggccaacaggatgtagggttattacctgacaattcaggagcccgaacctgtataaaaatccccgtctccatctcttttacctcagtctcgcgtatatcctagtaccaacgatccccatactatgcaaataccggaatcacgacataaaacgtcgacactaatagagttggatttgttctccatttagtacccatgggttttttattgggtcaaaacctatacccaacgggtatacgggcatggttcacccgtttacccacaaaaactgactgacatgtggtccctcagttaaattagtataaatgccaccatccagtaatgatgaacttgtaatgctttgtattattgaacttggtacaactgtacctttctttaaactgtgataatgtctctctgtttggggttaaagcgttgaaccgtgagtctgtgatgggtaaacgcgggcaacgggcatggatagtgttccttgcccgtcatgtagtaacgggtatacccgcggacatgaattatctcactgcccgtgcccgactgtcatccctagtccaaacattcgatgtgatagggtgaaaaaacttgccagggaatctaaacctgccctagaaataaagtaggacccacaaatcagatccgacaagttaatcatatgggattttttccatggtcattggtagcgagccaagtttagatgggcctattatctttccctcaagcgggccgagatttgttggcaatgtatgtacaggggccgggtcgggccgggcgtacggacgtcgtgctcgactctggcgaccggagaagctcctccgccgctagctgcgcgcttccggccaccagccatagccggcagacgctgcgccgcctgatttgccgccggcgacgtaacagtgtacggagccgcactctccggtgaacatgaacacgcagagagcaagcagtttatctgttcctggagatcgctctcgattgttggggctcatcggttgctttttcctaaacggcttattagagtataaaaataaatttgtaggtaaaacttttatatatgtgttctcggtgacttaaaagtcaatgctcaaaaagaaactacgttgaaaatatctcaaaatcaatgtcaaaattaagtttgaaaatttaaattttggctttttctttggctgaataggccatccgatgggagccttgcgatttacgaattgcatcaaaactgaaataaagaggatatatgtaatctcatatctgctgcaagtcttctacgatcgtcaggcatcctgctgcagatttcaatttcattcatcggatttcacaggttactgcttttaaaataagtcaaggaagcaaaactatgcacattcttcattcacattccatctccatacaaactttgtttacaaccatgtctagattagatagtaactcaacttaaaaggtaaaaagaaccaaaaaaaaaaaaacagccacaggccattccttagtaggttttcctggctggttatctactttatactatcactgaacttttggtgccaaactgccaatcacggtgacctccgatgctggatctcatcgcctgcgattatgctactctccggcttccacatcacatctttcaggccattggagatgttgtggtagaactgcgaaacgcgtaaaaaattacaccatgagttagccgaatcccagtctgaagtatgaactgtgaggtcctgcagtaattttactgttatgtgtaccttatggaattcaagagtgtcgccgttagatttgcggagctcaaccatgtacagcgagggcgtgacttcaaaaacctttagaaatggatgaactgatttcagtctataaacccaggaaagagtagtagcacaagctgcacagcatatagaatgacagaacatagtaaatagtgatgttgtatcattggtgtacctctgttgcaattgcaagctgacctttccttcctggattctctccttgcaacttcagctgattccaatccataaaagtgtcatcagaatgttaattgtttcagataaaaatggtagaaacaagttgtggaattttggattagttaccttgtagttgcgcttctgtacattaaagcccatgggtccagcagctgcttcaattttcgacaatatctcgtttgcaggcagccttgatgcaaatcttgtttctcgcttcacagaaccctgctaaaagtagaaagaaaattggtttagcattttagattataactcatgactgtaagtgtacttgaacatgtttagttcagacttcagaatgaccaatttaagaatgtgatcgtaccgattgcttttcaaagagtgtgccaagattgagaccctgagatgtagagatcaactcaaaagcattcatcactgatggcctctcttctcgcctctcgacaacaagctgtgtttggtcctgcgttagttagaatagatgttaccaagcccatccagtgcattatgaagaatgtaatgctatgagctgaatggtgtgagagcttaccccagattcattaaaaatagagttgatatcatccaggttaacatctgctgtctcaaaccttggaggctgatatcccttcttgaaccactcattgttgataagctctgcgatggtaatcctctgcacaaggagataacgatgggataagctacttatgtataagaatgctccaaagaaatgaaggttaaaatgctgcaaaacatacggtgctaggattaggatctagtattttcttgatgagcttcttcgcacttgtagagaaccaagacgggcaactgaagtctgctttgaagatctggatgagcaataatcacattaatcttccaaacaaaaactttgtttagggttcataaaccaacaatcctttgacatggttaagagggaccaaccttcttgtaaagtgacatgaggtttgagtcttcaaatggaaggtagcctgccatgaggacaaagagaatcactccacatgaccacagatcagccttggctccatcatatcctttgttgttgataacctgcacagacaatattattgaaacatgagaacaaatatttttttagataagtaacatgaaaacaaatattcaatccaacgatgataataactatatactagtttaatgtatgagtgtaagaaggtacctcgggagcaacataattaggagttccacaggtagtgtgcaacagaccatcctcctgcagagtaaacagaaagatatgcagcactaatgtaagaactttattcagatggatctgaaactatctgtattaccatgtgaaaagatgtagaaaacaaatggaatctacagaaagcaattgaaatgctaatttttttacgactaacaactctcggcttttcatcactttgaataaaaggaaactctccacaaaaagataataaaagaataaataggaagagtcaaattacttactctgacttgttgagacagtgcactcagcccaaaatctgatactttgagagtgccactagcatcaagcagaagattttcgggctgaaattgaatttgtgtatcaattcactgcttctcggctctcttgcatagcagtagtaaacaccgcaaacagttaaacgccgctaaccttgagatcccggtgatagactcctctgctatgacagtaatcgacagcgttgatcagctgctgaaaatacttccttgcatcatcctctttcagcctcccacgcgaagcctataacaggaattatgacaaattgaacatgtgtgcatagcataaagagtaattcagatgtcgatagaaaaggccaagcactcacaatcttgtcgaaaagttcaccaccggtgacaagctccatcactatgtatattttggtcttgctggccatcaccttcagagaagaaaacaaaaccactaagtggagatcgacataaagccaagacaacaaaaggaaaatatcagaaagcaagagctaggaaagtttcagataacacatagtttagtgtcacaggaatttccttccagaacgatctctaattgcaacttttcatgtgaaggaacaacttgttcattatgtcatccttgaccaatttaatttaccctggtttttcataatttcagattgctcaaagccttgagaaccatatcttaacttaattagcagggttcacaatctcggcctagaaaaaaaaaatctgggggggaccaaaatttttcagaagtttcaaaccagaaaaaaaatgaattttgaacaggctctagctgaattcgaacaaattttacaaaattaaaaaaaaaatccacaattcaagactgggaatcacatccaaccaggacccactggtagacccgaaatttcgaaaatttcgaaccaaaatcacgagctctgcttatgattagtcgatttcattggtggacttatcatcagttacaaaatttttccatgggcaagatgagctgagattaatgattggagattagtaaacctcatgcatccggatgacgttggggtgcctgatgagcttcatggtggagatctcgcgctttatctgcaaacaccaccacacaaaccacaaacacacatcaaagtcagaactcccccacaaaaagtcagaagctaagccaaagttgatgcacattaataataactaactcagcacaagttccaacgaacactgcacgaggcgcccgtgctaacctcacgtcaaagtctaggctgttgcaattttggaagtaagaacgcaattttggaacgataccaaacctttttttttttgcagcaagaacgctagtagtaattagtaatgtttactgtttctggttaaaacaaaatcatcacgtcttgtcgtgagaggaaacaaaacagcagtagtacaaactgttcatgatttgggactcgtacgtataggaattgaaattgtccacgaaattcactcaagaacagcgtatgatatgattaaaaaaaaacaagaaggcgagaaattcgaacagtactatcatcatgggaagaaatccatggagacctctccaaatcgagaatcgattggggggatagaaaatagtatgggtgagctgacctgggcgatcatcttgtgcttgaggaccttgtccttgtcgaggatcttgatggcgacattctcgccggagtccgcgttgcgggcgaacttgaccttggcgaaggtgccctcgccgagcgtcctcccgagctcgtacctccccacccgggtcctcccgcccgacacgctcatcctcctcctcctctgcttcttcctcttcccctgtccctctcagatcgacgaccccggcgagtgggcgagcggcggcgggcgactaggaccgcttcttgtcgcagggcctccactggacgaacagctccgcctcctgctcgccggcctgccgctgccgcatcgatcctcctctcttgggactctcttctcctcacaacctcgcggtcacggccgcaggcatgggatgggacgagcgcggtggtcgtcaatggcggcgggtgaggcgggaggttgcaacttacaaggaggtgggtggggggtgggtatgtataggcgatggcgcggtgggcggcggcgaaggaggaggaagaagaagaaggcgttttcgtcgacgcttctcccttcttctcagctaaggaaatattttactactcctaggccatactattatcgtgattactagcggtaattactagtaatttagtgctctctacgtctagaagatttcatttaattttgagcgacctagaagaaaaaaaatagaatgggaataataaccatgttggttcatatattaggttacttttaatgggtgtttcattgtcattgggaaggctgtcacatcagcatttgtaataacgtggtaaaactaaggattgtacaagtttttctgagaaacacagtcctacctccgtccaaaaagagtgtagttctactgtttatatataatatttgatcttctgtcttatttaaaacaaatataattgttattattattattattagatgataaaatatgaatagtatattatttgtgacttttttaaaattatttcataagtttttaaataagacggacagtcaaacgttgaacacgaaaactcatgactacacttaaattggaatgaagatagtacatacatagatgcccataattgtacatttttagattgacgaagtcaccacgaacgtctagcgaaagaataattagtcataaatacgagcgctcgtgttaaatctagaatttggacttgggtatgggctatttccatcacaagtaatctaacctatcgagctatataagttattttcagtcatcaattaaatattttgttgcttatatgatatccttggaaacataaaaataatacctcatggtaatgacactcttattactccctccattccaaattgatctatatatatatattttaagattattcctaaatgatctacatatttgtgttcatttattaagtctattcgttatttgtgcattggagtaaatggacattgatgcatgcatccatgcacacaagtatctataacccacatgcaatatcttgatttgctattggataggaaatagtggggatggtgcatgcattgagtttgttgctagagtaaatgtagtatgagagagttattagcttttcttggtcttagtgtacctatgaaatatgtagatcaatttggaatggagggagtatttttctactacactttaatgcatatgtcttatactaatatgatattacctttacaattaaagttttagtgggatagattttaaacgatagaaatgaaacgaattcttcgtggaatggagataatattgatcagtctagcaccgcgttaggggtggacccaggaggatgggacttgtggggcccagctgccagtgagagagagagaggggttggaacttggaagctagcagccggcgattctttcttcggttaatttcttccccaccttgtgttgactgtttgacgttgttttcgcgacatcgagatggagatacgtgtgtaacttagctgattcgtctgaaatttgagctcgtggggctttttgctagggttgatgtgctctgctttgacttcgttttgaaaatgagatgatcgatgctgtagctaggtgtcatgagcttatgtcgctccctgtatgtggacagttctcggttgatttttgttttttttttgtcacttgaaaagtactacctctatttaaaacataaggattcctaatttatttagcatagactaattaatgttgagaagaaaagatttattggccttggtaaataagggacaagtggaggtggaaggataggtgggggtaagaaggaagaaaatttgaatgaaaagggacatgtaatactgtcgctagaaatctttgtattttagaataagatttaaacgctagaaattttatattttgaataaatagatcactctcattggatcgaccgtaacgcacaataatgtgtatttagtcttatccgcttgcgtggattgtctttcacatgatggatgacgttatttcattactattttcacttttctaaaagatatgattgattgtaggataatatataattgtcattagcactcctctaataatttatttcaaatcaatcacattactttattacttggcagtttatccaaaaatgatgcatcattgtttggaatggagccaagtgtcaaccttttggattctatctagagccagacctcctttttttttcatgaacatcaggatatgtaccagcgtaggtgatatattgatcccagcaattttgtcttgaggttcttgttatatattactctccccttcattatatatatatatatatatatatatatatatatatatatatatatatatatatatatatatatatatatgacactggctagttaaaatttgaactagccaatatcatataaaaagacatagggagtacttctctgctgggctagagacaattatatatatatatatatatatactatatgtatatatgtatatatatatatgtgtgtatatatatatgtgtatatatgtatatatatatatatgtgtgtatatatatctatatatatatgtatatatatatatatgcatattttgattgtgataattttgtaatatataaatgaaaaaaaattaaaatcatacacttaaaaaacattaatatattttttaaaaaatactacactaaaatcctacattaatattttttaaaaaaatttttagtgaaaacattaaaatcctacactaaaaaaatatagcatcagcatgagctatgtgctcaattaattacaattataaaagtcctactatttcttcttcgcacatcataaaccaccacacaatgttattttcatgtgtggttgtatattattcgttgaaaaatgtttcatgcacctaatatagccaataatagtgccttcatttttctacattgtccttacatatttctaatcaataacgatgcttaatccttgacttttcattgaaatatgaaagatcataatagctatatgccaacgttatacgactgctataaaagtcacattggcaacagatacactgagctatcttaagatcagatttgagatgttagtatccatagcattttcatatgaggtggtcatgcattcagacttgagatctcagagtgtctaatcggctgccacgtgcaccttctagatgctaaactttttttttttgcaccactactcctaccgacacctcatgtacgtatgtgtacaaattaagtactcccttcgtatttagggtaggacgcaattgactttttaaccaacgtttaaccattcatcttatttaaaatttttgtgtaaatataaaaatatttatgttatgcttaaagaacattggataataaatcaagtcacaataaataaatgataataatatatttttttaataagacgaataacagcgttatattaaaacacggatgaagtataaaatactagtattccgtactatgcacagtagctaaatacagtattgttttgtccagcagtctagcttgtgttttaatttcttccatgtgcataacttaattggtataatgccattaattatattactttggtttatgttcattacttaattgatataacggcatcaattatattactcttgtttgttaagcatattggtgactacgacttgcataatatatagttgcaaacgcatatatgcatgggttaatcagattattaatttagagcaaagcatctaccttggcaatttgctttggtgttgttattatcagtaaccgcgatggatcgatctcgagcatctgatctgattttgtttcgattggggggtagttagagcgatagtagccagccaatcttgatcgaatttattccatatgcatcgatctaaaaatatatatacatatcatcatgtgaaatgtggggtctctagatagatctacctcgctccgaattctctctgcacatgacaatctctgcatatatattcacgctatgttgtttttaagtttatctcttctttttttttctttagtttctgtgtgtgcgcgcagatatttttatactccctcctcttttttttaatacaacgtcatacgcttacaaccggtttcacctttcatctccaagcaaccgatcttcgttcccccaccaaattggtgaccgacctgttggttgattttatcggctaaataccaattagctaaggaaagaataaattccacttgtccgattcctaaagagatagagttagtttttgtgattggtaaaaactaatttctaacaaaatttcgagataacccccgagcccccaccaatgcgcctatataaagagatgaagggcagaggagggacgccgagctctctacctaaaccctaaatcgcctgatcagcttagcgttggaaggggttcgtgaggtgatgacggtgaaagaattggcgtatcaagaagaaaaggagaaaaaaaatcgaagaagaagaaagaggaaaaacactgatggcatctcaagtagtagattaagtttccgcattgaagcagaggtgattaactgattatgtataggctaaatcattgagatgtaatttagatctccaacacaaccatgaggaagagcatgtccgaatctgcgaggcaaggcttcgattcacttgttatctcttgttgcctggaacctcttaaagaagcggaaatgcccacgtattcgacggtattttcgtgtcatttcaagcccactcgatcagcactatccttcaagagaggctctcatctttttggatcgaagctagggctcgacacctcggcgtcctcttggccctagctcctggtggaccctacttggcctctttctgctttggagttcattttcactaagtatccctccttgcttttgtgtttagcttggtttatatttttcgtttttgtctttgctgctagtaagaggccagatgcatgtaaactatattgtttccttcgtctaatatatcgacgcgcaagtgtttaggaaaaaaaagttaggattagaaggttttatgtgtaaaatgaaaaggtttctaaatgtcgttacctttcggattatacaatgttcgggttatattaacatttcaatggatgagttcttattggatattagtcaatatttttcttcccatcatgacattttttaagatccggtatatcagttagatgacatgagatgattgctctttagtctttaatttgttcccaatgcaaatgtgacaagtctacggacaacgatggcgtgtccgctgagttctttatacaaaagaagcagagctctattattattagagttattttatatctcaagtgccgtgataattggtattaacataacctacgtaccaatcgaatggtggagatattacagttaaaaaattaaaattaacattagaagacgcatgcacttacctcgtctcagtacctctcaagaattaaagtaaccacagtcattttctgaggaaaatgtatctatccggcaaaccgactaattaaggtttttctaactgtgcaagagctaaacggttggtgttaatttggaccaaaccttgattccttttctactgaaaagaacagactttagatcctatcttttctctaacaaaagttggataaacttttagataaaaatagcacgtttttcaaactgctaaacgatgtgttttgtgtgaaaattttctatatgaaagttgttctaaaatatcagattaatccatttttcaagtttgtaataattagaactcaattaatcacaagttattaccacatcgttttgtgtaaaacacttaatctttatcttcagaagattcaaataccacgaaattatatccactattttgttatgtcactcagacaaaatttttaagtcttttgaccatagaaatcgtttaagaaaatcgaattttggtctaggatgaaatggttgaaataattaaccttctggagcaagcattaatctcaatttatttgcataccatttgatgtgtttctccaaaaataaccatccgtaaaaaatgtattaattaggccctgcttgttctccttcaaccgatttataaaacagagtaattttaaagttaaaaagttttaaaaaataatttttggtagattttttttaaaaaaatattatcttgttagcaatcataaaaagatatctatgcaataaaagtgacaaagcaaacatgtaaatgaatccaaaaatcaatttcttaaatttaaaaacatcttcatatgtattataatccacatgaaggtcctaactcgtatatacataaaagactctaatagtggtggtagcgatctaccaccaccacctactcactatcattcacgtggccggagagtccttgttatccatgtaacaaccatgcaaaaaaaaacttgagcaacttcagagttcgtcaatatcactatacttctcaatgggtttcaaatagtacacggttctttttttattccattaatatgaattttccccgctatgacgagtgcacaatgtcaaactaaaacagtccgatatagtatatatcaactatcaactttaacatatccgagaactcctgaaatttatcattactatttcttaaaactccattgtaaaaacgcaaggacactttactattatctataaatgtcatcattgtaagggggtccatcgagctaggtcaaagctaggcggcgtacatacacggactgtgcagctacatgcatccgatgaacaggggttggggaatatggaatattctcttgcatgccatcgatccaaacattcgtctgaatctagacgtgtttgtacactcgtaacctgtccaagcacggcaaagacctgacctgactgcctgcttttaatttttgtttcagagaaaaaaaaaagaagagcaagtcaagaactgcagctgcaaaatctcgatcagcaattaattagtcatcttaattagctgctacttctagtcttctaaaacaaatattattcatcttaattattcatacacgatctatatatgcagctacctccagtccatgtatatataaaagctaacatgatggtgtgatcgacgatcatcaaagatccccaaaataatatctcttactaatatatatgtgcaattatttgttgattagttatgcataacttatccggttatccttgcaaggtaatttattctaacatatgcacatattaataaatggagactttcaaagagtacgtacgtgtacttcgtatattaataatatgtcatgtatatgaggatatcgagattatctctcgggtggatttaattattatggatccaggagcatttttagaccaagcatgattaaaaagtcgtccatgagccccaaattaattagttttgaggaaaacaaaaggagccccaaattatgcgtatggatgcaagttggccaactatttgattgacatttttacatgttactaattctcctgtttggaaaaaaatgcgtatatataagtgaattagtgagctaattaattgtactatatatgcattgcaacttctgcatatatgtggattgaccatctatatctaccattcaatgttaaaattgcagagtcatttcttgcgaggattaaaatatttttaattatatatgtataatatgtcatatcgatcgatctgtatatatattttttgagggaaagatctgtatatatatgtacaaggtagttaactgtctacggctatatgtaatgtgttatatcgatctgtcatgtgtatatatgtacctgcttgtacgcattaacgatattaatcagccattgttgtccaaaattattgaaaccataagtttttgagctagatgtaactgatcattattaacacggacgaacactagcttaattgatcgatctattcgatcattccctcactaactaattaatctaattctgcctgctaataaatataattaattgtccactcccctgatcaaaatgatctttttccgattaattttcctcaggtcgaccaaaacggataatagtttttattttatgatacccaattgtgcctatatatagatataggtatacgcattatatatacttacccggccgtacacgcgactgtgtactagcaggcactacgttcctgagcaaaatgaagcgtgcatgcatgtgtaagcaaagattttgtgccaattattgtttttgtatatttctgattttaacaaaacgtgtacaccatattaccataacaacatacctagagatcataaaacactttgtcaagtaaataattaattaatcagctcaaactaagcacacattgtaagcatctcttcctaattaataacttaaactaaaactaagaccaataatagttttacaaagatcaggttgttgtcaagaaactaattaaaattataaacacaatataattccacttgcacgcaatggtcatatcaaaataaaaatctatatatttatttatttttggagcggtagctagtacagtagtttggcgagaaaataatgcatgtaactttcccaagatcctgtttggcgagaagaagacagaacctacttggcgaaataatttttttagataagatcgagttaattagcataatattcaggatcaagagaatctagccagtcaccgtcctcgttcttgttctattcaccttgtttgtctcgtcaatttgcagcaatcattgtactaaaatatttcacccataggagaccaccagatcatttgcaaccacatgccaagaaagggacataagataggttaataattagggtttgttgattagtgatctaaaccctacagagctggagcatgctctgtagtattatacacatataaaacaaaataatgcagtagtattataagctaatcagatgacgtatactaatatactcgtctgtttcaaaatatttgacactattgattttttagcaccgttcgtcttattcaaaaacttttgtgaaatatgtaaaactatacgtatacatataagtatatttaacaataaatcaaatgatagaaaaaaaataatagttacttaaatttttgaataagacgaacagtcaaacatatttaaaacaatcaaaatggcgttaaatatttagaaatggagggagtatatattatctccagaaccaacattttttaattgtggataaaaacccagcctctatatccactgccaatttccagaatcatctggttattactagctctcatacatatgcatgcaagcactaatcctttgagatctactggctagaaagttgagatgacctattgtctccataagagagcacaaatcctcatttatctcactgtccaactgcttttgctgtttggttagtgcatgtaaaacaaaaaaaattgcatgacaaatgagatgagaagattgagtttgagatcagaaataattagacataattaaagttaattaactttgtgcttggtggaagccacatcttcatcaacacaagtggtcctagcaagatatcattgtacttatgtttatgcatgtcgagctttgattttatttattattgaacccactaacatgtaaattggattagtacgtacgtgtagtacacacacaaaaaaagttcagtttgtgcagtgagcactttgtgacaccaatgaactcacctgagatctatgcatgatcaagagaccacccatgtgatcgtatcccatttcacatgtctcttgggatctaaccacaagcgcatatgctcatgcttatactctctccattccataacatactaggcacaactaatttttaagttatttataatataaggcgtgcatacatgcatgtcattaactagtaataattatttcttgatctttaggttgttaagggtggttgtgcctatggatggagtatatgattgattagttagtcctttgctttgattactagtattattatgagctctaacatgatcctgttaattaattagttatatatatatatagaacattgtctgttgtcgatgagtttatactagctaagtgtgatatcctggctcagggcttaatagaattaatagaatactcatatcaacaagttgtaacttctttttcggaagccgatctcgaactctaaggttaagcgtgcttgccctggagcaatttcgggatgggtgaccgattgggaaattcttcacaggtgcgcacgagtgaggaaaaagtgtgcagaaaagactagtgttggtatcagagccgacccttgcagctatacgtatatatgaacatgtacgcgacccttgcagctatacgtatatatatgaacatgtacgcgggcatacggtgcatacgggatgatccacgaagtggtcgtatggcatgacgtatgtgcgccgaaaattgtcttgtatatacgtggtgctaataggggacgttcctggcctgggttgaccgacgaggacgtcggtatcttaaggggggtgagaatgtgatatcctaatatgattaataaaatactcatatcaacaagttgcaacttcttttccggaagcgttaagctatcaacaagttgcaacttcttttccgaaagccgatctcgaaaaaactctaaggttaagctatcaacaagttgcaacttcttttccgaaagccgatctcgaaaaaactctaaggttaagcgtgcttgccctagagcaatgtcgggatgggtgaccgatcgggaaattctttccgggtgcgcacgagtgaggacaaagtgtgcagaaaagactagtgttggtctgtgaggaatagtctatatcctaggaaagctgccagatgtaggaggcctcggaagagtgtgggggcgtcacactaagctcctaatactcgtcagtagtgtactttgaaatggggaacatctttgcgccctatccgatccaaattaattaactaattaattgtttagcatcgttcacaagataatgttgcaaattaatactagtagtagattaacagagactgattggatgagttcagctgcagcctccagatggctctttgtaacatggtgatgacatcatcacatgtcagcaaatagggcctgcagcttaattggaaggtttttttttccctgttctgattataaatacatgcaaggcatgtgacagaggcaacaaaaaagaaccttttgatagacctttgtgatattatttttagtggtctaaaagtcaaagttggatggcgaaaaagatgaaaaaaatgcagtaaatttattctaaaattgaaaattctagccgcaccatgctttaattaatttactcagaaaatatatgcactgcaccgagataaatttgaaaagatcaagctgttaccttttccacgaactcgaaatagtcacatgctgtcaatttattaattaatgcaatttggcgcaataagaaaaatgtcaagaattcaagtgcatacgtagagtatgatcgatacagtaaaaatatcagcaaatgagattgaggcagctggtcaacaatccatgcgactgaggtcattttattgaggtgatcaacatggacacaagctgttaataacttcttaattatcctagtacagagattaattagtttattaaccgcatctgctgcgagcaagcagctatacgtgtgaagcttgaaataactgaaaatgtaacccccccaccctcccccttctcttaagtatataaacgtgcatctcgacattgccaattaattaatccatccatgaatgatctcatcactgttacattaaattagtgaattattattgtcaatttgtcgtcactagggttcagtactgacctgccctagatgttgcttgttgcaacgcaggcatcgactggtcgggtatgatgcttattaattacttcttggaagggccttcttgtgcccataaaaaaattgcaaatcattaattgggctttttttttataataattgcctatacaacatgcatgcatggctttgtatgactgaatctagctagctagctagctaggggccggataatacgaggggatatcctttgtagttgtaatcgagttaatatgtaaaatacatatttgtttggtctcgtttacattgcaataattaattatgttttttatagtaattgaggtatacctgtcgatatgtcataataattaagaatattacagaaggtgtgaattattacggtataaacgtctcatggtaactactccctccattccaaattgatctacatatttcataggtacaccaagatcaagaaaagctaataactctctcatactatatttactctagcaacaaactcaatgtatgcatcatccccactatttcctagccaatagcaaatcaagatattgcatgtgggttataaatacatgtgtgtatggatgcatgcatcaatgtccatttactccaatgcacaaataacgaataaacctaataaataaacataaatatgtagatcatttaggaataacctcaaaaaaaactatatgtagatcaatttggaatggagggagtacttaattagaacaagtataataaaaaccttacgctagccataaaacaccacgtagggccggcacccctcgtgtaagatgtaatatatctgtacttgagcttcaagatcaaagtgacagaaatgaagggtatattaaggtagcaaaataaaacaaaaaaaactacagcagattattgctggggccagaccagtgtactagcagtatagagtgtgttgtacatactatcctctgcgttgatgagcactagttgatatgggtaaaattagagataatcaggtagaaactaaaaactacttcttttattatatttgctcttatatgcatgtgtttttaattgtggggacttctagaaaattttttgtggggacttctagaaaatttcatgatgcctttcatactgtagtacccctaccctggtaacctcctcggcgtatttccgatgtatgctattccttattgacatgcaagacttttgcgcgttcgaaaaaaaatcactgctcatagcagttcaactacaataaaactagggaagcttagaagcacagcttaaaaagctattagtattttttaattccctccgatcggttattatttgaaatgccctccgatccttaggtttaagcaggtggacgatctgcctatacaaaatgccaagtgggcccatatgtgaaaattcattttcatatatggatggcttaagagatcacatgctccgtttaaatggtgctattacacaaattaatcagtaagtaatgtaaattgatctcgtccatgagcaacatctaattaatcttcaagatcttgatcaaaatttcagtcccggccggcaacataattattttgtgacgtcgcagagatcgatcgatcagattaattgatcatagagacatggctagcagcagctactacctaacatggcacatgcatttgggagggatgtatctatttgtatctgcacatggtgacaaggtgtctgcacagatatgtgatgaaagtaggtgataaacttttgaaataaaatggcacgcttttcaaactgctaaacagtgtgttccgtgcgaaaactttctatatgaaagttgttctaaaatatcatattaatccatttttcaagtttgtaataattaaaacttaattaatcacacgttattaactccacgttttacgtgaaatgcttaatgttcatcttcaggatattcaatcaccaccttaatctgcaaacctttgcgtgacgaactacgctgcatcgtcgtcttccaaaaatgtggcgacacgttttgtttggtacattcgatacgatgatatctgtactatgcgtttttgcacatgagaatactgaaaccctacgaaattcagtgaatgaatgcagatatctgttcagctgatatcgagctgttttatagctgcaaatggctagacagcgaagatatgcgatgccttgtagacaaatttatttggttctccatataggttgatttgatttcgacaggggcccaatttgcaccaaaagtgatcgaagaaggacagattttattttgtcttcttatatactccctccgtccctaaatatttgacgccgttgacttttataattaaacatgtttgaccgttcatcttattcagaaaaatttaagtgattattaattattttcctatcatttgatttattg

SEQ ID NO: 59132 - DNA, 38570 bp, Oryza sativa
ttgatgccgcctcaccgcagatggacactctttgggttcagttgggatctgaatcctcagcaggtccctgcgctactgatgcacttctgaatggcatggagatctttaaggtcagtcggaatgggaatcttgctcatccaactgtgaggattggaggtttcaacagtgccatggggaaaccgaaacgtagccccaagtgggtactaattggtgcagctgctggtttggtgatttttgtgtcaattgttggtgttattttcgtatgtttctatctgcgatggaagaagaagacttcagctaacaaaaccaaggataatccaccaggttggaggccacttgtgctccatggtgctacaacacctgcagcaaattcccgctccccaactcttcgtgcagcaggtacgtttgggagcaacaggatgggaaggcagttcactgttgcagaaatcagagaagccaccatgaactttgatgattccttggtgatcggtgttggtggtttcggcaaggtctacaagggagagatggaagatggcaagctggtggcaatcaagagggggcatccagagtctcagcagggtgtgaaggagtttgaaactgagatcgagatcctctcaagactgcgacaccgacaccttgtgtccttgattggctactgtgatgagcaaaatgagatgatcttagtttatgagcacatggcaaatggtaccttgaggagccacctttatggaactgatcttcctgctcttacatggaagcagaggcttgaaatatgtatcggcgcagcccgggggcttcactaccttcacactggacttgacaggggtataatccacagggatgtcaagactactaatatcttgttggatgacaactttgttgcaaagatggcagattttggtatctcgaaagatggtccacctttagatcatactcatgttagtactgctgttaaggggagttttggttaccttgatccagaatattatcggaggcagcagttaacccaaagttcagatgtgtactcttttggcgttgtgctgtttgaagttctatgtgctcggccagtcataaacccggccttgccaagagatcagataaaccttgctgagtgggctctcaagtggcaaaagcagaagttacttgagaccataatcgaccctcggttagagggaaattacacactggagtccatcaggaaattcagtgagatagctgaaaaatgccttgcagatgaagggagaagccggccttcgattggtgaagtcctgtggcacctagagagtgctttgcagttgcatcaaggtcttctgcaaagtgcgaatactgatgatttatcacagcctgaactgaagctctctgatgcatcctgcaatttagggtgcatcgaagaagttgaggaatcctgccgtgcagggtcccaggatgtgaatgaggaatatgtggatgtcaaaattgaagttccatgataatggaatgctggtcaaactagtggcttcaagcaactgaatagggtgagtgtcaaattaacaaaaatgtttagatgcactgctatctagtattgtaacaccatatatgagtgtccctacaatgtactgagattattttggtacagttaggagaaaactctcttcatttcttttgtacttgtgctgatgtacaagtctttatgatgcaaatttcattgattcttttgtaaaattctagagccgtatgcaatgcaatactgagcattaactggagatgtgctacagagtgaatgagtttttcagttctcttatcaactgtgctctgtattgagcttcgtacgcagtattttgctacccgttaatgttcagttagatattcttttagccagttgttgtgaaccccatatgtttactctgcttattgagcttctatattattgcacgaacacataagaacattacttacatagttttattcactcagaagttaattctaggaacatagctgtacacagatccattctagaatatgtaaaccttgcatggcactacaataagttggttttcttcaaaacaagcttcaagaagccaaggcactagtattgtagacaagaagagcaccagccagcagaattccagaaagagtgactgcccagagcaacaaccctgtctttcctgcataaagcaagggatgaaaattatatgtgctttggaaattgatttgtctgatattttttaagtagcggtgagcgctaaaaagtgtttggccttttgggatggttatatgtgcttacctccagtataaacatcaccacttggtgaccattcctctgggttatatattgggctacaataaatacagcaaatatccattatgaaaattgaaggcaataggtgagttatgaatgttatgcctgctgttcttctattcagatgaatgttttacctgtatccatcaacattagctccatacttgctggcaaactggtagacccctttcccctaattacaatggaaaagaaatatagtgatgagcaaattttactattgttgatttttctctaattttgctttcaacctcagccctgaccttgattggccttccggacgcgtcaacaccgtctttcaggttcggtcctcctccaggtcctacatgttaacattacatatgttcatatataaaatagtactatgttgatagtgtcatccattagaatcagtgctagttctctgatttttttctgaaatagtttgagccactgaaaagaatggtgtgcttgtgcatacatgaaacaaggggcaattaagctactaacttgaagcttaacctctatgcagtttttccagtgctaaactctgtagcgtgtactaaccgaaaggctgagaagtctggatcttctttgcttttttggccattactctgaacaaggatggccttgatgatggttggatggctcggattcgcgtctgttccaaaaatggagatggagatggttttagagcacaagaggccatgacagaggctgccatgcgtaagatgctatctcttactctccaatttgctgtcagtctcttttcttggctaaattgtgtaaaagtcttgctttaaatatacgaaggaaggctagaagtagcagcaactgactaagctttgtttgacaagtgtcagctgctatgtggcatactaggctcatggaccactactttgtgatcagtcgttgtccttcacatgaccaactgaagatgatagaattcgaaggaaacgtctagcgctgagtggataatcctgagaattttcttacttgttccactgattgagaaatttcgttttgttcttcgtgagtcaatttcaccaagtgcattcatatctgttccccttattgggaaatttctttcgttctttgtgtgtcagtttcactgagttaagttctgaagattattttagccgggttggccgaagaagaggccaaccaattgtattaagttttgggacaaaaagaaacaggaactgtacatgttggcaactgtacatcgacaggatgctgtcgaaaacggaagaagcacaggaaaccccacaattacaagctactcatcctgaaaaggaaacaggcctgcttccttccagatcatgagctcctccttgacccctccaaagagctgtgtcgacaagcatgattactgatcgaacactcttcaattctcacatagataagccaacatactatgaaacaaagcgagtcaaatgcttcccgcctatcaacaccgttctttaagttctgaagatcattttcatttctgtctgaaagaacatatattaatttctgtgagatttttgcatatagggataaagtcttaatcattgtaaagtaatctgattctcacatagataatcttatttaagagggtaataagttttatggtgcaaaccctcttctattatgatggaaatttagattcttaaggcatgcatcctggatagccatcctttttttttttgaaggtgatagccatcctttttgtggatatgctggatatcattcttattatctgaaagaacatttatcttattaggtgttgttaaatcagaaaatattttactaagacattgttaatatgcttttgtggttttgtactttcactgatgcagagtatgttttatagcacctaatttattattactattattgtaatactggagaatgacatgtaatccttggggatatttcgatgatgaagatttacttgcactccatggggatcggtacgctaccaaaactttattttccaatttttcagaataagctgttcaactgatttaactcttatgatccaacaggtgccaactctgttgaactcaaaattatttgtccctagagcccaagaacactatgttgctcactaaaacatcgttgcataacttagaattaacattactcggccttattcattaccaccgctggcagtcaagtccagtccaggtacataactggttacattcctagtgaagattatatacatggaagcaggcacagcttggtctgctgcacttagctaagccagtgcactagtgttgtagacaagaatagcgccgccaactagaattccagcaagagtgattgcccagagaagtaaacctgcctttcctgggaaaatcaagaaattttgtaagtacaaaatttgtgagaacaataaacatctcatgagaaatttaaataagcagtgcgcagtgttaaaattcttgtttctcgagtccttttttttgcttacctccaacatagacatcaccagttgaagaccattcttctggggtatatattgggctgtaacacggtagaagcaacaaaatgtcatggataagctatggatttcactgtttttacagataataaataggtgtttctcttttcatctccctcatctagatctgtaaatttctccttttattcattcacatgctttatcccatttttactttgaaactaatatttttatgagttactatatattattatttgtgcatggatctcaaatatattgttcttcattggatcggtaacatttacctgtacccatcaacatttgctccatacttgttggaaaactggtaaagaccctttccctgattaaatttgaaaaatttaatggtgaaaaataaccattttgtctgatatatatgcttgtctgagcttatagccttatactgaccttggctacccttccagatgcatcaacaccttccttgaacaccactcctccagcaggccctagatggtggcataccataactttgtgagaaggtaaactaatttagagaaaaatgaatggtaacaatcacagttctattcactaccatttatcacctttgcatgtaaaaaataagataaccaggagacactcattggtacccatgaaactgagaaacccattttccatttcatgtttaagccagttgctaatatattaactctgaattttacagcatgtactgaccatagggctgggatgtctgaatcttctttgctttcttggccactatgatcaaagatggccttgccattgtccctttccctcgaagcttcgaacgttctagtaatggagatgcagatggtttcagagccagagaagccatgacagaggcagccatgtttatgcaacaacactcaactgatcactcactctatctctgaaattaatgcaaatgatctcttatgcagttcatcatcagatatccatggctttaaatacaggaaggctttcagtagcagacagtgagtgactatgatttgttagtcaattgtcagttggatagtagctatgataatactgtgtcatggggccatgatcacgtgacaagatcttgtcttttacctggatgattagagatgatgtactgatgaaaatctgaagcaagcacctagttggttggttgatggataatcctggggtttcctgccctgcttaactattttcctggtcgagaaatttcaggtgtcaattctgatcatagcgagttgtctggggatcttatctctaacagagccagcgagttgtctgtaaacagtatattgatatatgcagttaatgttacatattttcgtggtaaaggatgaatggtgcttttttttttttgatatagttcaatttatatgaactgactattgtgtagtaggtatgaaaatatcagtttacctaacaagttgttatgtttttactcccaataatattataccacaaataaacgtacctaacctgatcattttacctacattatttgattctctccctgtagcctgatcgatctagcactccttgcaccaagctcccttttattaaaaaaagagtaactactgagttttgtttttgtctaacattgccgggacagtaattaaacaataaagtaaattttgtgcagattttagtattttacattcctgatcgagcctattcgtgtactaagtattcgtgtgcaatgcatgcataagcgtaactcaactttgtatcgaagagaaagaaacacgtagtacgttaatatgaaattaaacgtaggtcggtgcattactagtggcactgtgggtagcttatcttttactcctaaccactgtccttattaatccctgcgttatggaaaataaatcttaacgagtggagtactccctctgttctcatttactccgatccaataaaaaaaatatctcgaggtatcggtacctcacggtaccaaattatttctgatcattaaatctagttagacataatgtgtattgttagatctaacaattggaaatgatttggtaccgtgaggtaccagtaactcgagatacttttcgttggaccggagcaaatctcatccattcctaacaccttgagcagcaaagttgaagtagcgttagatccagacatgacgccgtgattgttatatgatgttatctgatccagttgtagctgcggatgccgggagaaggaagcagaactagcacgaccaaccgccaccaagtgttagcatctcatgctgccatgagcatccatgtacatggaggtaggggcgaagttagtgcgaaatggagagatgtatcacatgcttgctttactctactttggaccaaatttaagctgatgcgggtgtctaagttgatcttaaggggtggtggaaatagaaaataaacgaactatagctaaaaattttcaaaaccggattcctgggcactgtgtggaggggaaagggcggatatactcaggtacgggttcaaaattctagtttgtatgaaattttcaattttttttatgaatttgataatattttattcaaatttaatcaaattttattctaaatttcagtatatcggcaccctccgatacaaatcccaaaaatgaaagattgaaccctgaccctcgtgtggtttgagccagtactaatgacaaagtttgagcagagaagaatgcttacaattggaattattaggttacatttctgttgacatttttggagattccaaagatgattgaattttgacaagttcgaattgatactttcttccttttctttgaagaagaaaaaaaaataaaactttgattgatccgtacaaatgggccttcgtgggccgtgcgcgcgcgactgggcgagatcaagcccaagttcaaggccttagggaggtcgatcagagttttcttctccgacccttcccctctggcatggacgcatggtgatacgcgcacgacgacagccgccgggttcgcggccatgatctctgtctggctcgcgcccgcccggcgcacgcatccgctgatctcgccgccgcaggtgaacaacgcagccgtgccggcgagcacgccgacgcgcgcgtcatggacacggccaagtccctgaacaagaacagttcgaggtcgacatcgtcggcctcactgccttcccgtggtcgcctcgccggcgccggcgccggccgatgacgactgaggactgaatccccggtggaggccgtagactgtggcgtccgcgagtccgtttcggtgtttcaaactccgaaccccattgacagtgccggttacctcgccatggcctcccttagcttgctcacctcaccggtcaccgcacgcaccgacttccgaccaagttccgggcgccatcatccaatgcatgtgtgcagtgtcagtgtgctggtgaagtggtccgtatactccgatcccaaggggtcggagtcttcttctccgaacccccttgccacgtcaacgtaactccggttcattgttcgtcgactcgccggagcgccgccgcccaatcctggcggtccgctgctttggccgctctccggcggtcgcacgcgcaggaacacccacaggcatgcatgcatggtgatctgatctgatcccgtccgcgagctacgacgagaacgttctcgccacgccgcacgacagccggttcacggccatgctcagtctcgccgcttttgccagccgcagcgcgcggggcaaacggacgccatctcggacgctacgcacgccgcgtgcagagcgtcggcgtggcgaccgcgcgcatggccaggcagagggtgtgcagattaacctgatcgatccccattggaaattctgaatggcatgcagattctgcagttcttgtgggaaaaaaaaaaggagctcttcttcgaaaggcgttgttgttgtattattgggaatgtgctctcagagacaggcatgaactgaattactgaaaccatacaaggttgaagtaaaaaatgccgtactgttcttcaattgcgtaaatgatcatgttagagtagatttttttctctttttttttgaacaatgatgttagagaagaatatcatggtgcattaattgtttgtttgatgcagcacaaaaaggttccagagcaattacagtcgtcaataatccagatatggccactatctgtggattccattatttcatcaagtcttggttagattaactatgattcagattttttgttttttggtacctgaagtaatcatatcaaccgagaactactcctacatccctcgtgaaacgcacatctgttacagtgatgtactagtatatgatatatccaacgcgatattaaaaggagctggttgcaacttgcaaacaaaaatgtgcagtattttattcattagttgaccttattaaagtttaatttactttttttttctataacttgttaagatcgaatttaacactgcatatttaaagatgatatatcgtgcattaatatatcttgttaactttcgttataaaaaaataacgactatttctgtgacataaagaaacgtgatctgtacaaataacactgatcgatctgtacaaaatgcatgcgcccaacttcaaggccttggggaggtcggagttttcttctccgaaaccccctcccgatccaccacctcacgtacacgcacaacgcggccacacctcctctctggcgtacgggaagaagcaccttggcatggtggtcccgtcggccatcctaaccatcagcaagctacgacgtacggacgtgttcccgccacgccgtacgccgcgcacgacagccggtcactaccagcagattcacgaccaaccctgtaggagcgaaaccatcagaaaaattggttttaccgttagaaaatgtattcctgtaggtgaaccgtcagaaatcgccgatagaaaaaaggaccacgagaaattcaattttcctatcaggtagaaaattgcaactggcgtcaagaaatgttaattgtgacgtggacccgtcaggaaaaaccgtcgatcaggctcacggccatgatcgatcaggctcgccgcgcgcttttgcccggccggcgcaacgtacgcagccacagcggcatgcatggtctcccgcggtgtaagtcggcggccggccctagctagcgcccatgcatgcaaaccagacggagtagcaaacgcaggatcgttggcggcgaggcagaacggcgactgcatgcacacaacatcatcggcgaggttgccggccggagctcgcgacgcccctacgggatcgatgtcgctgccgaagcccaagtggtccttcatggctaccctgatggaccatggtcatccaatgcatgtgtactgtgctcatgtgacaaggaaggggtaattaacatagctcatctgatttttaaatacgcgaattggcttagtgctacacgcattctatacacggttggccgcctagcgctatgtgattcttttttataaagtcgcagttagctttgagctacgcgcattatatttttaagacgtggttgccctaaagctcgcgttatattcttaagccacgatttgcccagagctacgtgcatcatattttatgagtcggtatattactcagagattaacaccgcatatgctataaactaatattgagtcacttggttggttaaaattatggttcttactatgtgcttagttgtttcccaactaagcacatagtttgctacagttatcaggtacacctattcgatgtacctgtttatctatcaattcgatgcacctatttttttaatttatttgacgagccctccacagtctctttgcaagatatcaagataaggacttaataagtaaacactcgggaggccttcgcaaagaagattgaagcactcagtatcggtcatgaaccatagagaagactgtaactcgacttcgaaggtttcggaggctaatgtggataatatggataccggataaccacgtgacctccatattcgactagaaatataggaggtgagccgaaaccatgtattatgtaatagagtaaggttcggttgtcatgttgtcctgtatttaaagacctctataccacgacgaggccgacggtggcttcgactgtgttcttccccccattttcccaacccacatctcttgttttccgcgcacacttttcaaactactaaacgatgtgatttataaaaaaaaattctatatgaaagtttttttaaaaaaacatattaatccattttttttaaaaaatagttaatacttaattaatcatgcaataatacgagctttgttttgcatgtcagggagaacccctcctccccaacacagcctagggtgcttcgacgtggtaggtgtgcagtgatggagctctacgatcgaggttggtggcagctcaaggatgttggtcgggagctcaacaaggtcaaggtgcaatgtgctagctggatgaggccactagcggctcaggagctcgacaaagggtgtgtttagttcacatcaaaattgaaagtttgattgaaattggaacgatgtgatggaaaagttgaaaatttatgtgcgtagaaaaatttcgatgtgatagaaaagttaaaagtttgaagaaaaagttgggaactaaaccggcggcttgggagctcgacaaggctgatcataaagtcgtaacagttggatctgggccaccatcgtcaaccttctcgagtacccgtaggccgtagtatgatgaccatcttcgtcatccatcggtccgggcacccgtcgttaatttgctcccaacgcgagatgaaacatcctttcccgaccaaagccaacaatggagtgaagagctcaaccgcaatctcagtcagatctgacgctacctggtgagaagtctctcgagagcttgtgagagaacaggcttctacagtaaaatccccctccccgaccccttttccccccgattccggtggttcgtcgccggcgagggccggaggaggggtcaggccaccttcccgtactagtatagagtaggttaggtcggagttcttccgtagtcaggtcttcctgtagctcgggtttgtcccttttggagtttcgccggtgttgcttcatggcgatcggagaagacgatggtggcggtggtgtttgtggccgtggctgtcccagtgtcgcttttaatctggaccgcagctggcttgctctccacatcaagggtctgcgcggtgtccgacgcaatcccggctgcgtcgctgaagatggacggatctggggcgtttggcgtcctttccatggcgacaagggcttgcggtggtggatctggtgcagctggcctcggttcattgcttggccagagcgatggaggtggatgtggtgtttctgggccggccgtctcaggctctctgacaaggacggatggtgttggctgcaagagctgctgctgctgctcctgctcgttggtgggctgaatgagctgctccagcttgttagttggttgaatctccacatgcttctgctgaagctcttggtggcaagcttgttggttgcttattgaagctctctacggcaacattatcccttcaatctccggtgttgcgtacctccgccaaatcgttacaagacaggggttcagtcgccgttatcctaattcttgcatgttcaaggcaagttggagtatggagactttcttcaaatctccttgcagtagtattcaggttgaggactccattcgggttgagtataaaccgtctagtcggctcttgtcgataggattgtagtctatgctcctcagattcgatggagaactcctagacaatattttgttgagtccggtgaagcttaagaaaaattcatgactcaacaacaaacctcgaatagcgccgtttccgtggaggcagccgaaggggtcaccggtctatcaagcggtgtgcgcgtcttcagtagaggctcgtggacgtggtcgtcgcggcattgccgcagtcccctgtcgatcgcgttctttactgctgtttggattatcttggaggatgtttttcttagttcagctagctttaccttctgaatggatggtgttgttctttgtcttatcttttatggcgatgttttggggatatcatttcctttaagctctgtctgtaatcctcactatttaaataaatttatgagttttaaaaaaaacagtcagatctgacgcctgctccctcccggcccaacaccgtggtaagtacgtgatggggccaccggatacaacggctacagtagtgcttaatttcatcgctagccacaccaaccaagctgttttttcactggtggccatgtttccaagtgttagaagaagataacgactacggaagaaaaatggctaggtgcattatattttgatccctgtgaaaaattacagaattccttccaatcggtcgaccagctcgggggcagcaggatcgtgcgctctcccctaacgcgcacgtgtctcctcctggccccaccacgtatcttcaccatatactccattgcaacaaatcacccacatattttggaaaccctttattaagggaatttgttttattttttttccaccaagaatgtttcacttaatgtacacacattgtttcactatgtatagatctaatattgcagtgaacagaaacattcttttgcaacaaatcacccatttggaaaccctctattaagagaattcgttttattttttgttccataaaaaatgtttcacctagtgtactcataatgtttcactatgtatacatctaatgttgcagtgaactgaaacattcttttgtaacaaatcacccacatattttggaaaccctctattaagggaactcgtttcattttttttcaccaaaaatattttacctagtgtacttacagtgaactgaaacattcattcgctatttgctgaaacattgttttcatacaagatgaaacaacacccaatttaaatgattgaaatattttctatctactcagtgaaacaattccgatatacttggtggaacattgtgcaacatttaaaaataattcaataataagctaaaaaaatttcgtcggaatatatccatgtgtggtcttgttttaaagatttaattgcaatgaatttaatggtgtaatcgaatcatgatttggataaataatttaagagaaaaaatagtttcaagtggttttgcatgtatacgtggcgcgcccgattccccccccccctccatcgggtgcccgacgcgtaggagtccccgaaaaaatatggtataaacaaactcctttaggacgcctcataggcttaggccacataatggcacgtttcgaattttatggtataccaatggcactgagtcgatttaacaaacagtaacgtcatttctccaagacgacgaatttgtaatggcccatatattgcaacaggtccacatatgtaattagagatgagtagcacaacccatatcaatagggatagatcattagtatggattgagcataagtatggattgagcataaaagaatatatccaaccatttttttatgacccgagttcatgagagatagaatcgatagcggcagtataatttaaccaacatgaaatcgtgtactcattttctccatgaaaaatataagggtaaggcaatgcttatggttattatgacaataaggatggaacccgttacagctcggagcaatatttatgataatatctacaatggttaagtttttggaagaacataagatgggtcccgttgagttccaccaaaggaaaaaaagatcacttcctaaccaccccatgcaaggcagcaagctagagaaatagtccgtggacaatgaaaaaaataattttatatttctttcggatgaaccttgggcctaaggttctttttggttgtatgaagcttaaggtgtgcttccacaatggctaaagttacaacacttaatgcttaagactaactttttggtagattgtggttgccctaagtatttagactaaaattttatagtattcctagactgattcatatgatatcatcactttaatgatttcaaagctaatcagatgtttcgaaataaaatgtaaacgatccaaaatttaaaaattgacaactgaagtgactaaaaataaatattttgatatagaaatcctagtatttgctactactacatagaaatccttattttcgagtaattagtaggcgtaggcggcaaaatcttgagctagtaccagattgatccattgtgggtagtaattaaggccttgtttagttccaaaaaattttacccaaaaacatcacatcgactctttgaacacatgtatggagtattaaatatagataaaaaaactaattgtacagtttgcatagaaatcaagagacaaatcttttgaacctaattagtccatgattagccataagtgctacagtaatccacatgtgctaatgacagattaattatacttaataaattcgtctcgcggtttccatgtgagttataaaattagttttttcatttgtgtccgaaaacccctttcgacatccggtcatacgtctgatatgatccaaaaattttcttttcgcgaactaaatacaccctaaagatatgcaaatgatcgtgattgaagtggcatatcagaaaaaaaaacatggataatggagtagaccagcaggtgaggtatttatggccacaccacacggtcacactcacaggtcacatacactagagtgacctattttcggaaacggaatctgtcagtcggaattttttggaaacggaaacggatttggaaatattttctcggaaacggaatcggaaatgataagggcagtttccgtcggaactcggaacccgtcggaaactttccagaaattttctcggaatttccagaattctttctaggaatttccagaaatcacaaaataacctgaattctttttttagcactgaatagttaataccatggtgtttggctattatttttttaaaatatttgttatacaaatctaaaattacataagaatattgggatttatcaacagcattactaatttgttttatagattgtgttttgtgatgtactgttgatacctaacaattggacttatatgattgtgttttatgatgaattgttgaccgttaagacttgagaattgggtttatcagttagaggggtttttttattcaaatttccgttaccgtattcacgccggttcgttttcgctccgttttcggtttcgataatattcgattccgttttcgtatccggggttttcgattccgatttcgattccgaaaaaaatatgaaacgaaaacgataaagatgatttccgtccgttttcgtaccgttttcacccctacactagaggtactagtgtagagtaggcacgcagaagtttcaactttgcagacgagcagtgaattgtgcatcgatctctgtggtattactttgtacgagtagtatcgatcttctgtcgtactgtacgattgtatcgtagtaactcgtaagtatggatcgacttttgatctatagtagtacctacggtgtggcctggcttctttgcgtttccgtctggagtctagcttgccgacccgtgatcaattagcacttcacttttgtcaaagtatttccgaatgtttagttttgggctgggtttagttccaaattttttcttcaacctttcaactttttagaacatcaaaattttcctacacataaaaacttctaacttttccatcacatcgttccaattttaatcaaacttctaattttgacgtgaactaagcacaaccttggtagtactagttagtgtctcagatttatagtgctagtaagtgttccatccattcaaaatcttttatataatgggatggagaaagtatgccgcttgtcacaacccaatgcaggtgttctccatgcagcgttacaagaagctttatgatcgccatcatcgactcatccaccaaatgcctagatataatttaggaggcagcaaacaggcagtacaactccgttccaggatcggctccaccaaatgcttagggagaaactcaattggtttagggttaagtcagtttgaagttgttagggtttgagtatattgtgctagctctagccgtatataaagctgatgagacagacaaggttagattgatttttttgttagccaacttagggataaaaggtgaatgatcgggcttctggctcggccatgagacgcgacttgtgtctcgcggttgattcatgacgaatgtataatttcctattctgattaatgaattctcttccccccaaaaaaagattgattttcttttcctcagccatgtctcgcccggacacataccgtcatagcccatgacaatgaaaggaaacagaggtgcaggaagcggtgtcgtcaccgatcttggtgcgcccgcgtatatttacatggttgccaatagccggcaacatggctttacaggatcataacgaccttggctaatcagtatctctaactaatcctgattacaatcattatctatcagctaagataagatcgatacggccaggttgttatgcttacacatgattatatctaatactccccctcaatcacaacctacctagatcgagattgtacttaaaattttcaagttgtcttaccgataacgcctttgtaaatccatcagccacttgatcacctgtaggagcaaactccacttcaagtaattttcgttgcactctttcacgtacaaaatgatagtcaacctcaatgtgcttagttctagcatggaagacagggttagatgataaatatttagcaccaagattatcataccacagtcgagccattggaggacttggcacactgagttcctctaacagagtttgtatccatatgatttctgctgtagcattagccaaggccttgtattctgatttagtactagaccttgacatagtagcttgtttctttgcattccaggaaaccaaattatcccctagaaatactgcaaaacctcctgtagatcttctatcatctatatttcctacctagtctgcatctgaatatccactaacaagcatagactttgacttactaatctttaaaccaagtttagtacactgttttaaataccttaatattctcttcacagcagcccaatgaactgtagtaggagcatatagaaactgacataccttatttactggaaaggaaatgtctggtctagtcagacttaagtactggagtgctcctactacacttatgtaattagatgcatcattgggacctaataaatctccttcatgcaaagtgagtttctcactagttgacaaaggtgtactaacaggtttacaatcagtcataccaactcgtcttagtagatcagtaacatatttttcctgggttagaacaatgccactagatgccttgttcatctctatgccaagaaagtagtgtaagtcacctagatccttcaaggctaaatccttttataggtccttcagcagagctggaaccgcatcttgtctcgagctagcaacaattatgtcatcaacataaacaagcacaaaaattatcagaccccctttattataaaagaatagagaagtatctgccttggatccttggaatccaaggtgttgaagcttctgacttaacttagcataccatgctctaggtgtctgttttaaaccatagagagctttatcaaacttacacacatagtcaaggatggaccttatcttcatacctaagtggttgttttatgtatacctcttcttcaagaataccatgaaggaatacctagttacgtctacaaagtatctagttactagttgagctgtactgctactagcaaaattataaaaattagacaaaaacaaatacaaaattaaatactcttcacttaaaattgtaattgctgacaaaaattacaaaaccaaaaatttagcaagacttttgatatgtagcaaaatctaatctaccatcagcttgattaatatatagcaaattaaaaattgacaaaaaaaaagaagacaaaactacacaaactcctgatccccactttaattggaattggaaataattagtgaactgttataacaaaacttataacaaatagcccacattcacagtgctcacaaaaatgacaaaaaatgacaaaactaggaagtgaactgttataacaaaacttataacaaatagcccacattcacagtgctcacaaaaatgacaaaactaggaataagtatggctagtagatgacagaacaacctactgctagaagtcaggaaatctcctttagagattatgagctgcttatagaaaattaaacaaaccaaaatacctgctagctgaaaattaaactaaagaaactaagtactcatcattgagaacaaaacttacaaatatatttctaacaaaactaagtacctactcttcacttcaaattctaatgtgatgcatgctaatttctaacattcctaacaaaactatgttatctttattgctaaccagtttactgtttagtagcttatatggtgccctgacaaggtaaattaaccaaaattctactgcagataaattagacaaactacatacagagtgcaaaatttatcccttaagttcacaaacattaatttgtttgcttcaaaaaggaatatttctctgagaaaacacaaaactgtttctaacaattctatgtcttcgcacaatttataacaaaaaaaaaacgttgctcatttccatcctacatcaatgaactaaaattcagtgaaaatagaacataatcttaactttagatggccagatccgttggcggggaggacggggacagtggggagggacaggaagagaaagggagagggcggggtggcgagacaaagagggggaggggaagaggacgcacagcggccacttgcatcctcacctctgcgcatcttcctcccctccggccgaccggatccgccggcggggagccgatgacagagctgggaggaagagggaaaggggagggaggaggagagggagagggcgaggtggtgagacagaaagggggagacgaagaggatgtacggcggcgactcgcatgctcaccctggcgcatcttcctccctccagccaggaggatccgccggcggggagagcgacggcgatggcggcgactcacgtgaggaggcgaagagactggcgaggggaacgcgttgggttcccattcggatccggaataaaacaggtgcacacccaaaactagctgtttgcccggtaacgtttgcacaaatcttggaacaatctgatggccaggaattcagctgataaaacaaaatttttcagcagggtgttgtatagcaaatccccatataagccaacatttgtagacaagcccatactgctgggctccgtgcagacgtgagccggcacaattgtccgcttctccgtgtgcttccatggtactccctccgttcatcttataaaatgttttgactttggtcaaaatcttttgactttggttaaagtcaaacttaattatctaagtttgactaattttttttaagagaaaagtagtaatattcttaacccaagataaatatattatgaaaatttattcaattataaatttaatgaaactatgttgatgttgtaaatattactatttttttctacagagttagtcaaacttataatagtttgactttgacttgaaacggagggagtcactactacaaaaatggtattttcaggcagccaaaaactatttttcccggcgggagagtagtccgtctagaagcaatcgcatgcgaaaatcatcgattttcgcaagcggcccagtcacccgccagtgaaaatcatctctataaaaaaaaaaatcgcggccacccccacccgcgcccctacccacctccggccgatctagggttagggttggggggcgctgccgccgccaggaggtgaggggaagtggggatctgcaggggcgctgccgccaccaccgccctgccccggcatccctccgggcggatctggagggaggggaaccgctgccgccaccaccgccctcccccggcctcccttcggccggatccggagggaggggaaccgccgccgccgccaccttgcctccccccttcggccagatttgggagggaggggaggggagccgtgccgaccgcgtgcctcgcctcatcgtcgacggttccccccgccgccggtcgctgagggagttgagggagagagagttgaggaagaggagaggtgagggagagccggagaggaggagagaactgagaacttagaaaaaaaaatcccctcatgtgtcgagtctatttatattccacactaattttcgcaggcagacaaccagtttcaacccggtttacatttttttaggcggctatttcgctccgatgatcatacccgcctgcaaaaaaaaaatactcaacgttggcaaaaatgttttttctagtagagagtagattctagattgggtatccacatcaagaacataattcagaaaacataatacacaattgtactccaatttaattttactgtgttatgtttcttcttctttcaatcagcttctgaccagcgaagtccttttgtactggaaattgtcaggtaatctctactgcgtgtgttccctaatcgaaggatgtagcagtgcatgtgtattcagttgtagtctcaaacaaaaatatcgagcatttgatgtagatcagaattgtactaatatgaacaaaatttgtgtcccataataaatcaaagaatttaaatttgatttatttggaactattttacttacaaaatctacttataaaaactaattgtactacacaacaataatgtactatatatgcaaactacataaaattcaattttcaaaattattctgtagctttaggtaatccctttactaccatcattaaggctgtgttcggctcctgggttgagaactaatactccgcgcatgtaaaacggatcaactcattggcacataattaattagatattagttatttgtatataaaaaacagattaatataattttttaaaagcaagtttcttatagaaaagttttgcaaacaacgtaccgtaccgtttaatagtttgaaaagcgcgctcgtgaaaaaaaggatgtgagtttgagaaagtgaacaaaacaactcagcctaatggttcttaaaataataaaaatattttccctcgctgtttgtcaagtttaatttatattagagccacaagcaacttgtctggtttaatttatattgattttttaagtgcgttgcatatgcacgattaattactagttctcttaaacttccattccttctctcaatttccaaccaatcaaacaaacctaaatgtaaacgaaccaaaccgtatggcacgtacggcacgggcttgcaaaacaacatgagggagaacgacatcggtgctgccgcctatcgacctcgtgctcaaggcatcgtgcaagcgttgtggctcatcgtcatgagggtgctgcttccgccagccacaccacgatcgatgatcgatgttttgctgttctctttgcacgcgcgtgcataggagtatacaacaccgtcttggtggataccaccgcagagaaggaactctcgatcgatcagcatattcaccgtcgatcggtttggcataacacaatgataaggaagtggatttttatcccctacccttgtatttcatgtcgtccaaaaaattaaaaaaaaattgatatcatagatcaatgtgaaatatgtcattccatagacatacaaaatacaaattcaacctaaataaatagaaacaaaaacaacaaattttattgtgaatagtacacagtcaaatctatcatttttttttacttgtctatgttgaatttgatttttctgtgaaactgacatatttcgtattgatcaattataccttttttttaaaaaaaacagctatttaaattacatgtaaaaatgagaagattcccggaaaataaggctgctccaagcaacaatgaaccggagttttttttatgcccttaatgacactaaaagtttaaaatcttcatctgacggaaaaggtacatgcatgttagagattaactatatatttgcaataaattaattccaatgatagcatgcaactcaagaacttaacccttgcttttgcttttgatcctcctatcgtgtggcacacgtacttatttgacaaaagaaagcaaaaaaagagaggataattacagcaacacaaaaccaaataccccatccgtttctaaatatttgacgccattgacttttgaaaatatgttcaaccgttcgtcttattaaaaaaaattgaagtaattattattttcctatcatttatttattgttaaatatacttatatgtatacatatagttttacatatttcgcaaaagtttttgaaaaagataaacgatcaaacatgtgctaaaaagtcaatggtgttaaatatttagaaatggaggaagtaatttttaaaaagagacaggtaaattaccattatgcgagacggggagccggacgttcatgaggaacggcatctacataggtagccgacatcgggccgagctacccggcgcacgcgtacaggtacaggcttcggagcacggcgttctacctgctgggcaacaacgtacttcgacgtcgatcgacaagctcatctccgccgccgccgacgaccagcgccacccgcctcttgaacagcttcgagcgccgcccacaccaagatcatcctccaggaggtcatggcaaagagagaatggcctagttttagtggtggtgtacactagtatttgtctcgctttacttgtcatcacattcacatatactccctccgtttctaaatatttgacaccgttgactttttagcacatgtttgacggatcgtcttattcaaaaactcttgtgaaatgtgtaaaactatatgtatacatttaagtatatttaacaatgaatcaaatgataggaaaagaattaataattacttcaattttttgttgaataagatgaacagtcaaatatatttaaaaaagtcaacggcgtcaaatatttagaaacggagggagtatatatatatatatcctcctcatcacacatacatattcacatccacgctacgcaatataacttcatatactgagtactaaaaaggcaacagagcagtcactcatttgaattccagttactagtctgtctttatcatccaaacaaagctagcccaacacagcacagggcacttctccaataaaatacaaccaaacctcacatcttgttactaccactgcacattgatgcagccacaaattagatactactactactatcagtaatgcaatgagatgctcgtacaatcaacaaagccacatgacaaatcagaatatcatacacaccctctaagcaaatgctcaagccccatcacacggaggggatgcaaatgaaatgatccattgcatccctcaaataattcttaaaatgagacaggtgaatatcaacaccataccaacgtcaaattcatagcttaactcaacatacggtttgtgacgttgcatggcaacgatttacatacagttcattctagtgatctagtcccagtctccgtgcttcattgacaaaaaaaaaaaaacacgctactactactactgaagccacgatttgagattattgaatactaaaaagcatagcaagtcctgtagaacaacacaaacatgcagtagaataataactcttgtgaatcagctcaacgtcaactaagctaagcaaaaggatcatctagtaagaagaagcaatataggaatgggttttctcgcatctgatccactgtggcttccccagtgccactactagaaaattcattttcgatgtcataggggatcgattttcacaggcggacaagtaattcggagccaaaaccccgccggcaaaaaaagtacccggggtggagggggcggtccgcctgcgaagatttatctttgcaggcgccgcttatatggccggcttaaaaagatgcctctatatagtcttcttcctccccgagccctgttcattctccccgaagtttctctctcctaaagtgacttaaatatatgggggatgttttgaacttcaaatcttcgggggatttttctacggtacttagatctactcatttccacactaggtatgcaattttttaagcttttagaccttaatttgtgatggatttatgcatgcaaaattgtgaaggaagagctccatgttttttaattttatttcttttgatatgttgatgttagatgtatgtgtaatacttgatgcctcttgttgtagtggtttaatgtggtaacataaattctcaattttttttatttttgctatcacatccacctcttagttctagatctagatctagatcttgtcatatatagggagagaataaaatttttaatgtctatttattcggtgcaatcaaaaaatagttatagtattttgtaatatgccgatgatatgattttgttagattttcctaatgtactaatttggcatgtctgtgtaaaaaaaattgaaataaactttgatttttttattactttacacttaacctttagttaattagttttgaatagcgataagttttttcaataaaccctacaaatttggtattaattgtgcaaatattttacgtgtatttttttagagatatggaaagtcgggaatggatgtatcattggccaaggtttttgtctccatatagaaacaaagtgtctaaatttattggtattgccaagacacacgctgagaagaacaatatgaggaagataatttgtccatgcgctgacagtaagaatgaaatagcctggaactttgacaatgcttttaacgtgaaggagtacttagtaactcgtggatttatggacaagtacgaaatatggacatgtcatggcgaagaacaagtggacgggcctgaaaatgtagttccgacacaagttgaagacatggtgcatgacgatggttctattgtggacaaaatcgacctagaggaaatgttacgtcatgcagaacccgaggtgctgatggggtcggctagagggttaaataactttgaagctttacagaaggcagcaaaggaagttttgtatgatgagtcgaagggctgtgacagtgagttcacaacactccggtcagttcttgaacttatgaggttaaaggcgagacatggatggtctgataccaatttcgacagtttgttagaacttctgcagaaaatgctcctgaggcctaactcactaccatccagcacatatcaagcaaagaaactcatatgccccctttcacttggtgtggaaaagattcatgcgtgcgtaaatcactgcatactatacaagaaagaatacgcttctttagatgaatgtccaataagcggtgctagccggtacaaattgaatagcaatactggcctagaaccgtctgacacaactgagggacgacagagaaaaatcccgcagcttgtgatgtggtaccttcttgtcaaagaccgcattaaacggatatactcaaatctgcgagatgcggaactaatacgctggcatgaagaagggcgcaaaaaggatgggatgattcaacacccgacagatgctcgtcagtggataaactttgatgctcagtacagagagtttgctaaagacccacggaacattagatttgccctgagtactgatggagttaatccttttggagacatgagcagctcatatagtacttggccagtgcttctcaccatgtataatcttcctacctggctctgtcaaaagcgaaaatacgtactactctgtatcctcatacagggaccccgtcagcctgtttttcttttatgttagaggtttgaaactatggccgatagtactaaagggactgaagagaaaggtttagtggagcaagagcagtcccttactattgtggttgctccggaaccaacggtcccaccagaagatagttccggcagcgacgtagctcacgaagacgatgagtactcatcaccaagcgatccttgtccaagcccaagcccgaagagaaggaaaaagggcgacggtgaagaaggcgacaaagactacattccccctaaagaaggggtaagtaaacataatatgtaaactgttcaccgtgataactattagcccgagctaatttgaaactgtcatgtataccttctcgtaggaaacggcgccacggcgatcaaaacggcagttccgtcgcaaattgacgaggtaccagctaacacaaccggctcaaagaaaagcgaacggtcagctaaggcgaagaaaaggaagggcgagagaagcgtgaatagaaaggatgaagggttccatgttgttacccatgtttcgccaaaaggagagccgctcgcctctaagacggcacgtgcgaaattcagttcacagtgtggcataatagtaagggaaaagatccccatcacggtgaaggactgggatcatgtatcgaatggggataaggaagtcctatggaaagagttgaagaaaatcttccagttcccggatggatcagaggcagcagtgaggaattgtgcactgcaaacaatggccaagtcttggcgtggttggaaaaccaccttgaacacaaaatttgtcaagacgggacgcacaccattttcgacgtatgacaacataaccccgaatcagtgggatgactttctgatgttgaagaactccccgaaagaaattcaaaggagccaaagtatgcagagttggccaagaagaacaaatttcctcatcgcttaggctccgcgggatacgcaccaaaggtggagcaatggacaaaagaggaggagaaaatgaggaagaaggggcaaccggtaccaatggaggaatggacacagagatcaaggaactgggtaagagctagaactcctaagatcacgaatgaaggaaaagtattgtttgaagatccggagctgtagagcgttgctgataaaatagagaatttatctagttcacagaagaaaggatttttcaagcctaagagggagaaagatgtgctaagtacggcgctgggtactcctgagcatgggggaagggttcgaggtgtgtcgagaaaaatgagttggaaggaagggttcaaacatgacccccacaagaagcgtgaagcgtacaatgataaacttagagacgaaggggctgcggagtttgaaaggcaaatgatggatttctgcgtcaagcacatgattttgcctcgcctcgaaaccaaagaacctgaaccagattaccccttcgatgacctcaaggagaatacgccctgcagattgcacgttcccattggacgctccgggaaaactcttgaggccgctacaaccattgctatccctgggagaacatacaacgaagagttcatacccaatgcgtatgccaaggtgcagccgcaagtggtccacgaagggtttgagtcctacgacattgacttcctgactgcagatggtgtatccgtacttggggatgcggtcgatcttgtaattctctggcacaataatgacatatcctttggattgggcaccgatgccacggaaaaacctttggtgccaaaaccggggttgggaaaacctctgagacctcctaagaggaaggtgactgataaggcggaggaacccgagatgcaaaaggataatctagtgccggaagtgccaccggagattgtagtgccagaggcagccatggagattccagtgccggaaatgcccatggagattacagtggcagaaccagaggtgcaatttgtggcatcagtcgggtcagaaatagaagaagtaccaggattggaatgggacggtacagagccagaaatatttgaagacccttctcctgcgaaagaccccgaggtgcaagagaccactgtccctaagaaggccactaccagttctgaggtgcctagagtgcttaggagccacgactccaagtccaaagatgagaacaaggagaagttcatggtaaccgtcttcagagggggtaaggaacgtgccaagctcagagatgatgacccctagaagaccgctgaactagccgggccaacatacttcacaaccgatgattgcccggaaaagtaccaacatgggaaagcactcttgcctgaatgggcactgaatgaaggaccatgagagatgaaaaggttacataccttctacatggaggccagcaagaaaggcttgggcaatataacagctcgattaccggcagattgtttcggcgaagaaggttatgtatggctagatttctcagatctccacgccatatgtcgtcgggataagatggacgtcaactatgtcggtgtttggtgcatgtgagtatgagttttaattaattatatgaaaaatatgtacaatacaaatccatgtgattgttactaacaaacttcttctgtaggatgcaatacatggatgctaagaagaaaaaagaacctatcggcttcttggatccaactcggatctgccaaacacaacataccgtgaggctagcaccagagtctgaccagctgaagggcatgaatccaaaagagatagctgaatacaagaaaggcttgcacaaggagaaattgattactgtcgcacagtacattggacaagccttcttgcactttcaaaataagagagtcgtcatggccgcttataattttaagtaagtccggtacatttatcttctacacatatgtcttattttagctggtactaactaactatgctgttgttaatatgtagcgatcattatatctgtttactcatccaccctaaagacggaaccgtggtagtcttggaccctctcgattacagacaccagtcatacaaagaatttctagcaatcttacagtagtaagtgattatgactcttgcatttttatatgaatgtattataaataaatatcctccttaatgtgaaacggtacgacatccatacagtgcgtaccagtattacaagttcaaggatggagaacagacccgaactagggagaagctgctagtacgtacctattggccggtaatactccactcacttaatgtataccaattatttcactaattgcaaattttaactatttttttatgatatgtcctgaagtgtcacaagcaaccgtgaggaacggtcctttgcgggtattacgcttgcgaattccttagagttaacgggaggtacaagactaatgcggaggatgtaagtctctatactatatgctagacagcttcacatatttatgatactaatatattgtttatcttcaatgcatgcagttgccaagattagaacgtcgaacaagctttgacgatacaggcatcaaaaatgtccagcgtgatctgtggcacttcatccaccatgagtgctgccatgtgaaaggagatttcttcgacccagagggtgccctagccacaagtgacgaattcaaggatcttcgggagtggaacagtgctatgccataatgtattaactggatggcgtatttgaagtgacaatgtaaaaaaatattgtaatatatatattttggcaacacttttaagtaatgtaatatatgtacatttatcagtgccaaatgcttgataatcttccaatatatgtacataataatctacctgcaagaatttctattaaataatttaaaagtaatttacgggcaaattattattaaatttcaatattttctacctatcttcgcatgctgaagttttttttttttgcaagcggccgattcctattttcgcaggcggatcagactagccaacgtccgcctgcgaaaattatcttcgcaggcggatggccgccccgcctgcgaagatcggcgatcttcacagtcgttggcttacaggtggacggccgccccacctgcgaagacccttttcggccgcttgcgataatgcttttactagtagtgtgcgatcctttacccaatggagcttctgctgaacctggatggacaaactctcccatgtcttgtgccctgtaacgtcttcaagcaactctgataagctggagtaagtcatcaacaggatctgtgctacgaagaaaagtgtatggagcaccatgtccttggcgcctgctctctggtggtacttcatcatataagcactgtaagcacaattcagaaaacgtgttataactttgtctcagtgttagtaggcaagcagctaaagcaaatgatttgcatcagtaatagaatcacctgtgttgttccaaggcctccacaatcttacccactgctgctcccagagcttcaccttgattgactttgccattgacatccatcactcccgcggcgcgcagctcctcggcaaatcggttggtggcggaggacgggaggggacgctgaggaggcatcagccgcacagaaccatcgccaaacaagagcttgtgcacccttttcagggcagcaacgacagccatcctctccggggatgtcgtcggccccagcagcagccgcacaagccgctcgccggcaagcgcggcgccggcgcgatccagaaatcgagtcttggccgcgtccttcacgccggcgaccgccgacgtggacttggctctgtacacgacgaaggtcgccgcctggagcagaccgccgggcacctccgaagcggtccacctgctcctgccgccgaggctgccaggcatggcccggaaggggacgacccagaccgcagccgctcccctgctgccgccggcggagagagcggacggcagggtccagcggtcggcgacgaggccgccggcgccggggtggtcggtggtggcggtgaaaagagagctctttatcttgacttggacgggaatcggctcgccgaggacgccgaccttgccgcggaacggcacgccgttcaccgccgtcgcctggaacagcgcgccgccgccagctgcctccgaagcggtcctcctgccgccgtggtgctcgacgacgacgacatccttccccttgccaggcatggcccagaacaggacgaccccgaccgcagccgctccactgctgccgccggcggagggagcggtcggcagggtccagcggtcggcgacgaggccgccggcgccggggtggtcggcggcggcggaacgggcggacgctgccccggccgttgcgatggtgcgcgcaaacgacggcactgccgccgtgttgctggccttggccaacacgcggatcattcttcgtcgtcgtcgtcggcggcggcggcggcggcggcggaggattgggaaaaccctaagtagatagtttggcgtgtagcgtagcctgccggcgtgggagaggagggaagtgttttggcgtgggaggtgggagacagtgggatggacaggtgggagacagtggatggactgatgggtgtttggatgggatgtactctctccgttctaaaatataagtatttttaaactctaacacggtttttgagatattatttttgaccaaaaatatctacaataataaaatgttttaaataaaaagatatgtatattatgatagtttgtttaatgataaatctaataacatcaattttacatgattaatcttttttatttttttgtcattaatgattaaagttaaaaatatttgacttgtcactatgctaaaactgcttatattttggaacggaggagggagtaattaattaagtaaatcaacatctatattactatttttctatataaaagttaaaatacatcatttgaacgtaccagcaacaaccaaacaaccacgaaacattaatattttagtgtcatcttaaatcattctacgcaatacagattcatctaacgttctattaagtcaccatgtgtcacattttaaaactagaaaaaattcttagaaattcgagcatcattagtttctacttaaatcgatagcctattattttcaagcactataaacatatcatgtcttgaaaaatagggggaaaatgagaaatctgagaaaaaggacacctgattattggatttcacttaaatcattcacgaaaatagaaatagaaagtcaccttcacctccctcgctcatatgcccacaacactacccacccctctctcttttggcccgaactctacgctcttcattaatcataagctatcaaagtgaaatagtcaatagttataagatacatgtgcgatgtctgatctaacttttattgtattataatgaaaaaaaaatgcaagcatatgcctatattttgttatataagaaatatgaaatttgggaacaatgacccgtgcactatcaataattatcaacacaaattacgtctttatacatcaaagtataaaacagtattttttttttgacggacaacatccctgccctttttacatgtcatccaaagataaaataactatgaaataattcagcaacataggatgcaccatcatatattattctgtaaacataaaaactaaattaaatatacaatgcctaagaaaaatatatcaaataaaaaaatcggtgggacatataccattggccttttacatgtcatccgaattgccataaaagaattataaaataattcaataatacaagttgagccaccatacgttgttttgcaaacatgaattaaattaagaaatgaaactttaactcaaatataaatagtccaaatcacttcataaaaaatccagtggctttagttatagaaaacaaatcgaattactttatgttttttaaaattaatgtggtcaaataattcgagtagcctaagcgctctaaatcatctaatagattttttaaggtaccatctaattgattttagatggtgtttaatgcactttggtatatccgtagatattcaagcatgtattcataataaatcacattaaaaaaatgtgtgcacaattatatttagccctccgattgtattcacgctaggctatagagagcctcgcacactctacataaaacgtccacatataggttatttcccacactatgcaatcactcaacaaactcatgcattcagataggttacattcaattaatagtgagaacctatatcggtcttacatgcttatacaaaaggtagcccatttatttttcaaaaaaatgacataaaatgtgtaacgcaccgtcactatttaacatatcacaaagtttaaacttaaaataagaattgtataaaacaaaacagaaaatagaaaaaaaagggccaatatgaactgcattaattgaactaattggagaaaatcttattatttcttttgattcatacttgcacttaaattgaaacaaccattgccataaccattgcatcattttttttaattaagtgcttagatattaatattttttctctatcctacaccatggtattatgattttctccacatattattgcaagtataagcaaaaatattaaggttacagtatatagttgatttagaagttatattcataactattaaatttaatttttaagggtcaagctgattagatttttctttttaaaagtacaatggatcacacatatcatagggaatcgagacctaggatgtatgtatatatcctctgtcttattcatatataagtagtaattaaagtgcatcaatataaaccaaataaaaggagggctagctaaatggtataaataaaacacatttgttagcaataatagtcttttaagatttgatagagaaaacatagctcctaaacattcattttttttaaaaaaaaacacctactttttaatttacatttaatttgttagatatgttttctgaacaaactaagtctgttatattttaagtgatgaagaagattacatataattgcttaaagaatgattaaatattataccgaaaaagctaacaaacagattaaaattttatctaagcaacacattctacaatacatgcccgcgcaaatgcgtgggctacattcctagtttattaaaactgggatacattacctatacgtataaatgtatccctcatctatttataaacttgtcgatcttcttggctgagcacatattttgaacatcctttttttttctcccagtggagctcgcgtccaaggatttctgtacacatccacatgataccgggcatcacatattcacatcgatgtggagattgctgctccccccccccctcctccgtcaaacagaatcctgtcactattggagaaaccatttgtagtgccggttgggaaccccctgtagtcctggttttctaaccgggactaaagatgcacatctttagtcccgggtgaaataaccgggagtaaagttgactaaagagagggtagcgccgtcccggttggtccccttttcttttcttttttcattgtttctttgctacttgctagggttaatcaaaccccaaatccccaaatcaatgtaacatcccaaatcattcacatcataaatcctaagttacttatacacacaaatcaaatacatcacaaatcttaaaaaatttacacacaaatcaaatacatcacagatcaattatacatctataaatcacaaattatcaaaaaaaagaaagaaaaaaaacgacagaggagaactagcgcgctgtcgcccgccatggatgctgctcgccacggccagcgcctgccacctgcggccccgccggcgccgccacgcgctgccccgccagtcgccgccgggcgcggccccgccagctgccgctgcgcgctaccccgcaggccgcttgcccgccgccgccggccgccggatgggaggaaaggggaggagaggaggaagggaggaggagaagggaggggaggggaggagaaaggggaggagatccgaggggtaggaggtgaggggatgatttgatcttatctaaatatctcggtgaggagtaaagtctcgtctgggacttaaccgatcagagatgggagagaaatatttactccctccaaccgggactaaagatagatttttaatcccggttggtattatcaaccgggattaaagatctaaccaaccgggactaaagtggtgatctttactccactaaagatcctcgacctcctgacaagcctctgataggggatgaatcgagactaaaaataatatttagttaatgtggaaaacaaccaacctagcaaagatcactcttcccagtagtgtgtgcttgctttccctctcctcgatccccgtcacctgggcatgcatcgcgactgatggagtgcatcgccagaagctagctagcccacgcgctggctgcttcttcctgggttaagccacaacttgcaaaccatggctcacggttatggcgctcgtggagacgtggttgctcatggccgcagttgggggcaacagcggcgaggctcgtgcacggccatggaagcacatggggataatatgacggtggtgcactgcatggaacggagtttactggtagtgactgacttgtatggttcttggcgtgcgtggagtgagcatatctagtgctatatatacaccgtacgtacatttccgagcacatacggtctgcatgcgatggacggaccgggtacgtactactgttacactccaccatttctgattctgagcaaaactcctgctctgtgcggtatacagcataggattaattagaacattgagaggataggtgaactattagcgtataattaatagagtatcaattatttcaaattcaaaatatattagtttgaaattttaaaataactttcctacagaaaatattggtaaaacacaaaacgtttagtttttttctcgatcagttgttgccgaacgcagccggattatctgatttttttttcagcttgtagctatttgaaggtactactatgaacatgccctcatattcgagaggaatgaggagtactatgagatatttcaaaacatggccaatatgtaatggatatatacaatggcgaatctaagatgaaaatagagatggtgctaatgcatagagctaaaaatataactcagtactagaaatcatatttcctgaaaaatatgaacttaaaaatatccatgtttcattttggaaaaacatgtatgctcagttgaattaaaccctccaattaatgtgccctaatcagatacaaaccaagagctccttgtagatggtaatatctgtgttgtcttgtcctcgccagtttggtaattgaattggtaattgtcctcaccggtttggtaattgaattgggcttggtatagcatttagcaattaataaacactggataacagattgagcactaatcaaaccgcagagctataggcaagttttcttcctctctagtcgctgcaggccccaacatgtatactctaactgtcccagtgtcttctactagctttgaacttattgggagaacacttggggctagaagctggagctagggcttgcgctccaacaagcccaacagtgaatccgcccctggatatatacatagcaaaaagaaacttttggaaaaagacaaaaaaacaactctcttgatagtatgttgtgatgcacatttgatcaatgtatgcttttaacttgttatttttagggtattttaaaaatatatatacaagttagataacctatataaaaattctagatatgttagtgaataaagttcatttgtatttctagtacaccgtattaatagagagcaactagtgtggatcaagtacaaagctaaaaatacaagattacaaccctggagggtcgtaaccaggaaaaaagaaaaaatataccaccacccacacaccgacaacgccaacacataacccgggagaagactagcaccggaccggccgccgctaagcgtgaccgaccgccgctagaccaacaaaggtacacagacgagatcgccccctaggggatgctaaaacgacgtcttcaaaaagagaagcgacggaaaaaccaccgccgccgtccgtcggggctcaaagaagccaaagactaggctttcgcccggcaaccacccttagggggtgagacagcacgacaacgccctcaggattttcacccgccgctcaccacctgcgaatccacggctgacgcaccgatgctccatcaccactcaagctctactgacatgtgggacccctacaccgatgtcttccgctggtcagccttcgagcgccgaagaccacgcacacccactggcaactcctcctcacaccgaggtcacctcctccaccaccggccgcgcctctcgcgctaagccggcctccttcaccggacgcgcctcttgcgccgatctagcctccctccatcagccgcgcctctcacgccaagccggcctccatctccgccgcccgcgcctctcgcgccgagccggcctccgctaccatcggctgcgccactctgcgccaagccggtctccgacccctcctccaaacgataccgcactgaccagatgcaaccgtctgccacaccctcagctagccgtccgaggccgccatgcctccggtgaccgcagtcaccgccaccgcagccgctgctgccgaacacaccaccgtgcctcctcccaccgtgccacagcagtcaccggtcagccgctgacaccaccgctgcgccgagctccgaggcctcagcctccgcaccgtcagccacagccgccgccaccacgtgtgttgccgcggctgcctcaaaccacaaccgcggcagccaccggcaccgccgccgtcgagcctcgcgccgccgtcgccgccatgttgccgttgtcgctcgccccgctgccgcccggcccggcggcgcgagctccgtctcccgcgcacatgtcctcgccgcggcagctgccgccagcagccgtgcaagcgtcgtcaccgccgcctccgctgccaacgccgcgccgttgccgccgccttgtcgcgccggtgctgccgcccttcacgcgccgccgcgccacggccttgtccgccaccaaccacacaccctccggccggatccggccaggagatggccagatccgacgaaggtggcgccggatccgccgtctcctcgctgggat

SEQ ID NO: 59133 - DNA, 5139 bp, Oryza sativa
aaaactttcctgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagacctagaaccaagcataaattaaagcaaaaggtacagaatgtcgagcacacgttctgggataaacaaaataagcccttgtttagttctagctttttcgtcacatcaaacgtttctacacacacaaacttataacttttccggcacatcattccaatttttttgaactttcaattttagcgtggaactaaacatagcctaactatttatgtgaataaaacagaaagaaacgcaagaatttataggcctggtttagttcttactcctgctgaatgaagaggactttcattgccttgatgatatcgttgtctgcgtacacacccaggtctccagctccatccttcacagccttgctggccttcacagtgagcacgcgagggcgaagaagaagatgaaggcgcctccacgacggacatgtcggcggcggtggccacccgcggcatggtggaaccatcgccccggtagatccttgccaggcgagccaaagcgatgtgggccctttgggatcccaccatgacgcgtcgaagcgccacggccaccccgacgatcttggcgcgcacggcggcgaggacggtcgacttgccggtggcggtggcgaggcccctgctgcagacggcagcgagggcggtcgacttggcggcggtggcggaggcggcggtggcgaggcccctgctgcagacggcggcgagggcggtcgacttggggccggtggcggcggcggcggtggcgaggccccagctgcagcctgccgcggccgatggagagcgcagggtgggggtgttgccgggcaacagcggcagcttgggcgctgcaggtccggccttgctgcagctaccggcgacggtggtggcccagatgcagcctgccgcggccgagggagcgttcttggtctgccggtcgacgagttggtggtggatgctcctcttggtggcggcaactgcagggcctggacggaggacggtgagcagggtcgagggccgcctcaacctgccggcgatgaacccgagcatggcggcggggtggattcgcggcggcgcggcgggatggagacgggaaccctagcgcgcggcttcgagtgacgacacgagacgagaggaagggtagctttgctgtgcgtgcttgctgtcaaactcgccacacgcgctaatcacaattaccacccatcattgtcttaaacattttttttctaatattagattactcctactgtactaaatagtactccccccgtcccaaaatataagggattttgagttttttgttgcactattttgactactcgtcttattcaaaaaatttatgcaaatataaaaaacgaaaaattgtgcttaaagtattttagataataaagtaagtcaaaaataataataattttaaatttttttaaataagacgagtgttcaaatagtgcaagcaaaaactcaaaatcccttatattattgctattaaacctttgatgtttgacaacataggaatataaaatatacagtaatgtaatttcatgccacaacaaacccttcctatagaaaatgaatccacgtgatttttccaaaaaaggaaaaatgtttggtagttccataggaaaaggataggcattgcgagtcacacggaaagaaaaaacatgagatcgatctaaaggagccatgttagttgccctccaaaatttcattggaataagccatttcataggttatcctagtcttcctttgttccaatgagccattctggaatattttctagcgcattcataattcctattctttttgttggttctaaaggagcccttgactccttgaggcaagtgtgtagtgacacacgagtaagtaaggacattaaattcatatattagagaataccttcaagtgatgttatattaatgttataagtataattaatggaaggtgagaaattggtcaaagtacaacaaacaaagatcgtacgtaaactaatacacttgatatatttttgggacgggacggagggaagatgtgctattgtcgtatcgatcgaattcctgctttatatttcaaaccttaatctttttcttctttctgttagtactattttctttaaaaaaaatatttatttttattattatatatatagatgtatccatgtttgtaaaaataccaagggtgaatttaggagccacacccacaaaactgggtggctcgttggcgcataattaatttagtattctttccgttccaaaatgttaaaacctattaggataagttccatttgaatttggatggaagaagtattatctgtaaagaaaacttaaaaataggttggtgtgatttttttaaaatcaaattttatgtaaatattttgttgaaagaaaaatgtaccgttttgtttaaaactaacgtgggaggtataaaagtgaggtgagggtagaagttgagtgtatcccttctttagatcttaaaaaattttaggcaaaaacgtcacatcaaatgtttggacacatgcatagggtattaaatgtggaaaaaaaaaactaattgcacagtttgtatgtgtaaattgagagacgaatcttttaagcctaatcacaccatgatttgataatatgatgctctagtaaacatttactaatgacagattaattaggcttaataaattcatctcgcagtttacaacgtggaatctgtaattgtaatttgttttattattagtctacgtgttcgtatactttaaaaacttacaaaggttctataggctggctgccaggcccctttccaaacaccactttaagatctttcaccatagcaaacactgttttaccgctgcgatgttttggcttcgtacggtggtccgccgtatgttcaaagtgcttgcctttcttccgtactgggtggtttgctgcaaggaatcgatgatgacccatgtacacaaccttccgacagtgcttaagatacgtactttttgtttcatccatacagtgtgtgcaagccttgtaccccttgttggactgcccggataggttgctaagtgcaggccaatcgttgatggttacgaacagcagcgctcgtacgttaaactcctcctgtttgtcctcgtcccacacggggacaccttccttcttccacaacagtttaagatcttcgaccagtggtcttaggtatacgtcgatgtcgttaccaggttgcttggggccttgaataataatcggcattattatgtacttcctcttcatgcatagccaaggggggaggttgtagatacacatcataacgggccaagtgctatggccgctgctcatctctccaaaaggattcatgtcatccgcacttaaaccaaaccgtatgtttcgtacgtcctttccaaagtctttaaattttctgtcgatgtttcaccactgcgaaccatcggcggggtgtctcagcatcccgtcctgttgacgttcttcagcgtgccaacgcatcattctagcattccccttgtttctgaacaaacgccttagccgtggtattatagggaaataccacatcaccttagcaggaattctcttcttcgttagctgcccgtcaaccttacctggatcatcttgtctaatcttgtatcgtagtgctttacaaatagggcatgcttctaggctctcgtactcctcaccgcgatataggatacaatcattcggacatgcgtgaatcttctgaacttccagtcctagagggcagactatcttcttagcctcgtacgttgtcccgggtaatttgttttcctccggaagaatgttcttgacgagtttcaataaatcgccaaatgccttgtcactaacaccatcttttgccttctattgtaagaacttcagagtggtatccaactttttgtgcccctgctcgcaacctgggtacaacgacgttctgtggtcctctaacatccgctccaatttatgggaccccttttcactttcacagtcctcctttgcgtcctgcaacatctgaccaagatcatctgcagcgtcattatcgccagcatccctgtccacctcgtccgtttgattttcttcaaatccagcgtactgagcccagtcgggaatgttctcgtcctccgcttcaccttcttccatttcaacctcttgctcactgtgggatgtccaacaattatagcttggcatgaaccccaactcaaacaagtggaaatgaatagtcctggatgcagaatattccttctggttcttacacttattgcatggacaacaaataaaaccgttacgcttgttagcttcggccactctcaaaaaataatgcacgccctcgataaactctttggaccgccggtcaacgtacatccattgccgatccatctacatgaaatgaaaaaaaattgtacataaataaattttcgtacaataatgacagtcaaacagtaatgataaaataattaaaaactctttcgacaagcaattcttattaacaatttttgaagttctaaactaatattaatgttgtacttctcttaattttcaatttagtttgttttctattttttaagtaattttcatcatattttaaactatgagaataaaatttctatatattcttcttccccacacaaattttctctctcatcaacttacaacaaagttttggagaaaaaaaatgtgtgaaacatagctccaaaagtaatataacaacaaaaaaaaatcttggatgatgaagttactaaccttttagacacctccgatttgtatataatcactaaaagaatttcacaacatattttggcatgacctcccctctttctttgagaaattttgaagcttgctctcgggctggaggaggaagaaggcatatataaagggggggatctctc

SEQ ID NO: 59134 - DNA, 36496 bp, Oryza sativa
gggactaaagatcccgggggccctgacaacgtctgacatctctacaactgggactaaagatgatctataccaactgggactaaagatcacatatgaccgttgtagccaccaatcaggactaaagatccggttttaaatggatccgggattattgtggatttcggccgaccgaccaaagatggtttctccaccagtgcttgctccgtctccacccaccctttcctctttcgctctccgcctactccgcttagggcagtagcaatgcaaagccatccttctgtgtcttctgttattccctactatcgccgtgtttagatgctgtaaaaatttggctaattttcttttatgtacacagacacatattttaagtattaaacgtagactaataacaaaacaaattactgatttcgactgtaaactgtgagatgaatcttttgagcgtaattgatccgtcattagcacatgtatgttactgtagcacttatggttaatcacgatgtaattagacttaaaagattcgtctcacgatttatagttggactgtgcaattaatttttctttttgttcacatttgatgctccatacatgtgtccaaacatttgatgtgatgaaaaagttggaatctaaacacagcttatacacagtgggcgttatctgttttggcacaatgcaagttaccaaggttagcattgatatcccaggccaaggaatatgttccccaactacccctttgttctcctcgacgcatcgcctccccacccacttcatctcccaatcccccgctttttcccccagttcgtgatgatgctgctccgacggagacggcggcggcagcggcggcggtgatggtggtgaaggtgtgcgaccacgacggggcccaaggaacggttctttcgacggccgccggcacggcggccgcacacgcctcaggcgagtcctgcaactgccgctacgtcggctgcctcgccacgtcctcgccgccctgccattgcttctcgtcgcggtctgcggtctgcccctgggacttctccagcagagacagcgaggcgggagcgaggtcacacatggagccgaactagcgtgagaggaatagaggaatacctctctctttttctttcttatctcatgtcctagctctcccctcctcctagatccagttctcccctctccctcaacatcttcttcctctttcaattcgacgggaggggtagcggccgcggcaaggggagcccgtgggcagagtttctcccacagttggcggtagcagagctcgggtcgtgggcggcggatgatgtgctattttttggtcgtgtggatgtgtgccgatggaggtgaaccaatgcgatgcaattcgctgagatgccggctggtgcggctgtgcaagccgctcatatattctcccttcgtctcataatgtaaggtattttgactttttgtttatactgtttgaccattcgtcttattaaaaaaaatttagaattattgtttattttatttgtgacttatttattatccaaagtattttaagcacaactttttattttttatatttgcataatttggtcaaacagtgcaagaaaaaaaattaaaatttcttatattataggacggatggagtatgtcaggggacgtcgatcaaagtccgaccccgtgcaaacagctagtagtagatgatctcgtgcatgtgcaccgtgcacgcgtacggggtggcggcggttattttgttgaattgaatcgccccttgccgagctgaccgacgtctctgccatagtgccatccgcgacgatatatcgatcggcggcaaggccgtctccagatatttggggccaccgaacgaaatgctaattggatcctaaattttgaaaattttatataactaatataaacaaagcatactttcaatcaactatataactttaatatgtgttattttatacaaatattaatgctaaaagagaaaaggtagtactactgatctcatgttgtactgaaaagtgaaaagcatcatccttctagtgtttcttggaatgaaatcttaaattatatcttcataattaatatcgagattgagctgctgcatctagcctgtctcttcctacgtttttcagcacctgaatcatactttctgtttctagaagtgatgaagtgatgaggaattaaagcaattgaggaaataaaagccttcctgagttcctgttttataaacaaaataaagaaaaagacatatgtcgtatacatacatacatacatacatacatacatacagtatacacacttgattagagaatcagagatgactagataagatgagatcagatgaaagtctagttcgttcgtcaaattacttgatgatcaaactccctttgattcatagaattggaaaaggattttcataggattcaaatttctatggatcttttttctacatgtccctttgatttatagaaaagaaaggaaactacaatcctatgctttccatttcataggaaaaatagcaagagatgtgacctctttgtgaacttttctttatttttcctatagcactatcaaagactcctattgtttttcttgtgttcgctaattcctataggatttgagaaacctactactttaattcttgtgtttttttttattcctgtgttttttctatcctgcgaatcaaagggccctcagtctggttgccaggggcgccctcgccggctcgcgcttgctggttgccggcttgccgcgcgcgaccgcatgccggagttagccacgccgccgctgccgctcgatcggcgctcgcccgctcgattggccggcgattgttgtgctgtctgcctgcgcgtgcgctgcagcctcgcgtcctccctgcctcggctgctcagtccattgtccacgcctccatggccatccaacagaccaacacagcaacttaacactaaacgctcgcgagttggagtcggtgaatcgcggcgacgcctcgactaacgcatgcatgctgcgagcgatcaccaatcaccgcgcgcttgagatgaaaacaaggcaactacgctcgcgagacgcgacgcgacgcctcggactgcaaacttccgccgttctcgcacacccccatcgacggccctgatcggcggtcgatctggtggctgtggtgcacggcgatccagcgacgccgcgcgactcgggtctccagcctccaactgccactacccgaccgacaaaacctcggactcgtctcctgcgaaaagctaattaatccctcggtaaaaaaaaaattggatgtgacatattcttgtatatacaatgaatatggataaatgactagtttagtttccaacttttatttttaaactttcaactttttcatcacatcaaaactttcctacacacaaacttccaactttccgtcacatcattctaatttcaatcaaactttcaattttgtcgtgaactaaacactctcgtatattggttttttatactaaatccgtcctaaaatgtaaacatttttagctataaatttaaacatttacattttggaacggagggagtaacatatgatcttgagcatcaagcacgtaggagtactggagtagtaagctggcgaagaaccaccgatcgaggatctgcttgagttcacgcccgcatgcagtcaccgtctagcttgacgtagggtttaccagaccttacgaaattttttttttaaaaaaagtaaatcggacttaccaagccaaatatcacttggtttaatttgcgattatgctttaaaaatcaaattgaattttaatttgtcgataattaaattagttttttttcccatgcacgcactgtcctgcgttaggttaatattatactgtcgctcggcgtcgttcaggaattaattcgttgtcctctcgaacgaataatttctttacgtctgatgcaacgacatacaatattaatgagagagatgcctgcatataattacttatactgaccggaggatctggtctctgtttttcactagtaaaagagattatcatggacaaccttttttttcgtaggtgccaggcggggctaaaaatttttttttggttcccagtaatataaagaccaattatgaaaattctttttctcaggtgaacctattaagaggcccgcctagctgcaaggtcaacctctcgtcctctcttccctctcaatatttttaaaagttaataagtcacccatacttatatcctcagctcctctctctctcctgctcacaaactcatcacctgctctttctcgcatggtagtttgaataacatgctaatgaaaactatggtaaaatatatatcttagttagaaactaacaggggcctaagtattgggtgcatggagactataaatataactatctcatttgaaacaaatagaaaaaaaatgcttaagacttttagatggagaaagtactgacatagcacctactcttatttgctatagtaatttggtttagcacacattaattaaggcctagttaaaatgcatgatctatactcctttaaaatcagtaatttgtggtgggagcgaatctgccattccacctaatttcattgcaaattttacaactcacctcttcaactttttaatactaagaatcaatcaaatctaaatgggacatataaaatcgaattgaagtaatcattcccaataggaaaaagatgtgtaacccacactattatcgtaaattttcttttatccatatcaaaacaccgaaaacacacagagttgaagtactagcatgagtgtgtttcatcaactctacaatattaattaaaaacacagaaaaaacgagaagaggtgccttggttgcatcactgacaaattgaattagaagaaagttttcataagggtttaatctcttgcttatttttctatgaatttgagtaggaacacgatccaataaaaaattttctgtcatgcatgttttctatgaatcttaggtgtatctagaaaaaagaccagaaaatttaaatctactcaaaatcctttggctgtgtttagttacacatcaaaattgaaagtttaaagaaattgaaatgatgtgacggaaaagttagaagtttgtgtgcgtagaaagttcgatgtgatgaaaaaaataaaagtttgaagaaaaaaaagttgaaatcaggacctttgccaaatctttcatttcaaatgctcacagtagcaataaaatattgcatgaatgttcatgtcaagtttatactcatcacacgcacagtaatctagtcagacatgcataccttgagcagctgccccctgccctgcatggtgactggagtaatagaggggtgtttagattaggggtggaaagttttggagtatcacatcagatatacgggcacatatttaaagtattaaacgtagtctaataataaaacaaattacataatctgtctgtaaattgtgagatgaatatattaagcctaattaattcgttattagcaaatgtttactgtagcaccatattatcaaatcatgaaacaattaggcttaaaagattcgtctcgtaaattagtcgcaatttatgtaattagttattttttagcctatatttaatattttatgcgagtattcaaacattccatgtgatagggtaaaaaaatttgagagggatttaaacagggcctagatgatgatgagtgtggcagacaagagtggatctgatatgggtgccacagtggctataagctcccttgggagttgttgcttgcttgcttcggtcggatgattgatttacaccatgccctagccctgcccaagcatatgcctattgctagtcactctactccgagagcgagcaagcaacaattcgtgtaaaaatctatcgcgctagtgaggccttgtttatataaaaaaaaatttctcaaaaacatcacatcaaatatttagacatatacataggataataaatgtgagaaaaaatcaattgcacagtttacatgtaaattacgagacgaatcttttgagcctaattagtaattacgcaatgatttgataatgtaatgctacagtaaacatttgctaataacggattaactaggcttaataaatttgtctcacagtttacaggcgaatctgtaatttgtattattagtctacgtttaataatttaaatatgtgtccatatatctaaaaactttaagccgaataaaagtgaacacacccttactccttagagtctactctactatgtggctcgccatgctccaatgcgtcatgactataggaactagcaatagatttcgtacgaaattacgaatactagtagcgaagctcgttctagctgttccttaatttggatttggaggatttctcatgaaaactttagattattggagttcacaaggattttatacttgcatgcacgctcttttggactagaagaataatgccctgttctttctatatatttcgtcggattatattttatccacagttctagaaatatgttttcttagaaaaaaaaactttctctaccgtatcgttgggattaatttttctatactatacaaatttatttacaaaaatatataatttatctctattatcaaatagataatccgatgtaataattcggtaaataatatgggcctaagcttgataaagcttatgaaatagtttaatttcctaccctttcatttcaaaggaaaacaaagtttatttcgtgcgaaccatccagcgtcattacctcaaatattcttgtgtttcaaaaatcatgtgggcttctgatcgttttgcctgtgactcaaattgcagaaaaacagcatgtacacaattaaaaaaaattgcagggtaaattttgtaaatcaactaaaaatatcgagttttaaaatttaaattttagccacggctgataagtactcccttcatcccaaaatattataatttgtagcccttaaggtttgtcctaaatataataaattattcacaatattctcttcccaccaaatcacaacctatttttcacctacctcctcttctcatacatttataacattttcctatttaattttacgtactttcttaataccatatccaactctaaaaatctttatattctggaataagcagcagaaagcaaaacaacgaggacattggtattcaaaaaagcatggcatttaattcctgcatttttctattcatttttttaataatggaatgagtcagcctttgctcaagagctacagccaactattacagaattcacacaaaagaaactcacacctaaagttcacaattgcaaaaacaaaacaaatggcaagcacaaactagtagacaccaacacaagataaagatcctataactatagaattttattagagaacctccatccaaagttggcaaaaagttacatgatcgtcgtctcaaatttacgacttacatcatttataaaaaaaaattacattttcctattcatgttcctgtgaatcatgcattacaaagaagctctcaaacatgtacattatctattacggagtgtttagattttaggcgaagtctcttctctaaataaattatcctaacaaaaagaataaaaaaatacatgaaataaacttatagtcactcataaaaactttaaaaatacatgaaaagagaatttcaataaaataaaaccatatataatagataaattgtaacttaaaagaaccgaagctagctagcccgcccatgaaatctagcaattccctaggatatttttattttaaaaaaatcggtgttccatgttcacgctgggctctagggttgaaaaaaaaaacaggaatagataaaacatacgaatatggtaagattgtggatgtaaagcggtcactactacagaaagggacatataattaagtcggcactataggtgatggaaatggtataaccttcgtcctaaacatgtgcccgcaaggacaccaatggcaagaatcagcacctaagagcccacaaggacaccaatagcaagaaccggcacctttgtatataaataggtgccggtttttaattggaactgacacatattttttgtcagagaaagatgctggttccagctaaaaaccgacacatatatgactgtcagtcataggtgttgttccgagctgataaatcgacacttttatgcggattgagccaatcttatccaatcgaatcaaacgaaccttttttttcgccacccttactttttttgtctcccttatctcctccttttcttcacccacacatctttgtcttttcgcctctctttttctccgccttctctctctccaccggcatggaggcggcggctgctccccctacccggtgttgcggcagcggctgctgctgctccccctccctggcgtggcggtggctggtgctgcttcctccctccccctccccccagcgtggcgatggcagctgctactgctctcccttcccggcggtgctgctcccccccttccctgacatggagccgacggtggttctcaccagcatggcaacaatttgatttgtgaatattttgtggggattttatgatttgggatgttgattcagtaaccactgaaggaaaggaattgcttcctatgatttgcctatggccaattcctgcatccaaaggcatgaacagtaaaacatcctatgggatttgcaatcctatcttgttccatcaaaaaaggaccttggttgaaaatggcatcttaattctccattctctggctctatatttgtgaagtcacgtattcacgaaaatgtcatcaggggctccttttgaacaatgggaaactaaggaattttggagaactagattcctatggaaaaatttcgtatgtgctcctttggaacaaaagaatatgtcttccaaatcatttaaagtccctatgaaatgggccatttcatatgtaggaatttcgaaagaaaactagcattatcatattttcttattcctatggcacaaagttaactttgtaacttttttcgctgtgtcatccaaacaacagtttcgaagcattcctatatatattattaatgtccataagaattcaattagcataacactttttccccgtgtcttttatctttctttgtttttagaataccgtgttctaaatgagccctacatgtctaaaactagcttgtaggaggcatatccttataatcattaaacatggtgaatcgttaaatgacttaaaaatgctacaaaatgaatcaaaaagagaaaaaacatatactaaaattatgtttttaaagtttaagttttagctattgagcaatcgtctagcgtggctggcctcggccagaaacaagctgccatacatagtctgctcctcgtactctagggctacctaggggaggacaggaggagtacgtggtgggatcctctgtgcagttgagtcacttacatgtggaccatagtaaaatgggacccacatatcagtgactcaactgcatatgcagtaagtcagaagatctgctttcggaggagtactagcagcagctataggccacctccccccacccatccaaaaaaataaaaataaaatcggccgtatctacaggtactgctagtctactactactccaactagttccatgcatatacagactagtatccatactctaccagcttgttagtagtagtatgttctctctcttttttttttcttttttcccaattagtttcatacccttaactttagtctagatttacaaattaattagtatttcctccgtttcatattataagactttctagcattgtccatattctatagatgttaattaatctagacataacatctatatgaatatggacaatgctagaaagttctagacataacatctatatgaatatggacaatgctagaaagtcttataatataaaacggagggagtactgcttaattaattgcacatgcatagaatttcccgttcctctacttgaatcttcgtgtacctccccaaacggagacaaccattattattattattattactaggtgattccccgtgctttactgcaggaattactaaccatttctcaatatattttttcaacaatcaagctagaagtaaaaaggaaaaaaataaatattagggtttttccatacatatcatgaaacaaacaaatgatacccgttctttaatgtgaagcatattgataattatatgttaaatattatagaaataaaaaataaatttgttaaaatattgtgcaaatgatatgaggggtgatgattggatatacttgcatgttaatttgtagaattgaataaattgtagatgatgttgtatgcttgcatgaggttaaatatgtaattattgctagtagatgatgatgtggcatggttgcatgttgagctttagagatgattgggtatgcttgcatgttgatttgtagaattgaataaattgtagatgatgtatgtttgcatgaggttaaatatgtaattattgctagtgggttatgatgtggcatggttgcatgttaagctttggacttagcgggctatagctttatagaaagtgttataaaaccagccccgaaattaacatcggtagctaaacgtggaagaagcgccataggagatccaaacacaatgacgacaccgaggcacgatatttggtaatggagttcaaccaaggcctacatctctggggcactggttacgagcgctcctccccgatcagcatatacaacgtatcagagttacaatgactcacggctggacgctgccagcagccgctccctctcgctatactaagtcgccatgcggttacaataggcacccctctctatttaagagagaccctaggagagagtccgactcttactctagtcctaatacctattacaactccaagtcctaaactgtagctgactttgtacacatattcgacacaaactctaacaaactccaccttggcgaatatgccatgccaacctgaatttgttccttgcgcgaacctccgtgtacccggacttgagtcgatcctttttcgccactcacgcatttctaccccgacaagcctctaccaggctcaccgtaaacaagagacttcactatccttgcgatttcttccttttgactccacctgcaacagtgctccaccttctctcgtatcaccacagttgtcttgccaagcgaaattgaattccttcctagctttcacatcatagacttcttaaagaccatgttcaactccatctaccgtcttaaatttgacttgatctaatccatggccagataacccacgtcaccaccaaatagataaatcaaactcaccagacttgaagagaaccctttcttccttgtcgtcttatgaaccgagctaataaatctaacatccatgctttcccgcatccgtagactgaattcctaataatctgggaaaatcaccgttgctttgaatcatccgaagaaattaccaccatagcgctcactcttcctcttcagcgacgcatatttcatatatccccatcatgcaaaccccacagatcctggatatatcctgtactgccaaacagtccgttgatacccttaacgttttcacccgttgttgtccaggatttttccttcacacacctttgccacactcctgccccaccacagccttgccttcgaatcataatgcagaagccctgatgcacagttatttttgttgtcaatccatgatctcaatctagccctagacgaaatgtccatgtgagtgatcaactcggcttggtgaacgagtcccattgaaatacgtgtccaatcccagccacctagcctccgtgctgatctccacgtccatcacgactccaagttgagaagcaactccgcaaccgaatcgacctccaacagctacacaaactgtacatcatccgcgaccctgattcgatccgataccaagaacttgctgctccatgcatggacctaagcacaatgggcctccctgccgcgcgcatgcacctatggatcattacatgcatttaactaatgtaccagcatgcatgcatgcaaaattagttaaccatgcatcgctaatcatgcatgacagcatatcaccgtgccatccaattgtgcttctggcctcctctgtgtgctgctcctttgcgtgccgtcgccgcctccgctgaccggagccggcccgcgccgaatactgtcagcacctacacaacaaccacaccatgccgtgttcctgctgtccggatttcgtcaccaataaatccgctctgacctccgattgaccaccgtcaatctagttgcaagcggaagccgacaaatcgcatgtcgtctttccagtcgccgaatgacccgagcgttacgtctagccgtctccctgtcgaacacaactcatcgaaagacccgggccagccctcccggagtgttcgattccaccgaccgagaacgtcgattgcctccagcttcaatcaaccccgagcgtgtggccacatgtctccctgttgagagtagctcaccggaaagttcgagccacccgcccgaagtgtccgacccacagattggttcaccaatcgcttccgccgccatcaacccgagcaccacatctggtcgtctccttgttgaaagcaaccatcaaactgttcagactgccgtctgaagtatccgattccatcgatcaaattccgttgatcgccaccatgttccacctagcgtccatgtccgtttcttgacaccctgtgtagttgtcgcagcatggagcacctcactcgtacctctaccatggatctcccgcatgctttgataccacttgttataaaaccaaccccgaaattgacatcagtagctaaacgcagaagaaatgccataggagatccaaacacaatgacgacaccaagacacgatatttggcacggagttcagctgaggcctacatctccggggcactgattacgggcgctcctccctgattagcatatataacatatcagagttacaacgactcacggccagacgccgccggcagccgctccctctcgctatgttaagtcgccatgcggttataacaggcacacctctgtatttaagagagagatcctaggatagagtccgactcatactttagtcctaatacctattacaactccaagtcctaaattgtaaccgactttatacatataaccgacacaaactcttacagaaagtatagattgcgtggtgatagattcaggcatctctccaaatttactatggtaggtttatatctcatcctaagcttaggttgatttattttgaaaccgagagagagtagactatatatatatgcatggaaattaaaaagaaatgccatgtgtacttagaacaagtacattcaattttctccctcgttcgaccgccatgttttcaaacatggatctcacaacctaaatcggaatttctaacctgcataaagatgacgcaaattccagtaaccctcccgatcgaaataaaataaaatacagggtttgacaatatttatcacacctcgcttcaattgtagatatatatttgatgtttacgataagacttgttcaaatttttggagcttaattttaccattacttttatattagaaaaagttccgtattacccttagactttctttctctactccttggtctgctcttttttcttggtgtcagtagttgttatgcaattcttttttctcgatgatgtgatttttgttctgtcagatagtttttgtatgaaataacattggttaatttgagggaggaggatgaagatagatacactgtgtcactgctgaatatcattccaattctgactcgtcccaaaatttgcacttcatctctttttgcagctcttgtttattatcttgttatatttcgtggaattttgcatgctgttctcctctttcatttcttctttggtgatttccaaactaacaacttgaatcgatactaaactgacgcccagtcatgaggatccgtgcatgcagtgtctagggacactgctgaatgtcgttccaattctgactcctcccaaaatttgtttatttcagtatcttgttgatttatttcgtggaatcatgcatgttgtcctcctctttcctttcatctttgctgattaatctttcagtatccaaattaatcaggatttgctcagcagaaagaaaccaattagctcttgcctcttgaagcctatgtgaaagctcatgtaattttgcagttgcaaaaatgtacaactttcaggtgacaaaaaatggcatagggatgtacaaaataaacattaagaggaaaaggtttcgtgtttagaactttaaaaccaagcaatcaaaaacattttcttcctcgaagatccaacaacaaagctctgcatcaagaaacattccattggttgacagaaacaaaattaagctagataagcactgattccacgcacaatttacatgatcattacatcgtccatcacacaggcactcatgcatcgattacacataggagtattgattcgtgtgactagcttaatgaatttgattagccgatgatctggtccaggacgccgatgttcttgaggccgaggacgacgccgacgcccatgatgtggccgacggcgccgcaggccagcgtgtcggcgagcgtgaacccggcggggtcgccggtctgcaggccggagtcgcgcgcctccagcttcagccccgccgtcgacttcctgttcgccgacggcgccagcccgaacctccccgcgaacagcatcagcgtcgtcgtcgtcaccatgatctgcatcgcccccccaaataaattgcccatcacattccattcacatcaagcctaatcacgtcgttgaattcagctaattaaccacactgataaattaattcagtgtgtgtgttcttacaacgttggtggctgagccgatgtagtcgcaccggatgccctgggacctcttcttgctcatcctcaacgatggcagcgtcacctgtgattaatcaagaaccagggacaattaggaatgtgtaattgtatgcatctctagttatacttttcgttacaaaggaaaataatttgatagcattggatcatagaaggaactgaccatggacctaggagaggagtaggtccggaggccatggaactgcggcacggatgtggcggcggagagctgggaagccatggctggagcctaccttctccttctccttgcagctgagtttcgaggaaaaaaataatgtcaagtgccaccatggagatgcattgggctttaattcttggaggagatgtggaatgggagccacaaggggagcttgtggactgcagtggccactcatggataggttacagatccttgctgctgatgtggcatctcctggttagagcctgccaatgtggataagatgctcacctctgcatgcaatgttcttggatgcagctgcaaatgttgttggtggtgacttgatgcatgttctgtcaaaaaaattgacaggcatatatagtgagcaagagaatgggaaagaggaattatgtggagcagtaaaaaaaaatggaaatcttggtattttttcaaccgcagaaaaatgagtaaatgaacctggatttactgtccctgtaggctggaataagtgcaagagaatgggaaataggaattatgtggagcagtaagaaaaatggaaatcttggtatttttcaaccacagaaaaatgagtaaatgaacctggatttactgttcctgtaggctggaatgagttgcttgcatcgacactgaagtggatgtgccactttaccagttgctcctttgctggtgctatgccgagtcatgaactgaaataatcaagaacttgaagcccattgcttgcaattgcagaaatggattttgcaatgtgaaacaacgtggcgacgcatcttactgctgtaagcctacaccacgatgagattacctcacaacgcgcaaagaattaaaatagaatggacacttcaataaccatcactcgtacatatttccatttcgaattttgtatatgaaaccaacgatgacgagccaaaaaaaacagaaaatcttcccaatcaatcatatagcctaatatgagaattgcatacacaacttgtatattaatgcaacaccatatcaccaaccctccctttcctatgtacatttcatgagtatggaaaaccagggtcagaagagcaacccgctcctgatttgagaaaaagaaaaactttaacacactcaaccacacccatacacaaaagctgccacgctccaaatcctataaatattacacatcctccaaactaaacaacttgaatcgatactgaacaaccttttctaatcggtttcatactgtaagttatatcaggttggcaactcgatcttcatgcttctatcttgaggagtgagttgagagatgtgctgttgaacttttgagcaagacctctaatcaccagaatgatgacgtctcgcatgtgccgagtttgcaccatcaagtcaacttcgctctcaccatcaacaacaatcttgaagcggtgctgatcgttgcgatatagctcaacctgaaagattcaatgaacagttagctttagttataaatttgcgtaggacagggattatacattctaaaatgaacattttattttccaagttcatgcaagaatttacatggaagggtggaacatatgttcctcgcacttctgtagttgggaatgatgccttggatccaggctttacaactttgatcctcttcctattcacttctaaaattcttcgctccaaatgtcccatcacttgtgcctgttaaattgtttgtttttccaaaaaaagaaaagaaaagaatgtaacttgtagattgcaacgcttattatcctggtgaattgtgatttaaaaaatatattacatgtaggaggaaataccttttttggtgttctgtccttgtcacacaaaacctgttcaatgcaaattttatgcacttgttactaaacaaagtattaattgttgcaatgataacaataaaaaaaacattactgtgaaggtagcccatttctttagataataaagatagcccaagtagaaatgtaattatgcttgagacagttactattgactgaaataatcactctgctgcagaattgctcagcactcaaatttggaaacattagctgtgcaaataggaaacaagtatgctctccatagtttgacgaataagaggcccagctatccatgacagtgagacagtccagtagtctaatactaccaaaaaggaactaacatcagtattgaaatgaatattacctcaaacttgacagatccatcatcaagcttctgcttcacctccttgtaaatttcaggctctgcataagaaaaaaccaagcagttaatagaccaggctgacaaccttaagtaatgctctgaagattaaacttaatagtgaataaatataactatcgcagaaagtaaactgaggctagaagaaactgtttagctaaccgctgccggatcaccaaaaggataaaaaactgagatgatgataataataaatgttagtaggcgacaagataggtgaatggactataccaactgcaattggctccgttgaagcagagataggttgtccctcaactccatcctctctcacaggtgtataaatgataacaagtctataacctacatcatcaacattggcttcatatgttcttccaatttcgcctgcacaagaagttaattgcaatataagaatataagtaccaagaattgaagcaaaaataagtgggcatcatcttgtgcccattaggatttaaaagtggtaaatattatatcatttaaaaaaaatgtagaattcaaataatcataccaggtatagagataagatctgggcttccaaccatagacctgagccattggattttgctcttgccttctttgcctccagaataggtaccccgaacagcatacaggttagtgtggaaacctcttccttcaatctccagtttttcaattttaggttttcctgttaaaatcaaacatcacgcttcagtggtattgcaaattttaatgatttgcatgaggatggatatcagtacggtcatcaagcaaacttggcaatagagattaatccaactagccaagcctcttttagtagtatatacacaagaagttcaatgaagatgacagaagtacacacttatgcaccaattgaactaatacaacatgatgcatccaaaccccaactgcaaagagggagtcaagatgcagaagtgcaagcctatggactgatcctctacaggcctatccattttgaaataaataatgaatattttgctcaactaaaatatccatcagtttcacaaagttacaatacgcatgctgatttaatcaataagacataagcggtagacaaccaacctggtaagatcggagcagtcacaatggatatcaattcgctggatcgtccaaatacatcagagactgagcattcacatttcaggcatcggccaatatcttcgaaacgtactttgtatgagcgagagcactggttagccagtggctcaaaagtctgatccacttcagatccactggaagcaaacctgcatccagagatccacagcaagtgttatatgccatattgaacaatgtgacaaagtcatgactcacgacatacacctctttgcattaccattgatatgttatctctttcttgtagttactccatagatgttgttgaactgcagtgcttggaatttgttcaagaacagtcagtgtctctctctcaacctgatttcccttgaaagagagtgcttcgattttaagtcgttctggaaagaaaaggagaattaatacatgtagttgcatggaaaatgtgaacatagaacagtatgtaataggttcagatattaaaattaccagggagaattatatcagatggctcagagagcctttcttctccaatgatcccatcagaacgaacgggaatgtacctatcaagaattacaaaatatcatattccacaaatggaagcctgatcggttatgcagtaacacaatgtaaccaagtcattttaaatgtgagcaagaccagttcaaaatagaaaaattaaagtgccttacccaaacagtagacggcggctataatctgcatctgtcacttcatatataattaaatcagcaccatctatacaatgcctggttccatcactagattccctgtaccacttatacaagcttgacccctcatatccaccataatagactcctgttccgctatacaacaatgaacttttctgcttcaagtgaacatccgaaacagatggaaatgctgcaaggttggtaaaggactgaggatgtgcaggcagtagtagtaaacacacaacactggcaaggaaaagatcaatgggcaacctgccatgacagggtcactggtaacagccaccaacgggtcaccgatctctccatcatatcgtgcaggaacccagtgaagaatcaagtagaaaccaacatcatctaacgaaggtttgtacatcctgacagcattccattagatcaaagaggattagttcttaacctaaaccattcaaaagtaacaagcttgatgaaatcagtaggagaacgcacaaatttactccaacttcagaacatgaagccaccagatcagcctccaagttgtcaagcttctctttagttcggtaccatgtatattttccagtgccttccttaccaccaaagtaggttttgattggagaaatttcattgtcttgaaaacactctggtagaacaagatcaacacccttggggtcccctgtgccaatgatggaccaacaaataattaatgacatcgattataataatattattaaattatggatgaaatatgcccaaaactttttttttttgaactagagccagaaggctcccatttcttttactagaaatgataggctagtaacagcagtctttacaaaagcaaagagaaaagattagaaactaaacatgagggtcactccagaatctgccggccctagttcagaagattccacaaacgaaatgctacccctggaccattacaggcttgtcaaaacaaaactaggacccgcaacagcaaacataagcaggcatccatgcttatgtttagttctggtcctagcacaaaaaactaggacccgcaacagcacacttatgcttatgctgaaatatgcccaaaactatattcatcttatctgctttggtggacaagatacatactgacataaaatattcaggtcctagcgcaaaaatataacattctgaggaaaactaaccaggtagaattgtatccgatagaacactcttaggtgacccttgtgatccatcatctcgtacaggtgtgaatataagctcaatgcgcgaatcaacatcgtctagagtaagatctagacattctattaagatacaaacaatcaaccattagtttgctatgcaaagagaaaagaacaaacaaacattgcagctgtgtgtgaaagatagatactatacgcatgccatgaaagaatgcttaatgtaaactaaccatcagtagacaatttctctttgctgccatcagaatgtaatctgaaccattcttggatgcagtctcccttgaaactagaatgataagaaagaaaaaaaaataatgtcatcaaatgtgcggcattagacataatctaaaacggaggtaatgtatctcaccctcctgtatactcagcatgaaaggtcaaacagccaccttcaaccatagggccagctaactcaagagataagcatgtaggtggtcctgtaaacaggtaaattacgaaaatgttagtcctccgtttagtccacttattgtttttcaaattaagaacaaacgctgaaccacacaaccaaataagaacacttatttgccaaagtggtcaagttatcagtttatctaccaggtaagataggaccagactcttctgttgacaccaaagaaccatgaactccatcacttctaacaggctcacacaagacagatatgtaaaagccaatatcattacagttcaaggtgtatgatgaacttgcagccccttcaatttgtttttgtgatccatctgaactagtctgtggacacaaaaaaagtttataaggatgtagctggtaacttggtacatccaggcagttacaaatcactgtgccattgttacgtgaaagggaagagtagtgttttaataagaggaacctaccaatatccaacggaatatggtctccccttcttctcctccccaatatcttctgctggcaaccattgtggtcccctcaatggcctcaccagttagttcaagagaaagtattgttggccttcctgttaacagttagtgaaattgaaattaaatatgatatattttatttcaatcagcaggcatctagaatatgtcataaccacaagcatctaggacatgtcataaccacaaacaaagaaaataaatccagcaataaaatgggcagctagaccacaaaagagagttaaaaggtgtacttgaattattattttttaaaaaaaatacatctttgtaacctcatggttcgtattacatgagtatatgaattattcagacagaatcctcatttatctgttcattttcccagacagccagtaaacaaacatctacagtctttcagttaaggaagaaagaaatatataactgtcaaggttgttcaggcaaaaagagaaaacaaaacacctggtgtgactctgtcctttcctgtgaaaactcttggctcaccaagtataccatcattcctaataggtacgcatttgaaagaaaggaactttccaacagcttcctttgtaacttggtattgtagcagacctgatgcctctgaaaccagactgccttcatcatcctcagtctgcaaaactttatgccagttaagaaccagtgtgacataaagaacacaaagtgctactgagtaaaactagcgatcagaatttggcattctttttctcctttctataatacaaagaaacacagctctcttgcgttctagagaaaagaaaaatgaattcggcaattcactaattattataaatctccacttatgcaaaagcataatatgtacagtgagtgttatattgctatttactgggtatccaggatttaatttagaaacaagacaaatatggcttgtacctcatgaagatgccaactaaataaactattgccttcatgtcccccaatgtaaccatatgatgctgtcaacatttggccctctgagaattcaccagtgactgtcaaaaaattcaggctgggtggtagcactgaaaaagaggacacaagtaattgaagttggtaaaagactggacagatgaatgcaaagcaagaacttctttagctcaaaagctttatggttaaccaaaatagacttactttccacaacatcagcagacacagcataggctggttcaccagtttcaccatcaggtgccatgggggtaaactttgcaacaatataatatccaacagcactgagaggaatgcggaatgtctattgcaaaatcaaaaggagaattgttcagccatattatcatgacacaaatacaccaaataaaaagtaggtagatttatcagtaatagagagcaaaacttatcataccttagaaactttagatgtagtgaggactctgagttcattctcatttaaaaatttggatgaagatcctatgaaccattgaaccctgctgaacccttcagtgccacctttgacagtagcagtagcagacaccttgcttccttctcttgcttccccaactatcttcaaatccaagacttttggaggtgctgataaaaaagttaaagcaaagtggtaacatttctattagcatactccaaaaaaatatatacaggcaactttatcccaaatgggaaaaatatcgagactattgaaacacaatgggcacaaactccactaacctttcttaactgcatctgtcatagcataagcagcttcaccctcctgacctggagaagacaccgactgatgttgatacaatagaatagaatactgatgcaagcaagcaagcaatggatggttcgacaaaccttcaaggttgatgggaacatatacaaatttgaggggccgacccacatcctcctttgttagcgtgtactccgtgctatttgatagcactagaagaaattcactgcataaaatgaaattattttgtccataattaccacagtgtatagaagaaacttgctgcacaaaaaaaaagtattgtccaaattaccacactataaaactattgaccgtttgttgtagactacagcaatagttcatccaattgtctagtagctctagttcaggatattcagtttataattgagttttagcaggcctggagttaagttcagttaccaaagcccaaaatgatccttcttaaaatggcaggaatttatattgctgccaggagctatcctggttagggatgcaagtgggtagtcccgctacccacataaaaacccacttgctagttcatttcccacatggtagtacaaaatttagaaggaaaaatgaactagaagtaagataagcggtctgaaaaaacccgcttgcatccctaatcctggtgcaagttgttaagtcggtatggccatcgaagtttgatcaaactacagtgcttgaggaatctagccatccacttggactacaattctataaataaatcaggagttattcaaacatggcaagtggatgtaaataagccttttctggagacaacataagtgatagctccgatatcctataggactatctaatattttaatatttggttatggaagtgcactgtaagacctattacgaacttatcatagtgctatcgcataacaaaccagataaaacttattgagtaacagactcagaacagctaagtttggcaagttctactgaactaagtacttcacctagaatggacaggtaatgcatggaactatcaaaatataattgcttcaaggaggacaataaatgtatggaggatcaaacttgaagggcaatctgtacccaagattaacgtttgaccaaattgtttttcttacaacccattaagaatttaagatctactgtttgcatagtagtgtatgatagagaatagattaatcacgtgttcagaattcacattacttgtatatcagaccgagaatggtttcaaacttctaataactgcaatgctcacttgcccagctagtaatgaaatgtttaaacataccataaaggtgttttatcaatactcaaagatgacaaactaatggcagtatggctcatacggtcatacccattttccttctctctaaaccagaggaatttgcttaatccctctttgccaccaaaatactttccattccctttgattgtgttatcttcaacaatgtctcccacaacatgtacactgctgactgatggtgtggctgaaatgatgccataggcaaacaattattgagaattttgaatatttcaaaagaaaaaaagaaacaacttatgaacagttttctggaatttatttcaaatggacaatgttcttttatttaaacagcttggggatgaaccatcattggttactttttttaattgaaaggccattacaaaaaacaatagaccagatggtctatattctatctacagggtggtgcaatcccagtatatgaataaaagtaatttaagaccaaaactaatgggcattggcaaccctttcacaaatatatctgaacagaagctaagataatttgatgggatgaagtactttaccagcctttacaaaatctgtcattgtacattggggctctcccttaacaccatcttctgtaacaggggtgtacataaataccaaacttgaatcgatatcatctagggttagctgatattccatcctgtcagctccatctattacaacagcattgccgttccatcttctccttaaccaactagcctcaaaagaaggtttaacaaaatcaatggtattcactagatacaaaaattagcataaaagaaattaattcatctgatagaatgaatattcatttgcaaaatgaaacatgatggaagttattaggataaacaaaccttgcaacaccttttcctggcatcccaccacaccaggcaatctcaggaacacccctgagtacatttccttccaccaaatcaccatggaccgtcagattgatgacctttggacaaccagtacctggtaaacaaaaactgatcaaggactaaaggatttggctatatcattctagtgcataatttaatttaggtaaatgggtgaaatatccatatatactataaaaaataaatgttgcgctgtatctatcacctccccagtccccagcataaaagtagggctagaaaacatatgggaaggcaaataaagtttcactgaaaaggcaccataattttagaatatatcttttatccctacctactgcttgcaatgtaggcatacatcaaacaactaactagacaaagataaatccggcttacaaagtactatttatactttatatacaatcagttgttcaatacctggagaaacaggtaaggaaacagcaaagatgggcgggaattcagcatcattcaatattggagtgcattcaactttcagacatcttccaacatcttcacgctttggccagtataccttgatttacaaataaccaaagtttataacttgcaaaaggatgtggcaaaactcatcaaattataacagcagggacttaaaaacttgcaagtgatgcaaaccacaaattcaagtagttctaagaaatagatagataactaaccaggcaaaagctctttaagtacagttaaaagtgtgttcaagtaagtcaaaggagtgttctacctcacttaattcttcaggaagaggcacaaaatcagttggtgtcttgtcacctataaaccactgatatttgaggactagttcaccctcatcacactgatttgtgaagctaaaatggcaatgacagggatcttcttcaaatggatggtcaacatgagctttcttcactatcaaatcttgcggcaacttattcttccattgctcaagtaggaaggaaaatgttgaatctgtccaagcaagtaggaccataagtgtgcacttagaactcaaatggatactcgagaaccaggaaacaaacaaatcattcaacttcactttagttcatgcgatcactttatgtttgtatatgagaagagaactaaaagaatctaatactgttgaagtaatacatcagcagattcatttacgaacatgtaatcagtaggaaatgcgtcaacaacaataaaagaagtcaacacaaaatagcagtttttttctctccattaaaaccataccagcagcaagttcaggagagcaaaattcccaaccatcacgaatgcaaatagctgtatgagcaggatattgcttcgcaacttcagcctcaccggggttcagatctgcaacaggttcccacttaagaaatatccaaaaccataaagtaataagatactacattctggttgcatcaaacaattcagtatatttatctgaccagacctattaatcaacagtatcaactcacatgatagattaatttatccaaaataaaatctaggcattatgatggtgtagatactgtaaagctccagaatatgcgctcctgtttcatattctcaatcaggcccggccctgagggtggagcggccgcactgagcccccaaaatgttggagcccccacctaccctctagtgattacggatgggattaggcagttaggattagagctgccgccgtggacgtagctagcaaccaatgttcccgattccacgatcaatcaaccactacgcgagtcatgtccactgagacaccgtgtgctgcctccacgagtatgagtatcgatccgccacaatccatccacctatcgttactcctcactcgtaatcaacaaattaaattggtatatgatccatatctgtttgaattttctgttatctgctgctatcctggccggtttcttgcctcttctctgttgtgggttcctgctgaactaatgtctcatacattaacatgcaatctatttacacgtttgcagaagaaagatttgttagaactaatccatgcttttactttttgtaatctatgagttcgaccataatatgctaatattttcaatttttagctctttgatatcatgtcatcaataaattaaacggttgaatttgacaactttatgcattaagaattgctagatgagattgatattgataccatcatcaattactttgtatctagaaaagtccaaagaaatatttaagataattttcataaagttctacatctaaatattgcttttgaatgcactttaaatatttattggtagcattttacatatacatgtatgtattaattcttatttacatataacattaagggcccttttttagtttcgccctaggccaccaaaaccttgggccggccctgttctcaattcttactatatgtgcaggtgaagtatttaaagtgaactcactcatttctgagcatttggaaagtcattctagtcctatcagaaccttaataggtaagccgaaagaaagaccagaatgcggcttgtctatatcaagtaccggcgttattttcatttccatcccattaatagtctgaaagtaatcagattcgatgatatttcaacagcgataagcttaagataagccattgtgatggatattattctatactaccatttcagcaaatcaaatagtgatcagcgatgcaatgaaaagcatgttaaacataccccggtcattgaactttttcaaggtagggcctacaagcagaatagaagcagcctccaagtgtggcatctcaagaagtggattatcctcaacacgtaaatgctgcagacattttagttttgccatcagtgagcaaattgcgttaacacttcatgtgtcaatagccttcattaatttaacatatctcttcaaattcaaatatatctatatgccacagtggactggtaataactgatcatggatggtatgaattgcctgtttcatgcatataaggtctattctgtaacatcagacattgagcaacgcaattgattattaccagcttcaaacttccaattaccaaaatacttattatttgtactgcacatcatctattgtttgttcattatctagaaaaataatctattgtttgttaagcaccatccatgagattcaaatgcttttagaaatagcatcgttcaacaacataagaaacataatgagtaaaagcagacctccagagaaggcaaatgcggaaatcccttcaaaactgatattttgtttctgctggctgctagtacctacacacacaaaaaaaaatgcaaagcaagttaagggctaactgatattttgattatgctcaaggcagatacaaccagcatactcacttgaagtcgaggctgactagccatacagagtgatttcaacctattttgagcaacagagagaaactggtgcagcaagagagataagaaaaatagatttagcattgttgacataagtaaagatcaactgctaagactagtttggtaacattagcatacctccaagttaggaagctcgggaagggtagcaagggatgttatttgatttccagcgagataaagttgctacacaggtcagaatacaaaagatagttcataaaaaaaacctccatgagcatagtcaatactatgaggaaagcacaaacctggagaagtttgcaattctcaaggggctcaaacccagggagcttaaattcattaaaactcaagtcaagaacctgcaaatatgaaggaggacaaaaggcagaaaaaacaaaataaacacataatcaacagagctaggccacaagaacaggaagtgccaaaatggaatacatcccaataaaaaggagagaggtgataccttaacccctttgagaatctcaataccctccaaacttgatagacgattgtccctgagataaacaaactacagacagaaactatggtaagcacttcagcagacatgtcattcccaatatttcttaatcatgggctatgctggatgtatatatctttcccaaaatcttaggtgttgcaacttgcaaaaaaattaacagtgtcatgtggcttgagttattgcagaactgcatagataaaaggagaacctgactgcacttacttcaagtacaggtgttaatctcaactgcttcagagttcgtaccctatgacctcttgaatcaagtctctgcagaagcatgaaactatattgaatggaagaaaaaccaccacatgatgaaagcatcaagatcatccacataaatgaagaactttttcaacactaaccacttcatcactagccttcaaatccacctggggcagcatcataaaccgtgaatcacggctatcagcagtcgagctcttcttccgaataggcatggaagaacccttgtccatcgacgatgtccgagaacccacttttttcgtgacgctgcttgtcactgaaggtgaccgtggtgagttgagagtagcatttgaggctgctctcctgaagctgctgctagcgctactgctggagttctctgtcagtgatgggactttcttcagagtagaaattggtgatgacttaacagcaggcttcttcatcgcatccaccttggccctctcagactgcacagatgacttcttttccagtgatgattttgagctgaccatggaggctgtcactggtttactcttcttcaccccatctgacagagaaggactagctttcttagcaacaactgagctcccattatcctgttgcttccccgcacttcctgtgctgcttcttctctgaactggagcagcattcatagacgaggtagacttcgtcaacgatgaccttgacatccccaactcggctgagggagcaacatcagtccgcttcttgattgaagaagctgtccccaatgcaaacctgccggtgggcacagacagccgggtctttgacggtttagcctccgccggctttgaggtctccggtggtgcttccattcctgacaaccacaatcaaaacctcaagccgtacaccgccagtctttgctttctagtcaaaccaggaacctcttgacgattgcacacatgcctgacctggatagccaggtaaacaaaccaaattatcaatgtagcacttacaaatatttgggaaatcaccaaaagttcgatgcaaaggaaaaattctcagaatttgcagcctcatacgaaaactgagcaaccaacaacgcttgtacagaatttttgaattgctcgcagaattcgtcaacgcctagatagggaagtacaacgcgaggcggtaccaaatcagacggaattgcggaagcacgaagccggtggatatggcccgtacaaaaaagcgaagcattaaaacttgacaaaataagcacaaaaaatttatttcatcataattttttttgtcaaatgtagaaacagagcaggaacccatcgttttgggtcggaattcaaaaccaaaattccagcaaagtcgtcggtcaaacccacaggcaaactcaccacggatcagaattcatcacagaggatcaaaaccacacccgaaaaatcccccaaaaatgctcgtaaaaccctagcaccatccagcacataaaccccaccgcattccgcgagaacccaccgccaccgccacactacgagcaccggagaaatcccacccacacgcgcacaaatacacacacatacaccctctccaaactcgaatcgatccgaaatggagttcaaaacaaaatccagaacaaaaatgcccaaaaaaaatgaaatcaacacatcgcgcagccacgggggggccggctcgcctcccatctccctcacctccccccgccgcggcagccggatccgagcccctccgccgcctccaccaatgcgggctacgagcgcgcgcgaggagtggaagccaaccagacactggagcagaagcagcagcagcagaagaggcagagaagaaaggggggagaaaccgaaacgcgcacaagtatccgagaggcgggggggcacttggtaaattaccggaattcctaggggcttaggtgtaaattcgccaaagtttcgctcccgcccgcgcttttgcagtttcggttttggtccaaactccaagaaaacgaaatatcaggggtttttttcgtttaagcccttggtttttgtggaaatgtgacgggaagggccgggggtcggtgcgcagaggcagcgcacacgtcgccggcgtggaatcgccgtggggcccacccacccggggagttcgcttctaccgttgtttgtttgtttgtttggcttggtttcgtgagggtaatctcgagattaagtgccgtaattaacgctgatcgcactaaacacaaaagctacgctcgtactacacactaacgcacacgagtgcagccttcaatacacgcttaaaagagataaatgccaaaatatcatacaaattcgatgataaagaggtgcatcgcgagcactgagtttatcgtgttataacttttactacacatctactttgagctactttaaaggcaaacataagagagaaaatatacgaagacagttgtgttcttttaaagtgtttggcaaccagcaagtgaaatagaacggtgaattagcgtataaattaattaggtattaaaaaatttaaaaataaattaatatgatttttaaagtaactttatttgcataaagtttctagaaaaaaaaacactctttagtggtatgagaagcgtgcacatggaaaaagagaaagaaaatgttggaaaaatgtaatactggccgcagccttgaactaactttgaagttaattaagtcctaagttaaaaactagtaaaaccttggctctaaattctaatgtgcaagtccactgctatgtacgtatggacaaaactttaggtttgcaaacggaatgcaacaagcagtgcaaacaaaatcgaccattccagctgattgaaccctcctcgattgcatcgaagatttttgtttcgagacaggaggatgcataacacatggacagatagatatagataaatctagcaattattagggatgcaagcaggtaaacctgcgagttcaaataaatgataattcataagtttttgtgttgtggtccagtttaccgcatatagatatgcaagtgggtcaatccataaacctatttataggtcaaattaatactttctccattccaaattgacctacatatagtttttttttgaggttattcctaaatggtctacatatttgtgttcatccattaggtctattcattatttgtgtattagagtaaatggacattgacgcatgcatctatgcacacaagcatttatagcccatatgtaatatcttgatttgctattggctatgaaatagtggggatggtgcatgcattgagtttgttgctagagtaaatatagtataagagagttattagcttttcttggtattggtgtacctttgaaatatgtagatcaatttgaaatgaatggagtagttaactagcgggttacgtactaattttacctataagcaggttcacggacaagcccgcttgcacccctagaagttacgtgagagtaatcaaatcacaaaaattggttaattacaggtagaagtggtaggtgagacagacgagctagcgttggagcgatggataagctcgccatcgccagcgacgtgccggcgaccgctccatcgaaagccaatcaaggcactagtactaacgaaacctacctccccttcctctcgctgacatgtgggcccggtcccacctgtcatcctgatgcgatcatcctgggcccaccagtagctaggaggcaaagcccgtgggaaacggggccgacacggcgatgaacagggagaagattaattgttgggatggccttggattaggataattaaaaggtttgtgtgctaaataatgatgggttttaatttgtccttgatggatcatgcacggccttgaatggatcgatcgattgatgtgggtaattttaattaagtgcaataaatgacaatgatgattaactcgatcaccgtcgtcctagctaagcttgtgtactggatatatagctcagtgccaccgtctgatcacggcataatcgtgcgtgtgcaaaccattaataaatatagttgcacggttttatgaaccatgctacatccgttgcaaaatgcgtgcagccgtagaaatccgtgtccaacgtttcaccgtctgtcttatttaaaaatttatgagaaaattagaataaattagtcaaatataaagtactattcatgttttatcatctaataacaataaaaatattaatcgtaaaaaaattataaataagacgaacggtcaaaagtgagatatgaacagtgtaaaactgcacttattttgagacggagggagtagattggttaagcacgctaaattattatgcagtacgtgcattcttcagatatcatcagatgtgcctatagatttatttatgttgattagggctttattaggagcttgtttaattttattgacacaaatttaatcatcaagacaattattctccaaattccagactagctacactaatccaattaagctataatgcctatatgtaacttaattaccccccaaacaaatatacactgctacatttctcttgtccttatggtatttatttaagtactattcatactatgctcaaagaggaacctaaaattatactccctcggttttaaaacgtttgacgccgttgactttttatcacatgtttgaccgtttatcttattaaaaaaattaagtaattattaattcttttcctatcatttaattcattgttaaatatatttttatgtaggcatataattttacatatctcataaaagtttttgaataaaatgaacggacaaacatatactaaaaagtaaacggtgtcaaacatttcgaaacggagggagtacaactcagtatttactcttcaggcatgaatccagtgtagtaccactgtaccatgtcagatagtactagacaaagtatcatgctgctgtacatattgcattattaatttgtcccttgctactggtgcacaataactgtataagcatttgcaggtgactagctttagctatagctgcatgatatcgatgcctctactcttctccaatatgagtaggagtacgtgacaagaccagcatccttgtcacgatgtagaggcttcaacaattcaagagacacacctcttaaagagcttattctatcagctatagccctcggattgggagatgcaacactgatatttgtatacatgtccatatatgcatactagtgcatatcttggaccctcgcgttgtagtgggactttagaacttctctacagaaaaaagcatgggtctaactcaacacttcaatctcataatgattggcgtagtttgatgacatggctaaacataagagttcttttacggcaattaatgatatagcagtactggttgggtagtcgtgtttttcagtctactttatctacttcaaatcttttgatttttacacgcttcccaaaaaactaaacggtatgtttttataaaagaatacaagaaaattacttaaaaaaatcatattaatatattttaagtttattttagttaatacttaattaatcatatattaatacgtgcttcgttttgtataccggagaggagaccaacccctccttctaaacacaactttaatatgtaactatatggaaatagaaatagtgggtgtgcacatacatataaataagtttagctagcagtgttcatggctgtctgaagaatgcatgtgtaaagttaagtgtaacatatgcaagagtggctatagctacctaattaagtgcaggaatccactgatcagtcagaaagttcacctacaaaactgtcatgtatacccagcacacataaagataaaaaggggctgccaaatcaaaggaggaaaaggagttaagtcaaataaatctactcctaagatttccctttaagaaagaatcaggatggctcagaagcaaagagagctagacaaaagtgaagaggaagctagaaacataaagaacagataattaaactatctgtctgattaactattccatcaacaaaagctaattgcaaagttgtgatgcaaaagggtggtaggatgctagtaaccatcaacacaacgcatcaattagtctcttcttagggcgaaaagatatggttgctctctcctgatacatgcttatgaatgggccacacgagctagacgttgcagcaaccatcaagcagatatatatacaagtctccatagctaattaaattaatccatgcattttctagtgtacaacttgcaagattttctttgggtattatgggtggccagctcatgagtcatgaccactaatacacaaacattatatatgtaatattagtatattactaatcatactagtatctggtagagcaaagtatgttgcaacttaaattagacctcgattagtctagctttcgtttgtttttagttacaagttcgtacggattaaagtggttagccaacttgtggcacgatgagaagacgagaccaatcaatgatgacagttgagaaaagatcaaattaagaggttgttgcatatgtacaaacatgcatgcatggtactagtatatacgtgtagtccgttccaaaaagaagataagaaagaacaaagatctttttctttctttctttctttctttctttctttctttctttctttctttctttctttttgttttgtttttgctagaagagaaagaacaaagttgacaacgcataagaagaaaagagcaattgaatccgattcggcattatgttggtgtgaatgtgtgatccaagatggtggtttcttttaatttgattatctaaattgaatggtcaggtatgtatcgactgcttaatcaagatagattgggatgatttctgctcagaggggaaaaaagaaagaaagaaagaaagaaaggtaagccatatcgtgacttcttgagtgacttttgtttgggccttttataaaacaaaaagggccaggcccacacactaactgtggcaccggcccacacaagggcccactgtacacgtactagtgatgatggattatggccgtagatgggccgaaaggtcaatgtttctcaagcggaataagtccactttgaatcctttagagatgtccaatctaattcgaatccctcatagtagcagatatattgacccctgaactattagaactgatgcaaactaacttcctaggtgttcttttgctgacgtggctagttggcaaagtccaacctgttggaagtagtgcatacttcgccattaattttattccaagcattattatttgagagcatatacagtaagcataacctacttgcgacatgataggacaagaaaaactcataaattctatcatgctagatatcaaacaagatataaataaccaagccaagtaggtcattaggctaatcacaatggtaatctagccgcaatattttaatctagatgaacagtaccatgcatatacaaaactcaggtacgaac

SEQ ID NO: 59135 - DNA, 31617 bp, Oryza sativa
  unsure (1)..(31617): unsure at all n locations
taccctatcactcataatactttaagtgtgatttatatcttacacatttgcataaaatttttgaataagatgaatggtcaaacatgtgagaaaaagtcaacggcatcgtctattaaaaaacgaaggtaggtaatcacaggttttcgcatcatggtctagcttgccacaactagatatagaagtgagtcgaatcaataaacccatttataaaccaaattacccgcgagacaatctgcagattatccactaattttacctatataacgggttggcccgcttgcattcctaattgggcctgcctgacccaacgagtagagcccgtccagtgccctgacagataccgcagcccaagtagggcccataaaacaacccgtgggcccgtctcttgtccgaccgttgctgcgttgctggcaggtggggcccacaaccagcagcggcccaactcccaaccccgttccgttccgttccccatctgctcctccttccttccgttccagcttgaccccgacgcgtacccgacccattcactctctctcctctctctctctcctctcgcccgcatcggccgccatgcgcgaggaggtgcggagctcgtcggcggcgccgcccgacccgccgccgcgttcggcctcgccgcccgccacccccgtcgccaggtaacctcccctccctctcgctgctctctccgtctctgtgcgggggactcccgctgtgctgctggtgatgatggtgcgcttccgaatcgaatcgggggggaggctttgctcggggaaggggacgggtttggattcgcggcgtttcggctcgcgcgtggaagaatttcggtttttggtttcgtttgtggctctagggattttggggggtaggtgggttggtggaggggtctcgtacacctagggatttaggggcatctatactaaaaccctagggattactatctagtttgtggtaatcgagaagcctctctttcttctttttttcccgcggaatcttagaattggggccttgtagaaggcactactacctgtgtgcctgtagctctgggagaaactggtgttttgtactagttcgtaattctggtactgttctagtgtgcgccttgctctcgcgagcgagcttactgtagagctagatttctggggtgtatggtttttctgctgctgtcctatggtcagctgggcgcttatcagtcactgtggcattgaccttgcacctgttgtggttcttcacactgatgacatgttctttgcactggtgtcaaaatacatgtttttgtggtcatttacttacgtagtctcatcttgagcccaactagttggatatttgccaaatttggaatgcttaccatttttagatagaataaactgttgtactatcattttttatcgttatttggttactatggttgggttgtaattaaaatgttccaatgatatatattgataggatttgtttcagaacagtatagcgttttcagtgtatgctctccacatagattctggtgtatgtgcatgctgaagctcattcctctcttatttacagttcggctggtgcatcatcaccacctgcacaaacaaatgcagctagcatagattggttaggtggtgagccaatatccaaagtggaatcatcatcccagattgctccacatgctcctcggccttctcttagtactaatgctgctggagctgccgtggatttctctcaaccatcttgtagaccatgggaacgaggagacttgcttcggcgactggccacattcaagtcttcaacatgggcttctaagccaaaggtcatttctcttctctagttggtccttttttgttattttctgtgattgtaatttgtaattggcaagccgctcaatcttacccttttgcatttataccagtttagaattaagaataacatttttcgctcagaggatgtatataagtgaatgctgagaaacatgataaggttggtaatggaagtctgaagctaaagatatactacctctgttttttttatttgacgcttagttcaaaatagaaataaccaatgtcatgtaaataaaaatggagggagtataatttttatccatatgccacatacaacactaagttttgtctcatatattttctctttagtccttttttgcatattggtaatgctcaggagacatcttgtaacttagatgtgttctttatacctagctgcttacatatccatgtctaaatgaagaattacaatgtatagggcaaatgacatgtttgcccaaatgcccagctgaaatccagatcaggcatatgtttgataatttttgaaccagtacatcactttctgaaatgtccagcttagcatgtaccttatggtacctagataaagttattttcggccattttgatgtctcgtattgcaaagaggaaaaaaatgctactgaaaatgacaaatccagtttgttttagaagaaactaatagcttaatttttacaggctgctagttcactggcttgtgctcgaagaggctgggtgaacattgaaatggacaaaattgcatgcgagtcatgtggagcacatcttatatttacggcattgacatcttggtccccagctgaaggtatgtcctgagtgaatgtattttaccgcagatctatggaactagctttttcctgtttaggtttgtcctgcagatgtatggcatgcattatttcaatatgaatacttgtgttctcacagataatcatgcttgcttgtttcatgaaattttgcaacaggaaattccatgtgctttcttgtgcatataatttttcactgtcatctgaattagacagatgtagtctgagaaataagttggttgctgttggatgaaattatgcctttagttatttaatgttgtttgtatgatgtgttcctcaattgtacatacagcatgggagcagctcttttattgcatggtagcaaaagtttgtttaggttctcactactgcaaaacaaatttatgttattaatggaacaaaagggatttgtgttctagcattcagcattaccaacagtcatgacttcttgatttctttcatacacgcttctcaaaatcctgctacccagtttcatttttaccatactatttagttgagataggcatgtgccgttttggctatagcatatttcttctcaagctgaaataagctcagctgcgaaatctaattttccctgactacaatctgtatgttatgttgtagttgctaatgctggggaagcctttgcggaacaacttgatgcatcgcacctgggtgattgtccctggagaggaaatagctgtgctgatagcctagtccaattccaccttaccccatcagctcttgttggtggtttcaaagatcgctgtgatggacttttgcagtttatatctcttcctgttattgccaaatctgcaatagagagtatgaagctcacaaggagtcctcagattgaccgtgtcttatcccaagcaatcactattttatctggagagctgggttacaaaacagacagcacaacaggaattgatatcaatcatcaagatgagtcctgtagctactctcaagtaaatctcttgttatttatgctctcatatctttattctttgctgctatagtcctcagaatttgtggctttatttaatctaggtcacttccatctaatttatctaggcacagaaacttataagcctttgtggatgggaacctagatggcttccaaatgtacaggactgggaagaaaattcaacccgttctgccaaacatacagcctcagctgatccagatcagatccattcccgtttacccgagcataagcaaaattcgtactctgcatcagttaagaaagataagggcaaaggaaaaattcatgtaaaagactctggatgcagcatgaggtcacctttgcttgattgcagcttatgtggagcaacagtgagaatatgggatttcagatcggtgcctcgtccttctcatcttagtatcaataatattgacgcacctgatatgcggaagggggtgctgacacgtggaattagtgctacaagtggcatcaatggatgggttgctgaaggaacagaaagagagaatgttgaaggacgtggtgaggcaggtaccgatgagggaaaatcactgtcaaatgctcaggttgacctaaatcttacaatggcaggtggtttgccatctacgcattctgtgatgccctctatgcatgatcatttcaatgatggagggatgggaagagatctgatgattgggcagcctactggaagtgagctaggtggctttgcagcctcatttgagtctaggggtcctagttcaagaaagcgcaatctggaggaaggtgggagcacagctgataagccgctaaataggcttcatcctgctgacagcatagaaggaactgttattgaccgtgacggtgatgaagttgatgatggcgcacaagattcagatattcggagcaacaaaaggcctcgtggtttcaatctcttcgatgtgaatcaaccatcttcttctggagctggtcccagcagaaatttaagttttgacctggatatagatgtcaataaatttgatacatataaagctgaaggtccatctgcccttcataacccctctgcgtcgatgagggcatcttctgttattgcgatggacacagtccacagtgcagaggaaaattcaacagagagtgtttgataccatccatgtgatgttgatgacgttcacaagccgtctagtgctgtcaggagtggtggaatgagtgaggcattggatcttaactatagcaaccaagcaccgcaaagcagttttgtacagcctgctgctgaaagtaatgcaagggagataggaggtagtagtatgaatggaggggaggaagtcctcaatgcagaaactgctcctgcttttgctagggaccaactaagcctgggagttagtggagggagtgttggtatgggtgctagtcatgaagccgaaattcatggagttgatgtttctgagcataaaactgatagtgttgttggagatgtggaaccagctcccgagcttactgaaaatatgggcaatactggtgagtcagcccctggacctggaatgatggatgagtttgtccctgaagatgttggccgagaagaacctcagggtgatagccaagatgtggcatctcggttagtgggtagagctgacagtggctcaaagatttgtggttcaactaaagctgattctgttgagagtggagagaagatgagccatggcataggtcatgagagtaacctacagcattccctttctcgcaatgctagagtttattctggcattgatctgtctaaagatgaggtgacacagattgctaaattgccagcaaatgacgactatgatccaggagatgatcttggtacttcagaatctaactattctgcaccacatcctttcattgaactatatttatcaaatcttttatatgtttatcaacagagggattgggctgtaagctccaagaaccttcatttgtcaaacttaactttattaatcagcaaagtgttgataataatttcacagtagcaattttggcatcctatgcttaaataaaacagctgtcaggctgtcatctgatatgcatacacaacaattagagaggaatccgacataaatgcatttgctgtggcaagttaattcgaatactccgtttttatgttattccatttgtttgttggcagcagcaaacgggggaaatgactatgaagcaggtcttccagaatttgacccaattagtcatcacaacaattattgcccatgggtaaatggacatgttgctgcggcttgctgtatcaatactggttccagcactagtaccggactttccggctggcagcttacagtagatgcactggaaactatccagtctcttgctcaagcccaaaatcaaattatgccgtctgactctgcggcatcactgtataaggtaagttttgcgcagaatcacaaaatgcaatcctttgtttattaatgttttcctaaagaccagcttgaatcattgcatggtctatttgcaggatgaccatgtggcgcctagccgcaagctgttgaaaagggctagccacagcaaatgttaattgaagctcctcctatacagacatacatttggtgaacttaactaatccttgtcaccagcattttcacagttcaaatagttgactgatgcaaacctgagcagagttgatatactatttgcaaaatttaggttctggccactgacagtccagaagagctttgaagctatccatgatcaggtggtggaagatgaataaattaagcttcaacttagttattgtagagtgtagatgagtctgcctggccttttgccgagttgtgccccctttggttgtatttttgtatttcgaacctctttgtatctattcaagttacagacagattatctagttagtgaggctagaactttgaacaaccttgtcctttttcgtcaaagacctaactgtgcaaatgtgcaacattttgtccaattaagtattagtttccgttgtattttgattgctatcaaaactgggtatcgttgccgatgctgatcagagctatcggtgattagccctctcctttgacaagccattcattcatacctataaatgcatggtaacctcgtcaattttctgctcgatcatatatcgtgctgttcatgaccgtgatgtcatgaacaacatttgatgctgaatttccttgcgtggcactaggttgtttgaaagtggaattgtatttgataaatgcaactttctgttccaacgtaatgcaccctgccctgtttggattcaggaattcgaaaattagagttagattcctctagttatgttgagggtttaggagaactaatccccactactttacatcgtattggcgattcatatcttgaacggaagagacagagataagcacatcctttttactgagaattcggcgacaaagatgattccaacaatatgcatgcagccataataattttattaagagaactttcagtacatatagcatggtggtgtccccagacgcaatgttcaagttgatcatgtgcaatgttcctgcgtattcaaaggctcacaaaataataagatatagtttcttttaaaaaaaaacagatgaaaagaaagataaaaccacgatccccaaattccaaaactttacctccaagttatatccagcttaattatgtcccggcccataactaattaactaacctatcgataattatctggaaactataaatcaatcaattaaaccagcaattaaaccagcgaccctagagagatctagggttatcccattctttgacgagacctccatcgatcgcttcagatctcaatcaatcaaagtaagtaatcaagcttcgtctccattaccgatcaactcctccgcgcgctcgccttgattaattattgagttcgattgatctcgttgctgtttctgtgtagtataattaatcatcattaatttgatcatgatgttgtagttgtaggtgatcatggcgctgcgctgcatgctgatgagggcgaggacgacggctctccggccaccggcgtcgtcaggacagacgtcatctccggcgagcatcctcgccggcgccctccgctccccggcggccgtgctgatgacgccccacacatcgccggcggcggcggcggcgagttctcgccgccatctctccaccctcttccggcaggtgcgtacatagttcgtcattgatcgcttggcctcgtaaatcgtaactaattatacttttctccttccatcaacaacgtgtattaatttcaaaagaaattttaggatactttgagaaattaacttaaaatattttgttacctatacatcttgatatcttcttaaggatgataaattatgttaggaatttccccagcgatcgctagcaggaaaccagacgacacaacgcatgcgtactgtggctaagcctgcaaattcgcagaacagaggaaacagagcaaattttgtgcagcgcttttctcagctgcttttctgtttacttacatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaacggaaacatgcagataactaatcaactaactaaccgtggcacacaagattactgctaacaaaactctccctaagcttgatgtgccgattatacaggaaacataccaatttgttcccgcagctcctgaaacttgattcgagaaagcggcttcgtcaggatatctgcaagttgcccttctatgccgatgtaactcggtgtgatttccccattctccacggcttcacgaatgaaatgaaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtggtgctcttgcgagtgtcaatgtctccagccatatcactgtcactgtaaccctgcagtcctccttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacatggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgncgcgcgcgtacagcccatgctccaacgggctttgcttgaagccaagtttcttcagtgtgcagtctagcttggtgttccaagctctgggtgcttggcgaagaccatacaacgccttatcaagcctgtaaaccttgttctcctgtccatcgatctcaaaccccggtggctgaacaacatacaccttctcaatcagttccccattgaggaacgctgatttaacgtccatatgatgcaccatccaaccttcttgcgcagcgagagcgagcaacaaacgaatagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgttgccggttcttctccgctcaccatcatcagctcttcctggacctcacgattagcgagacctggcagcatggccggccccagcacattgtccatcgtgcggaaacggagtggtgcgtcgtcgtggtctgcatcaagattagcagctgctccagttggtggcgacacaaaatcaaccgccggcgcatcgccatgcaccgaaggtgttcggccggctgtcggtgagtctgatggcgttcgcggcgatgatgaagatcgagcaggcggctccccagcatcttggcgtgttcctgacagcgagccaggatggtacaccgtggtgtactcaacgacgaagtcggtgtcgagatcagcggccgcctcagcatcccagtcccactgggccgcttcgtcgaagacgatgtcacgggagatgtgaacacgccgagtagccggatcataggcgcgatacgccttggaccccggctcgtagccgacaaagatcattggacaactcctgtcatccagtttcttcaggttcggggtggtcgtcttcacgtgtgccacacacccaaacgtgcgcagatggtgcacggccggcggaacgccattccacagcgcgtacggggtcttgccgccgatacccttggacgacgacctgttgagcagatacacggcggtatttatcgcctctccccaaaacatacctggtagccccttcgccttgagcatactccgcgccgtgcccaccacggattggtttcgccgctcgacaacgccgttctgttgcggagagtagggcgccgtgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccagctgtagtcgtcgacgagtagaaggaaatagcggttgccactgggtgtcgccggcgtgatcggtccacagagatctccatgtagcagcgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagaccaggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagataataggtgttcgacagagtgcggtgctcaccattcttgcaggcaaagagaattgtgccccgtcctgcgatccggaccacggatccatcgctgagtcgcacgttcccggtgatgttcgtgtcgaggtcggcgaacgccatcctgctgcccgtcatatggtttgacgcgccggaatccataatccagcgcccgggatcatggtcagccacgtcgtcgagcgctgcaaatactttcatctccacgagttccaccacggcttggtggggcggtgtgggcgtgtcgccctccggcgccgccgcgtagaccgtgtcaacgcggccgccggtgagcaacatcaaggtgtgctcttcttcatcctcctgggcgacgtgagcctgttcttcgcgcttggacttgctcctacagtccttcgcccagtgcccaagtttgccgcaatttcggcatttgtctcccttgcgcgccgaaccagagttcgtgctctcggggctcgcagtcccgccgccaccagtgcgccctctcccgccacggcgcttgccgcggccgccagagccgcccgagtcaccccgctttgcctcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgatgactttatcagcaggttcaggatcaccgagggttgcaagctggttgacgatggttgtgagccatagagcgaaatcttccacggtctcgtcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggctcgatcgccgcccacaggcagtgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgacacaacgcacgcgtactgtggctaaacctgcaaattcgcagaacagaggaaacagagcaaattttgtgcagcgcttttctcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacaaattataccctaattttaactacatatattggtatatacgatcccaaatcaaattaataataagcccaaattacactccctttgatcgtatatacgtgcatgatgttttaaatgacagattggagaaggctacaatccggtcgcaaagaggggattatatgtgagggatgttcttcaacggtttggactaacacataaaaggaattgtagctcttctgcctattctgcacagtattcaaagatcaggcatgatccgagtttggaacttggattgaggaggtaaatatttactgcctctggcacaacgttttttttttcagttttgaatggttaaaacaaatagtagcattgtggagtcaattcagtgttaatcttgttattacattggaggatgttgcaccatggttattaaccgtggcgtcgcgaaaacaatgtggcggtcagcgacttttagggtgtcccgccgcctcagtctcgagcctatggcgtccgccttaagggtaaaagcgaccccgtgtcgttgttgtggtgtcatgaggtatgcactacagatcagagtgcggggaaaatttttagccaaggacatatataaactcaccaagtccaaacacgttggatccctaatagagtgagagaaatagagaaaaagaaatagatggctcccctagaaaccctagatgtagcgtcggtaatccaaatcccctttatcgccacccagacatcagctcctctttgaatatacactatagttaaaaatgacctttaactatctaaattgctgctttatatgctacaatctgtatgaagataggatatgtgtagggtgtcactaagccttatgccttaacactatgtcagtaattaagtggtgtggtgggtagccttaccttgccatatactggcttaataaaccattatactactaggccatgctaataatttatgaggagttcagcatattcaatatatagctggcttacgagaattatgatttgcccaccttctcctataactctaggggaatatgatttggttttatgcaatctataccaattgatcatcttaattaggaaatccataattccaaattttatggacactttatgacatgaaaaattaaagaaaatgcatatgccaatgtattgtatggtcatggaattaaatagacgtgtggttttttaaggcattaggacctatactaattagggctatactaattagggctacgtggcattgttagggttttctgcgacttaaactattaaacgtttcatgtttgctcaaaatttacactataaaattttatccttgaatatatatactaccactaatgttcctaactaaatactacctccgtttgtttatgtatgatgttgttgactttttacataaaatttgaccatttatcttattaaaaaattagtataacgaatatgtaatagtataaattaaagattatagtttcttttatgataaaacaaatcacaataaaataaattatatatattttttagtaagacaaatgctcaaacatcacgtcaaaagttaataatttatttatttatttattttattttcaaaactagcaaaaatgcccgtacgttgcaacgggtgaaaaaattgtaatgataatatactttttttcatgaataatcatgccaatcacaatgtttgtattttaatgagcagcttgttttttatataaacggtcttttttttcttgcgaaattttctcaaaccattcagaaatggcgcatttctttctaaagtttctttctagaatgtttttttttgcttttttatttacaacgaaaaccatatttttctccctttttttcttttcttttttcgtgtgtttttttgcctttttttacaattattttctcgcgcgtttttttgcttgttttttttcaaatgttctttttttttgctttttatcaatagaggagaatatatgatgaaataaaagccgtgtagtaggtggcaaaaaatcaatggatcctattctactcagagcgattttttcaatagacggtgtctttttcttgcacgattttttaaaaccattttttaaaatggcgcgttttttctgatagttttttcctcttatgtttttttaaaaaaaattaccgatgatggaaatatttttcttgcgcgtttttttatggaagatggaaagcctttttagcatgttttttttttgcacttttttttgacttttttctcacgtgtttttttgaatcgtttttattttctcgtgcattttctctttttaaatagttaggttatattagagatagaggagatatatattgattagaaatcagactttgttttgtccttttcattttttttcttgtgtgcattatttattttatatgaaccagctttttattttttagaactatttttttcgccactttcttagggaatcggacgaactttttaagatgtttttttcctttttttttgcgtttataggaatcagactttttcccgtttttaaaggaatcgaatctaatatttttgtcaccacttttttttttgccttttataggaatcgatttttttccgttcggatctatggttttttttcgccacttaggggaattgttgtttttcttttttttgcagcttttctttttctttttatgcacctttctccttttgttctctcttttattattacttttaacaaaaacgatgtcaagtaccttattgcaaaattatagggactcaaatgtaaatataaaagttacagtaactcaaatgcaaaagtacaaacccaaaaattaaaatcatataaaaatggaatgctcttgacctataggttccgttttttaaacatattttcaatctggcacatcattttgtttcaccaaaatgtgtgagatatcacggtatagaatgaaagagtggtggcgggtatatcgaactcaaaaggagtggcgtcttttatttttcgtttttaagggggaatcggatctatatcgaacttttttttccgtttttgagagggaatcggataggagtcgaacttttttttattatttttttcgctttttttttctttcatccgtttttttgatcggacaattatttttgggaatcagacaaattcattttttccccgatttttcttttaccgcgtcatatttggtttttcttttcttttttcgcacgttttcttccgcccggtttttttggatcggacaattttagtttttttcgccggtcttttctcgcccctttttctggataggacagatttgcagatttagtttttctttttttcgcacgttttcttttgcccggtttttttatcggacaattttggttttttttcgccggtttttttgcctcttttttctggacgttttctttcgctcagttttttagatcggataaatttggtttttttcgcccgatttttttgacggacaatggaagcacctcttatgttttaagtagtagagatagagatatgttaattttgattaatccagatcgaattaattaacatatttaaatatatgtaatgcatgccacgtactgcagattattggacggtttggattatcatcagcacagaaaaatgcctactgcagctctacttctccacaacaacgaaggcatgcgaatacactactgcgtcgatttagggacaaaattatccaaacctggaggtaacaagttttttttttcactattcaaattaagatgaaaattgagggtgacacttaatttgcacgtttacttcaagcaaatgtttatatatatgtaactaccccatctacacattatatatagttacttataatatgtgtttacgtcacttataaacattgttacatttacttttaaagaattatatatatatatatatatatatatatatatatatatatatatatatatatatatatataagatgaatacaatgaaaaaagacaatactagtaactattcaaatggagttgaaaaaaacaatgcaagcatcatctacacctgatcatcgacatgaaaggaacggccgtgaaacaggaaactaacatgactatagaattaacatactttagagcaacttgcatgttttgtgttctgaggaagaattaagtagtcactcgaattgttaattaatttttctagtaataaatagaaattaatccggtatgtagacaactaaagtttaaggaaaaaaatttaaattccagtcctcacaactgagaaaaattacagataatttatttagagtgtatatgcacttgtactagtaattaatttgcgtctgtcttttttttttttgaattgaaggcatgaagaaacacgtgagatgatactgaatgtctctgcaatgctgggtttggttgctgtcgtcgccgtcgtcggatgcattatgaagccccactttgaggcccagctagagaagcttgcccaagcttttgttttgttgtttctactggctctacttcaagcaatggtagaaatgcaaaaggaacgacggcaaaagagcctagaagatgatcatgctgatgattctgaagagagcaagaagaagctgaagccaacaaaaacttagaaacttttagtagaacaagttttacattgtgcaaccatgcatgcacataggatcaaaataattatgtatacaggccggggagtagtggattattccagcaatctacatttttgttttgagaaacacagtataaatataggcgctcacaacatgtataagttcacatctataaacatacacatatatacacaccataccccgttacaagatatacaactttttaccaacagtgattaagtaataaacccacggtttcaaaaacattgtaggtgattgtcaagttgatgataatgtagttggttattttatagtctcctatagtctttttctgatctccaataatataggttgttccgttacttgttgaaaacggaatacctaagtgcaacggattagtttacagagaaattttgattagctcgtattatatcatacactttccgttatcacttggtaatttaacaacgtttatgggaatttggccattgtgatgacgggataggaagccagctttttttttctaactccaccttgactgttcattaataaaggacccccacccgtgacgcggtgcgacccttgcacccccaacacccacccccacatacacacttcctggtgtttcctcgggcactagcggccaaagaggaagcacaaagaggaaataagtggggtctatcttcctagcgccaccgctgcattcaccttaccgccgcctaggtgggcaagaaacaagctaggtgacaatgcaatgacctcgaccactccagatcttggtccataagtgccctccttgtcatcttcgccttcttgctgtccagccccccaccatcgcatgccacaatcgagtttgttctcaatctacgtctatcatgctcatcgtcaccagatcaattggaggggagagagagagaaagagagaggaggggaacgacgacggcgagatagggatggacaacagcagcaactgaagaaggaagcggtggaagcgagatagggaggggcaatgtctagatgggagtcattcgttcctctttgatttgatttgcccgaggaaggaatgcacgagagagggggaggatgggaaaaggagaggggtaggtggctgaaatgtggttctgttaggagggaagggtgtatgttaggtctttttttcacagggtccaagctgataaggtcttaattgatttggtaataaaaaaagtaaattattatgttggcaatgcacgaacttgttatgtggtggaacctgctcactagagttcaagtcctagacttgagaaggatgctcatatatacggctaattattctttttaaggtagtgatgagtttatcctaatctcaaaatatgttggctcggcctttcgaaggttctcataaggtcataagggtaagttgtgcgcgcgtacgtcataaggtgattgtgcatatgttggagcgtatgcatttgtaatttgtttctaaaaaacacacaacattagttttctttattgccaagtatacacaacattaattttttttattgccatcccatcaaaagtgtttatagagatagaatgtgtgcggatgtgtttataggatgattatatatgcaagtgttgtgagctcgtgttattttaaaaaaaaagttcccacaacatttaatttcctttgttgccatcccatcggagtgtacgttgattttacgtaccaatcgatcgacagaaacacgtactccctccgtattttaatgtattactccggtgactttttggctaacatttgaccattcgttttatttaaaatttttgtgcaaatatgagaatatttatgtcatgcttaaagaatatttaatgatgaatcaagtcacaataaaataaatgatagttacataaattttttgaataagataaatgattaaacgttggataaaaagtcaacgacgtcatacattaaaaatggagggagtactatacaccagccttgttgatctctcctctctctctctcgcgtcgctttgcgttgcgccatcgacgacgattacatctgttgcatcacccaaattaaggtgaaccttggtacttactgctggttcgtcatgtgcccctgtctactgcatgattgattccataatttgttttactgctcaattctgcgtgtgacgattctaggagatgttcggttagatctgtgatagtctatgatttattaattcttgtgattttggttgtagctaggatgccgagtggtgaatataattttcaaataagatatatgaatggtacgtcaaacgttggacacggatatccacgggtgtacttattttagtacggaggtagtagtaactatgtggtggggttagtaatcgagtgttctattagtgttcggtcctagcatactttggactgaccggtctttgcacaaatttgatttttttttcaaaaaagaaaaacttagctcaaaattcaaccgtcaacaaatatcaatatcaccctatacgtcgccgacacgacacaataataatcgatcttgtcattatttgcgttatttccgagacaaataagcttctcgtcgacctgttaattaattagatctcgatcttgatttggagtggatcgatcatatcatggcgctactacgctgcatgctcacgaggacgaggtttattatccccaaatcgtcagccaccctccggccagcgccgccgccgccggccgggctcctcgccgccctcggctgctctccggcggcggccggtcctctccgcggtctcgccactctctcgggtcatcagctggtacgtacgtacgtagaacgtagttcgatcatcaccggcctaaaattactatcgcttaaaaaaacgtgaatattaaagaataacctaatatcaaataatttaaaatgggtgaggcttcaaactcaggtcatctagcccaccaccttatggagctagctgaaagatccatgggtctcaattctaccgcttgatctgcagtttacatgcaattatattcatgcaagctagcttgattgattattactccacgcgttataagtgtctgcgcgtttgtactgtgtttctgaaaacataacaatgtaagacgcaactattattcttcatgtttggtaatacaagacgtgcatttatacatcaaaataattatcatatcttcttctaaatttgttttttttaatccttcaccctcaagataattttattggatacatacatcgtatttagtaattatttcttggtttttacgttagaggtagttacaccttatatttaggattgagtgagtacatacttccttcatttcatattataagactttctagcattgtccatattcatatatatatatatatatatatatatatatatatatatatatatatatatatatatatatatatatatatatgttaatgaatctagacatatatgtgtccctagattcattaatatctatagaaatatgggcaatgctagaaagtcttataacctgaaatggaggcagtacaagccatcgatcgacgattttatcatatcttttggtatatggtatatgaatatagtatatctcattttataatgggttatttagattcatgccactattaattttacagatttaaagtatgccactactatttatctatttaaaatcataccgctacaatttaacacatatttaaaatatcactacttacccttttcataaaccgaaatttatttatttattaccaaatttctcctatcttcttcccctgatccccttctctctccactccccttcctcctatgtcccatctctctcttgatctagaagagacctagttagcttaggtcaagggaaactgagatccaagagagaatgggaaggaatgagtggagagagaagaggatggataggggacgaagatataggtaatttggtccaaaaataaatcccaatgcattgaaaagctatgtagtgactttttaaatatatattacattgtaatgctatgactccaaataaatgaataatagtgatttatttaaaaactatgaaagttataatggtgtaattaactcttttttaataaatgatgtaattgaatttttttttcgttacattattctctttcataaaatatttttttttgcaaataggcagctaggcatgcttaaagtagttttaaatttttgaaagaactttgcttaactaagcatttgaataaaaagtgtttgtgaaaaagtatgagaaaacgataaactgcatcatatttaaaaagatggagatagtatcatagtatatcccaatcaaattaaggtatatgtacttctccaccatcttcaggcaggttggtacgtatgtagttcgtcatcgatcaacccagcctcttaaatcgtgatttatatattctttttctcccttgatatatcgatatgcagttaattaatcacataatcagatgcaatcaacaataatagtaataattatatagtataaataacactggacaaccaaatagcaacttcgtgtcaaataattaagaaagtgtaggcggcgtacccctttcgctatactatcatgtgcatttcattgatcatataccttttgatacccatttctcgatagaattaattaattaattgctcaaatattgttgttaagtttagatgctctctgctgataattttaaccttctctgctgataaattgttgtgacgtttaaaccgacaggttgataaaggatgctgtagcaatccagtcgcaaagagaggagcatttgtgagggatgttcttcaacggtttggactaagaaacttcagctcttctatgtattctcaaaagcatttaaagctgtcacctcaaataagtttatttttaagtaatcattgtgtcgaagtttataaaagaagagaataattatgttgaaagtagataaagtagaaaatagttgcattgaaatttgataaccttgggatattttaatctttttggtttattggcatgtgtcgaatcaatgaaaaatgaatttattttggaagaaaggtagtaaatatttgctgcctctagccacgaagtttccttttcactttttaaatgtagaaaattagaaagattttttccctataaattatgcgaatcgctcatcactcaccacttcaccagagaagccttcggccttctacaccttctctagctcaggtgatcaccaaatcattttcatgaagaaatcaatatttcaaatattaattgtggacactttattacatgagcattaattaagtaaatatgtgccaatatattgtattgtttggaaattaaatatgtgccaatagttgcagttttataaagcattagggccacataattggtgttatatacaccctacatgttttaatagatggtgatattgatttttcgacatcatgtttgttcactagttttattaaaatgtctaaatatcatttgtttttattgtgattttttattatcaaaggtagtttaagtataacaaatttattttctatttacactaaataagacaaatggttagacgcaacgtctaaaactcaacgacatcatcaattaaaaaatggaagaagcaaacgccaatgccataataaccaaggttttctacaacttttattaatttaaccataaaaccttttgttattttgttaaattttctctattaaatactacatcaaataaaccaataattcttccaaataagatattactagaaaaacacccatgcattgcaacgggtgaatgctattttaatcgataattgttagattttttctctctagaaagtatatgggatttatcaccaagtactagcaagcacaccatatatagttattttgatcatgttaccatgtatgcatgcatgtgtatatgaccatcaaacagcacaatcatgcatcacttagaagcttggcgtatttattttttaatagaatagtacttagaagctttgcgtatttatttgatagaagaaaagattactgttatttatttataggcacaaactttaggataagatcgacaccgagagtaccaaataaaccttacatatttttttcttatcgaaaatttgacttatcccattattattcatgtatctaaattacacatctagtcaaattataatttgactgcacacatctatttgagaaagaacatacgggagtaagtttcatgtctttgcctcactttttttttttttgtctagggaggagggaatacgcgatgagaaaaatactgtccactacagttttgggtgtatattttgccatggccgccctatgtctcattctgtttgatcttgaggattggtttcgtgattatttttcttatgttccttatattgctggaagaataaggaaaaaaaatgcacgtagcataatactgaaagccaatgctcgcggttctaatgaaagcgagagagaaacaaagcaaaaattgacccaaaaatcctcgagttttgcaatgtgtacctacaaaggaagaaataattgttcatggattctactaattacattacttcattgacaaaatggcttggaatgctccaagttcctgtggttttaagcaaattacagtaaccactatgcaaatttcagtgacatagcaaccaaggacataatattcaagttcatgtttaggttcataaggttcgaataacaggattaaagatcgtgcttaggatgccaatttagcttaacaaatgtgactgccacgcgacattaagctgtcaataccaagggcattaaaatctgcatgtagccttctccaatggcaccttttactgtctggttcaatagaatgcatgcactacaaatatcatagacaattaaacaaatactaagcaaaagcacaactaaaattcaaaaccaaaccacaaagcatagcaacagattgaattcctgaaagattggacaagacacgagcaaatgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagccctagaaccaagcataaattaaaacaaaaggtacagaatgtcgagcacacgttctggatataagaatgctatatctagtgcgatttgacatagtcctgcactatgttaaggccctcagactcttcaccatagtcctgggaaatgaaaatgaacagccaaacattacaaattgccatcttcaaaggaataattccaagtgttaaggtgagggatcgattagttaccttgacaacgacgcaggagcagcccacaaccttccttgccttgccctcagagtcaatcttgcaaagctgcaaatgacaatatgtattgttaaaaccaggacaagaaggcttttcatataactgtaaattaaaagaaatacacagaacaaaggaaggtggacaatgataaatcataaatatacgtgccaacagaaatgttcaaagtttccccacaaataaaacaaatatactacctccatccctaaatatatgacggtggttagttgaaaaatgaactaaccaacgtcatatagaaaagaacagagtataagaatatcaatattaacatatagtaggcacattctcctttaaacactggtgaaagaatgtctactcatcaattgaacctacatcctatatggccctcagtgacagagacaagagggatggccagtggcctggccccctccaacaattttttttcacataatcatttaagtagttaggtaattaagctaagtgacagtgtattcggccccctccaagagtcttaggcccctcccatgtttaaatcctgactccgccactgatgggtgatggccatataggcaccagttaacacaaacaaaggacaacaattaacaaggtatagctattaggacataggcagcagactaacacatatcaagaaaaacaattgacaaagtacttagaagaatcctgtaactcacccctgcccactcgccaagagtcttagcactaggcacggtaacaaggtgaacgttgtgctcagcacacagagccttaaccaacttgacataatcaggttggtcgcagtcctcagcaagcacacaaagctgagcagcatgcttctcgatggccttggcagcctcacggagacccttcacaagcccatcatgagcacttgacttcttcatcacaagctgcagagcagtcatcagatccatgggctccccaagaaccggggcagctggagtctcaactggggtctcctccctgtaaaagtgtttagatctcagcgaaaatgaataggctcgctacaatacatcaatgtttcaaagaccgagatgcacataagatctattaacaattactagtaatacactttacaaggtatttttagttctcttctaatttgactgctctttcaataatggaggtccaaatactttggcatgtacgtggtgttacatttatacaagaattgagcacccataatataaaaaatgcattgtttctcactactggtgacactgtacaaattcagtacttcttggatgcaaacaagacaattaagttggataattcaattccatataaacatagtttgataagcaattgagctttttttttcaatctggctgtgaatttaccgtctacactccttggtgctagtacagaacaggcacatatcatctgatatgaatcatgattgtatttgctaaactagacggctcacatacaacgaatccaccaactatactaccagctgccaaattctaaatcaccaagaccccataccagtacagcagaaatccgagcaatcgcactcatgactcccacatcctttcactcaatgatcccatcgaaatggaaaccaaatgacaatttccccaatcaaggacaactcaaacatgataagaccaaacgattcttgagcgagcagtagcgcagccaaggctcagcaacaattacacagtaataacagtgttctaccaacagcagcaacagcaagaacaggctagatccaaaatgctacgaggatagagagagaaaaaacatggaactagcagaggccaagaagaagttggttgcaagaacttacgccatctccgcgctcaaaagaccggaacaccgactgcgacgaaacgatctgcaacaaggaaaacaagcgttctcagcacgattagcgaccgccggcgcactgacgcggaggaacaagaagagcaacggcggcgccgcctaccttgtggcgaagagcggcggcggcggcggggttagggttttcgcgaggagggtgaggagtgagccgcgtgggagaaggtgttcttatatatcgcgttcactatcgggccctgatgggccgaggagctccccaattgggcctcataatgtccagagttagccttttgagcccacatgaggcccatcacgtgttgcagggatgcacatgggccggcccatctcatggcccacctaagatgagtcatgggctcttctggctttcactctgttgtgctaattgtggtgctttgtggatgagctctggcagactacggatctgtttggggagcttctagcagctgcagcttcttctaaaatcttcagttgccagaagctcccccaaacagtccaactttttatccagattttgagaatctgtagttgtagaatctagaaaatgaactataagccaaagctggatttcccagcttctccagattctcactagctagcttttcagcagctgcttctcagaatcttaagctccccaaacaggccctacatatgtcaccttcagaatcagaacactggtctaatgatgtgtcattagtgctaagaaatcagaacaaatccatgtaggagaataatataatccattgattgtttcttccttgaaaaggaaagatggggcgccaaacacatgtgcgtacatacatgcatgatgcatgtgtgacagttttaattagtgtttgcaaagatatttctgccacaagtggcactctatgaatcattatggccatagttcatccccactctaagtagccggtgagagatttttttttagacatatagttagtaattatttgattaagatcatttgtctctgagctttaagtctccctctctggttggctatgtcaatgtgtgggctacacgatgatatttgacaataccacttgaaaacgacatgatcacatactattgctgggagaagaaaggcttacttaattaactagtggacgcacagcataaattcttgtatacgcacacttcaaaaaagaatcaaattaagttaagatgagaaaatgaaatactcaattttcacatgaattaattcagatcctgcaaaattccttaaaaaaactttggtttcgaaggaggcctatactattggatggagtaagttttttttttatataatgctcgatgaagaacgaatattgcgcactatagattaatggttgtgaattgtgattaagcatgtcaataatccaatactttttattttctagatgacatggtccaatacatattgagaaataataatttctagatgacgtggtccaatacacatcgagaaataataattatgtaagtgggtctgaattacatagtaacatggaattagtttgctttatttatccagcaaaacatgagcttgggatcatgggatgtgaaaggttgtaaactgcaaagccctctagtccctactttaataaattaatcaaaataattagtggcttactttattctcccaattctcctctgcctccaagttgcatgaaactgaaaggcagataattatagtgctttgctttaatcccaaggaaaggagaaaatctcctgccaaattaagctggtattctttttattcagaaaaaaggagtataaagttggtatatatatatatattgttcgctttagaagaatcctaaaatttgtcggttggtatacctttgaagtttgaactagctttgagcttttgccagaaataataggtaaaaacgttgtattgctgcaaattaggaggtaaaaataatctataattaaccttggcaaatttgacaatatctatgtcggtgacatggggccgggggtatcgtgactagaggcttgggtagccgcggtcacccacgtggcctgagggcccgagggtgacgtggccacccctccctctgtccccccgaggggtcgggccgctcccgtttcggccccgagggctggggcgccccgaccccctgtggttttggcgccacgtgtgtgggttagatgagcacagcggggctcacctaaccgcatttataacaggttggacgagcgcgccacaccgcatttaatgcggcgcagcgcacacttatcctgtctgtgaccggtcgcggtgtatgaccggtcacagaccggtcagatcgcgggttaggtggcaacaggcggcctgtcacacgcctcgccccgtcccgtcggaatgatgagagcttcctggctctcgtccctagccggagccggcgtgctaactcttggagttggtatgtcagtcccggtcagatccattccaggcttcagcgcaagcatggcaaggaagtcgctggccattgaatgaatgttgaaatgggcgtccaccgggaaagctggcgaggggggcaggaggcgtgtgctctgcttgtcagaagtcacttccggctatagactagtcctcattgtaaaaagcatgtttcctttcttagccagctagaggcccttgtggtgacccctgactagataaaaaggaggcccaggcctaggagagagagagggaagagaaaaaaagggaagaggggttgagactctggcgaatgggttctagaccctgaactcttgctcgctctccggctctctggattccttcacgcacagatccaccagaacacaggagtagggtgttacgcttctcagcggtccgaacctgtctacgtcgctcgtgtcttgtgcatttcctctctcgcggacgttcctcagatcgagggcgaagaacctcacttagcgcccccggccgaaccggcaaaggggggcctgcgcggtctcccgatgaggagccccacgctccgtcaatctagttgaaccttctttgaataatgatgacctagacgcgagctcccaactgtcaggaatggaacatctcaccagctcaaggacgtggcgtgattactagccaagtatactagcgatgcattttgatcatgaaaagggccggtttgtttttttcttttgacctagaaagaaagtactcactccatcctaaaatgtttgacgccgttgatttttttaaaaaaatatttgaccgttcgtcttattaaaaaatttaagtttttttctatcatttaatttattgttaaatatacttttatttatacatatagggaaggagggagtactttagtatgtacggagcagcttttgcatatagtaatccaactatatatgccagttcagctcgtgcgagtaggctcgggataataactccataggtagtatttgctatgtctagttggggggtgtttagatggggctaaaactttttagcccatgtcacatcggatgtttggacgctaatttagaatattaaacatagactaataaaaaaactaatttcataaatgagagctaatccgcgagacgaattttttaagcctaattaatccataattatcaaaagtttactgtagcatcacattgtcaaaatcatggcgtaattagacttaaaagattcgtctcgcgaattagtccaaggttatggaatgagttttgtaattagtgtatctttgatactccaaattaatgtccaaacatctgatgtgatagggacttggaataagtctctgaaaacaaataggcccgaatgggtgccatatgccaaacataaaccgaaaataaaatcatataataacaataaacggggtattgcgccgtggctaggaatgggaggccatagtgagagaaatacataatgaagcctaaaattgatagccatgcatatcccacggtattattatcgcaatcgacaggtagagaatggcggaagacacatagacagccaatcacgacgactcgcaaaacattgttaagctaatttagcttatgttggcctatcatgcccttctaattttagttctcgaccatagttatgatattttgggatttagcattctagttatgctattaattaagtattttaatatttcatataattacgatttagagggccctgattttaggaggcactaaacagtcgcacacctcacagatgctaccgtacggccttgcgtcgagattacaaagttgacttgtccactttgacactgaaatatccatcgtatattgatgcaagctaggagtttgagttgacaagttaattggaaatgccaaataaaaaatctgttaacatattaatcatatggatgtgcaaaactcgtggcttggctcgtttgaatttgcaaatgagttgagctaagggtttagccttgagttggctggtgagttagctcacgagtcaaatgagccatgacaagcctcgcaaaaaaaaaaaaggccatgacgagcaacataagctagcaacacaccagcagtctaactagtactaaaatgctaccctctccggcctataatatagggttatttggaaccatgccattataattttacaaagtttgagatatgtcatcgatatctcaatgacatgtaaaacccacatgagtcaatgatatgtgggtcaggatgacatatctcaaattttacaaaattataatggcatggttccaattttccctataatataagtgattttgggtggacgtgacacatcctattacaatgaatctgaatagggatttt

SEQ ID NO: 59136 - DNA, 37455 bp, Oryza sativa
ttatattatgggacggagagagtaatctctaacagaaaaaaaaagaactccaacctagtacatgtgttatcctcgatttgggatccagttgtaatgcacaggatctaccgttcccggtgttagggagaacggagaccgtttgatcaggatcgaaggaatcgcattagctcacattgttctcctcgcatagtcgcatgaacagtacttctctgcagtactgtagatgatccgtcatcctcatatgtggcatttggccttctcgatcgatccctcccatctactagtcgtctcgtgccgctccgcttattcatagacctgaaaatttggactgaccttgctatatatacatgtgtttggtggattgtatgaaaatatgaagcaaactatgatttactatagcttggattgtatacaaacattttgtaaacttgaacagattaatgttggtttgagcgtgttggctcctgacattaacaagccaactcatgtaggcaaacgagccgggtcgagctaggcttaacgagctagtttagtttttgttattctatcaatttgttatcctaagtcagaactgagtccagttggcttgatatccagccatatgtgtgcacagtagcaattgaaaaagctataagaaatccattgacatataccaccaagatcgaacgtgaacaatttaatgcatatgttaattaggctttacgtatcacgcgttgcattatcttgagtcaaacttacgtgagtttcgtcctaagtcggactattccaataatcaagttcacaaagaaaagtattagcatgtataactttaaataaataaattataaaattatattttataatggatattatgctcatttgatatataaatatttttctaaagattttggctaagctcatgatagtttgactaaagaacaaaactaattttcaacggagggagtaacacaaggaaggatgtattcattagactatagctaatggagcatgatttcgagtctagactatgacatattcatggcaataattattctttcagtgatataagacatatccattaataatgagatgtccacgatgattttgtcaaatctcaatatataccaattcagcctttagaaaatattctaaaaataggacgtacatgtgtgtacgttcataaaaacaagtgtgtgcgtattgtaggcgtgcatgtgtgtttcaaagaaaaaagaaaaaagaagtccggacaagcacctatggttgagttatttttaaggacggatatatacgagtgcacgattgaggccgtgtttagttctcaaaataaaaaatttcacgctgtcagattgaatgtttagacacatatatggagtattaaatatagaaaaaaacaaattacatagattaagtgtaaattgcgatacgaatcttttaagcctaattgcaccatgatttgacaatgtggtgctacagtaaacatttgagaatgacgaattaattagcttaatctgtttcttttagaaatctaatttattttgttagtagaatacatttaatattttaaatgtgtatatgtatatccaatgtgacaacgtaccaagaacaaggcctgaattttgtgcgtgactgcgtgtgcgcagcgcgtcccaagcgttttcccttccgcctcgccgtcgtcgacgtcgccgtcacgtagcgtaggcaggcacatgcgcggcgcgtgtgagcgggcggttggacgacatgtgggcggggtgtcggcagcccaggcttcccccgccacgtggctttctctctcgcaaagcgaaaggcccaggagaagtactagtagaaccacacgaatgggccccacaacaagccaggtcctttcatatccactgggctttctttaattccttttacaattttattattattctcgtgaccaaattgcccccctgctgtgccatttagcgccccgctgcaactgcacgtgggccggtgcacccacagatacagcaccgttgccgttgcccgttgcccgttggatcctaggtttttccttcaaatctctttctgttatgactactcttttttcctttttctttttcatgccaagtatggctctttgttagcgcggcatatgccgacatggacaaatggacatgcccaagctttaaaaaaaaaaatgcatgcccaagcctatccatatatgccagtatgtacacacacccatgcttgcttgttttttatgttttctttttttctttccatatgcgcttctttccagttcatgtcaacatcacagctcgttctgttttttaaatagataataagtaccaatgagaatttaagagaatgacaatgttgaattgttctatacgaatgtaatatactactagtacatgtttactgaagttcgtccccctcccccttttaattttttttaataaagtttaatatcacgatgtcgaatggttctacataaatgtaatatatagtagtacatatttagtgaaattcatcttctccccgcttcaaaaaaaaagtttacacttcggtcatcatttataattataaatgtgtattaatttaaacggatacatacttaaattttcttaaccctatacttttccatcccaaaatataagaatctaggattaaaaaataagctatccatattcgtactactagaaaatgcctcatccagtttcttttattttgagatggagggagttcatacttaaacatgtagtttgtactatttatctaaataacttattgcgtgtttttcttacttgtcacacttaatacacttgataaatactttaatctttccataaattgaacaccattttttaatacatcccaaacactccccgtatcttcaccacctgtcaacctcgatcactctccatcgccaaggacacggcttcaaagggtaaaacggtcactccacccgtgaagtcaaaaaagaaggccctactgcttctttccagcagcaaaagcagcgaaacaaattttttttttttttgcgagggcagcgaaacaaaattaacaatcagatataggggcaatacagtaattcacgctttcctcctttgtctcctccccttcctttgcttgtctagtagtgtcttcttcctcctctccctttccttcatttggcaacctccacaactcatcaactccactcctcccctcccctcgcaaaccaaacccaagcaaagcaagcatccaatgcttccccccttcctccctaatcacccccgctaatcgctcccgacgccaccactaatcgaagccggaggagggaggcggcggcgggatggacaccgcgtcgttcgtgacgtcgctgctgacgtcgttcgtgatcttcgtcgtgctggtgctggtgttcacgtggctgtcgagcaggccgggcaatgcgccggtgtactacccgagcgtcctgctgcgggggctcgacccgtgggaggggcgggggcgggggacgaggagccccgtcgggtggctgcgccaggcgatctccgcctcggagggtgacgtcgtcgccgccggcggggtcgacgccgccgtctacctcgtcttcctctcctccggtataataataatagcaacaacatccctctcccctgcgctctcttagttcagttcagttcagtttatttcaggagttgagttggttgtgattttgctccaacggaaaaaaaaaatggtttcgtgcgatttcttcgagtattttcgggtcggggagttctaaattttaatttctaggtgcccctgtagtactgaatcccaggaaatttggtccagagatttcttctcacttttgtttttttgttatccttttgtttgcagaagtagtagtaccgtgtattatatataaaaaaactgataaaaaatatttttatgtttcaccgtttcatgtaccaacataaagataacaattactactaattcatgctttcttagactaaacaatttatttggagaaaattgcgtggctctgtaaggccttgtttagtttccaatttttttttcccaaaaacgtcacatcgaatctttggacacatgcatagagtatcaaatatagataaaaacaaaaactaattgcacagtttgcatggaaatcacgagatggatcttttgagcctaattagtccatgattagccataagtgctatagtaaaccacatgtgctaatgtcggcttaattaggctcaaaagattgtctcgtggtttccaggcgagttatgaaatttgttttttcattcgtgtccgaaaaccccttccaacatctggtcaaacatccgatgtgacacccaaaaattttcttttcgctaacaaaacggggccaatttataggggcaagtcgtgctgaatgaaaggttggctatagaaaactatgatgcatggaggattgccaagtatgaaattcagcatgttaattgatttatgctgcactttactgattaaatttggctaaggtgccattttggctaaaaatagctaagttgatataacatattgacttgccacctattatgacaatttgtttaataattttctcttatgttacagtgttgtccatcttggtgttctctgggattgtgctgcttccagttctgctacctgttgctgctactgacgataacctgaacctggaaagggctattggcctgaagaatggcaaaacaccccagaacttcacagagctcgagaaattagcactgggcaatgttcaagtaagtggcccttcaactcgagtttacttgcatggcttggcttgttaccagtttatgatgtatatgactataggaatcgcacggcaccagtattttgcttgctgagattgtcccttctgtaaaagaaaaggaacaaatataagcatgttgttatatacaaaaacatggcaaccatattccctgattgcttgttactatttacatgtcactgtatgatcattgatcagcctagtgttcctttctgttctgttagctccgccatttccaaagttttgatccaaatggatttgtgatgatcaatatccttgaataactgccatatcagtttacgccctatggccaattggcttgtagcccagtatgagggcctgtttggtacagctccaactcctaaatttagctccaagagtccaggagttgggtctggagtggagttgtggagttgcctaaacccagctccacaactctagttcattttgtgagagagctccacccagctccacttccagttttggtggagttttggtggagctgaaactgtttggctgaactccaactccaggaggggtggagctggagttggagctgtgccaaacaggccctgaattcttgatgtggctgcttgtaaagtctctcaacattgtattatgaatttgttcatgtgtaaattatgagcaatcaattagtacagaaactggtcttttatttttctgtagaaattgtagagatagaacttcctaatctccagtcaaggctagcattcaagatcctgattatcatataatcatactcacagccaaactcctttacattttctacaggaacatagccgaaggctgtgggcatttctattatcagtctattgggtctcttttgtcacgtacttcgtactatggaagtcctacaagcatgtttctaatatgagagcggctgcaagatcaacaccagatgttaaaccggaggagtttgctgtgttggtgagagatgttcctaagccacctcctgatcaaactataaaggattctgtagactcatatttccgagcacttcatcctgataccttctacagatcaatggttgtgactgaccacacaaaggtattgccactcttaagatgtttttagggggactgatggtccttgttttatctttcttgtatacttgtgcgacatgtctcagaatgtaccccaaaatccatgtattctgatcataatgcactttgcaggctgacaaaatttatcaagagattgaaggtcacaaacagaaaattgctcgtgctgaagttgtctatgcggagtctaaaacaacaggcaagcctgagggcaccaagcctacgcatcggattggatttcttggtcttatcggtaaaaaggttgatacaattgagtattgtaatgaccaaatcaaggagttgctgcccaaactggaggccgaacagaagactacccttcgtgagaaacagcaacaggctgcaattgtgtttttcaacagaagatctgctgcagcttctgcatctcagactctccatgctcagatgtttgataaatggactgttgagcaggctcctgaaccacgccagataatatggtctaatctttccaagaaaatatatgagaggcaaatcagacaggttgtggtctataccattgtctttctcacagtggttttctatatgattcctattactgctatctctgctcttacaactttggagaagttgagggagaagcttccctttctgaaggtggtggtggaccaaccgaaaatcaagactgtcctacaggcttacctcccgcagcttgcacttattgttttccttgctttgctgcctagtcttctaatgttcctctcaaagctggaggggattccttcacagggtcatacagttagggcagcagcagggaagtacttctacttcattgtgttcaatgtcttccttggggttactattagttccacattgttcagtgctttgacaaccataatcaataaccctcctgggattgtgaacatgcttgccagcagccttccaggaagtgcaactttcttccttacatttgttgcactgaagtaagcaatgctttcttctcacattatgtacctggtattgtcagctatttccatcctacacgtctgtacaattcagaaagtaacttttcatttgtttttgttgccagattctttgttggttatgggcttgagctctctcgcttggtccctcttatcattttccacctgaagaggaagtacctatgcaagaccgaggatgaagtgagagcagcttgggctccaggcgacctaggatataacaccagggttccgaatgacatgctcatagttacaatagtgctgtgctactctgtcattgcacctctgattattccatttggtgttgcttactttgctcttggatggattatagtgaaaaatcaggtgagccaagagttacttgctttaaccgaagttttaacacactaatattgaaactgaattggaaaggacaaattaattagtagtttcccattgtcgaatgtaggttatgaaacctacttcagcatgaacttctgaaatccgctttcaatcctttttaatactcttgagtctctgatgatagccattgctagataaactttgtgacggggtaacctttcttttaacgcaggttctccgagtttatgttcccagctacgagagcaacgggcgaatgtggccacatatgcacacaaggatcattgcagctctactgatttaccagatcaccatggttggtgtcatcctgctgaagaagttcttgtactcccctgttcttgtgcccctcatcccaataagcttcatcttcgcctacatttgccatatgcggttctacccggcgttcgccaagacccctctcgaggtggttcagcacaacgtgaaagacacgccgaacatggatgccgtctacacctcctacatcccggcttgcctgaagcctgagaagctagaggatgtggatatcttcgaagacgcccagttgcacaccacctccagagccccatccatctaatgcaagtgctggttgcttgtgtcgagaccggagagtattactcatcatcactgcaaacgaatttctgatgaatttccacgttgaaatgaacccctgtgaagtgtgaatctgctattgccaggataggaaaacttatgtcatgtccgtgtacataatatgcactcgggattgcttgccttcttaatgtgtgtgttgaggtttattctttacttcatagttctaggtagctgctgtggatatcgcgcctttttaagtttaagtttctatcatatgttcatgctcgtggtgactgctaaatctagtcctcttatgtgtaacaaaactcagaaatctgttgcctagtgcaccgtaacctgattgataatttactgatttactcattgttactgttcattgaagctagtatcatggctgactcggtgtccgagaatgttgtcatttttgctagaatcttgtgtattaaccctggagggcaggcaggtcgtgagttgcaagttgcaaccgctgcactcgccagcggacggtggcctcgccgtcgtcgtttctccccgttggcatgggcctttttgggcccagacatattggcccggccttggcccatctaaccagcccaccgcgttgggccggagattcccggcccactctgcagaagagcacggctcgaaatcgcgcgaaaatccacagcgcccgcgcgggcggcggcgcacgaacggcggcgagccggcgaccagatgcccctccgatgagcgaggcgatcccgtccacccgcccggcgctgcgccactgcgtcgcgctcctccgcctccacctcgccgcgccatccctcgccgccgccaagcagatccacgcgcgggcgctccgggccggggtgcccacctcccacccgctcctcgccaagcacctcctcttccacctcgccgccctccgcgcgccgccgctccgctacgccgtcgcggtactctcccgcctcctcccgcacgggccactagacccgttccccctcaacaccgtgctccgcatcgccgcgggctcgccccgcccgcgcgtcgcgctcgagctccaccgccgccgcctcgcgctgcccgacacgcacacctacccgccgctgatccaggcgtgcgcgcgcctcctcgcactccgtgaaggggagtgcctccatgctgaggccgccaagaacggcttcgtcacgctcgtcttcgtccagaactcgctcgtccacctttatggcgcgtgcggcctgttcgagagcgcgcataaggtgttcgacgaaatgccggtgcgtgggcggaaccttgtctcgtggaattcgatgcttaacagctttgcggccaacgggcgacctaacgaggttctcactgtcttctgggagatgttgggcgttgactttgcgccagatggattcaccatagtcagtgttctaaccgcttgtgcggagtttggggcgcttgctcttgggaggagggttcatgtgtatgtggaaaaggttgggttggttgaaaattcgcatgtgagcaatgccctgattgatctgtatgccaagtgtggtagtgtcaacgatgcaaggaggatatttgaggagatggggttggggaggaccgtcgtctcttggacgtcgttgatcgtagggctggcagcgaatgggtttgggaaggaggcacttgagcttttcagtctaatggagagggagaagttagtgccaactgaaattactatggtaggagttttgtatgcatgtagccactgtggattggttgatgatggatttaggtatttcgataggatgaaggaggattatggcatttcaccgaggattgagcatcttggatgtatggtggacctgttggggagagcaggaagagttgaggaggcttacgattatatcatcacaatgccattggagccaaatgctgtggtatggaggaccttgctgggttcttgtgctatgcacaagaagctggaactagggaaggttgcttgggaacggttggttgagcttgaccctgggcacagtggagactatgtgctcctctccaacctttatgctgctgttgggatgtgggcagatgttcatgtgcttaggaagacaatggtaaaagatagagtgaggaaaaaccctgggcatagtctcgttgagctccgaaactctgtatatgaatttgttatgggagacaggtcacatcctgagagtgagcagatatatgaaatgctggctgagatagctgagagattgaggcgagaaggttacatccctcgcacaagtaacgtattggcagatatagaggaggaagagaaagagaccgccttaaactaccatagtgagaggctagccattgcatttgccttgctgaagtctcttccaggcattcctatcaggataataaagaacttgaggatgtgtggggactgtcatgttgcatttaatctaatatcaaaagtttatgatcgtgaaatcattgtcagggatcgaagtaggttccatcatttccaagggggggcatgttcgtgcaaagattattggtagttgattcatgtaaagattgacagtgataaaagcgtggtttatgaggttccatgccaatcagataactggtgctgagttcttgttgcataacatgttctgtagcatcatcatatattgatagtacaaccttgacgatggacactgaacactacctgatggtacaagtgagaaaactacaaagatatgaggcatgttatgcagacgacccagcaattattttgttgatatgcttataaggtaccagtacaagcgagaaaactacagagacatgaggcatgttatgcggacgacccccaattattgtgttgatatgcttataaggtaccaaactgtggcttttgtctgggatccatttctttccttttaattatcataccgaattttcaaaactgttttgattctgaatacatacatctttgaaataagccttataaaattgcctgagttttatcaaactttattctgggtgttccacttatatcggacctgatcctttttttaaagaacatatcaggcatgattctagttacaaatttaattccatacaaagcactactgtagtttattgcttggcttccctttatgtatattggtaagcaataaatgtttccactcattggctaccgatatgctatagaactggatgctgaaaagttgcactgcattaaactataagatctttcttttcgtttctttcatacaacatcaaactgtctaaagcttccagagcaaagttaagatacaactttcatcatgaaaacactaaagtttttatcttaatattatgcattggtgttaaccttttaatggatgttgcattgttccatatgtttctactttctactcatggggattactgttgacatttgtgtgcaccacttccatttatcctctttttggaaactgtttccagcaccatcccaaattcactatgtaaaatgtcttactagtgcgttttgttgcattctgtacgtatgccatttcagttttgataagttattttacttaacctagtttttttaatggaatcagcacaagattgtgctatttcattgaacaaggggtaaaaaagtacaggccctaggggcactggacctagttttttcaagatctgattttctttatcaggttctctcctgtattgaacccttgtcccaggttaaaacatgcagcattctccatgtaatcttcaggaaacctcttcattaggcttcactctttacaaagtgaatcaaggttcttcccttaatcctcaaggaaagcttttctcattaagccccgacatatgctaccatgaaacaacaaagaaaagaaattagaacatgcacttggcccctttcaatcttatggaatctattgcctaagtttctttttgttcttttagaaataatgtccatgcttgcacatcttgaaggcaaaaggaatctcatggtttcctggccttcaagtcattctcatccatattattctattatgttcataaaggtccctgcattggttgcacaatccaagaaccagcagctgctggtataatcatttataacatgttctgctccaggcattacaataactgcaacataaattaatagacgatcggcatggcgattctcatcatggtaaagctcactcatttatcaattcaatgacagcatataaaacgtcggtagggtctgcagatattacaattttgtaagaggaattatggtaaagtcatgtttgtgtagattcgaaccaaattagtcaaatggtgaccatatggccataggaactgggcgggtggctctctgatagctacaagatgcatttctctctgtacattggaaatatgggatctttgtgccacttttcaagccatctcctccctgctatggccataaatatgcaccacggtggggacttcttttagttcgtgtcttgcttgcttagtaattcgagtgaaaccctgaccctttcccatgaacaagacaagctttcctgttgatacagctgcccttcgttcagacactcaatatattccctaggccctcacattgaggagagagtggtagatagacaaagagggagagagctgagtgaaaagcagtgactgctttcagttcggtttcaaccatgaagagaaagcagttgatcatgcacagccttttgattctgggatggttcataggtgggtaactgcactgctcttgttctttgcccgtgtcttctccacaaatatttctcatactaagtatttgaatgagcttgctttgatctgttagtagtaccactgcaaactttatatgcataatctcagaactagctgtatctatgaacagactgttttgtttgttcacgtttagctgtaaatgttcagtcaatccgatcatcacaatgttctcactgactgttttgtttgttcacgtttagctgtaaatgttcagtcaatccgatcatcacaatgttctcactctgtcatttcctctgtgatcagtctcagcagcaggcgcacgcgtcgcgccacaggagaaggcggagtccgcgacgccgatcccgacgctgtcgccaccggaggggaacatgacgttcgtggacggcgtgacgtggtgcgtggcgcgcccgggggtgtcacaggaggacctccagaacgcgctggactgggcgtgcggccagggcggcgcggactgcaccccgctgcaacccggtggtcggtgctaccagccggacaccctcctctcccacgcctcctacgccttcaacatcttctaccagcagaacggcaactccgacatcgcctgcaacttcggtggcgccggaaccatcatcaagagaaatccaagtaacacaacaacagacagtttgtttacatttttacaattcagcattgttcagtgacatctgtaattgtaatttacatctgttctttgtgttcttgataggttttggatcatgcaagttcctggcatccgagtaagttcagtccataattgtttcagatgttcttctttctccttattacatatgactggtaaattaattaaattttgctggattggtgcaggacatctgctgcatcagcactgactcgaggaagcatgtggatgatcttcgcagctgcgtctatgatgtttcttcatctgagagttttccaatccgtgtgaattgggtcgatgctaccaaagtaattagtacctgtggtggtttggttctctttgtagtatattacttatgtaagaagcaaggaacagtgctagttttttcgtgtaaaattgtgaagattatatattactacctccatcccaaaatgtttgacgccgttgacttttttttaaaatgtttgactgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagtcaacggtgtcaaacatttagggaaggagggagtatgatttaggtcgtgtttttcactctgtaataataatgaagtaaatagttagcaagagtttgtggagggttaatgcatggttaattctttgaattttgtttcagaaagctctcgcttgcatagccgcagaggtggagtaggtcacaagcgtacacaaacacaatagccaattacgagccatatggcccaatatggtgaggcccacaaggcccaaggtgacaaagccccgcatagtcagatccgatccgtaggttgaaatctggacggtcggcacgtcacgcacggacgcgcgcgcttattttagtaccacctcgagaattcgatcggagaagcaccagcttatatacccgcccgcgctagcctggtcatctcttcggagacatccgataaaattggaacgatacagagaagattagcatggcccctgcgcaaggatgacacgcacaaatcgagaaatggtccaaatttttttgagaattctgcccaggtccctggagcttatactttttatcgcagttatgccctcggttctttctttctgccccttctgctgaatctttttcttccgttctcgtccttcgtgtatgaaggcatagttaagttgtctgcacttcagcccctgaagattttttatcttataaatagaccctcatctgtttccttctttagtgctgcccattgttttcttagcagttatgccctcggctctttctttttgccccttccaagttttttcttgcgctatcgtcgtccatggcttcatcgatggaggctcatacttaagttgtctgcacttcacttcagcccctgagattgttttctcttacaaacaagttgctgtatatttcttctctgcttcactttttaataccaatcaggtcctattatatattgtgcattgctgataataatttgtttagtgcacctctttttttgttaggcaccctgtaatctactagtagtactttggagccataaggccaatcttataacagctcatatcaacatcacgtcctctcttttaactatttctttggctccaacaaacgccaatcatatcgtccacaaccacaagcatacgcagtgacgaaccaataacaaaagctaccaacattctatacatattaattatctaattattggttaatatattaattattaacatgatataaattagctggaactaaataatctacccggggtccgtgaccccgagatagtgaacgtagccacgtctgtacgccactaagcatatgctaaaactcagttcaagattttttaattaattaacaataagaatgcatttaaatgcaattaagaatctttcacccttgtattttcaccaattagacctcacatacgcggcataacttttttacattcctattttaaactgaattaatgccactagttatgcttaaaacatacatgtttttttaaggaaagctttttagtgccttttttatggcacttttttaatctacgatccttctacctaataacaatcaagcatatcatcacaatttaggatctccagagagctcgagacaggacgctgttcgctctagcgtccgcgcctggacgttagtcctagtagcgtccttactattttcataatttgcactagtacctctcacttactaaatatttaatttcaggataattaattattataggattaaaaacccggtatattcttagataaaaagaaataaaattcagcttactctattttagatccaactttcaaattatgcaactgcatgtcgcgtgaatattaattcctggtggcgatgacggacacattcagccccttttttcttgttcggagttttgatccaactcatacctacgttgaggactttgtgtcacacacgaaccagggatgacgagcgtattaacagattctgaacacatcacgacgtgataataatgggcatacgacttagcattatagggtagggttagaagaagaagtgtttggggcgtgtttcgggcttagagggatgactgggacgatagcagattgactgatgacgggcaacgagatggcagctgacatcactgccggagccatgaggttaggagaggatggaggaaagggttgatagtgggggtaaaattgtcgactagttaggatgggtggggtagaggacgatggtggagaaagtagacaatgaagtggtggcagcggcaactctaaccactagaggtgagggagaggttggggatggggccaatagaggagacagtaatgcggcaaaaatctaacatggtcagcggttgaatcggagaggtcaactgtgggattgtcagagaggagtataaggcttgtttggttgataccctgataggggcggacgaaaagctcgaggctcgttagctcgctcgactcggctcgtttcattttcctaacgagccgagctggcattttagctcgttagagataacgagccagctcgcgagctgcttgtgagccttaacgagccctcagcaatctgccaggccacaaagcccataggcccatttatttagaaggcccaatagacaatagtgagcactaaaagtgaaaaccctaggtcattcccttatcccttcccttccctgttccctttggctggcggctgagttctgtaggatcgaaacgcaagaactaagccaaccagaggggggggggagggtgaatggttggtatgcccaaaaacaaaaacttttagcagaaataaaagttaccctcaaattcacgagattggtctgaccgaagatgattcgctggtctgaccgccctgatgctgtcggtctgaccggtgtagatcgatcggtccgaccgctcgtcgccggtctgaccgcccttatgccgccggtctgaccgccactcgtcgccggtctgaccgccggtgtattgccggttggaccgccgaaacccggtgaaatacaaatcgaagaactcttaaagtggatgataactttattacttctctctgtgtttacaaagtgcaacaacaacactccttacaaaaatcttgagaaaactcgaaaccctaactcaactatcaacttaattactctccaaagcgataccgggaagcctcacgctccctctctatttatacccaaggtaggcagcctaaagccacgaaccaaactcatactagaagtcctaatcaccctaggaaaccttctcgtacaagaaacaaactttacaaaaccaattccaccaaatttggactccttccaaattcgactccgcatcccatacgcacacaatacctccatcctaagccatatggaaccttcaccttccatgtgtgaaagtgcatctaggcccctaacgattttggtgattaattacaatgcgattagagaggactaacatttttctttaagcaaaggtgaaggttgctatgtcctcaatgagttagcgtaatgcatttcccgctgaatatgttaatgagatgtgatgcggcaaatgagcaaatggtatattgtatcttttctttttgtttgagtcaataggaatgccgcactattaagagggatgatgcattgacatatgaggagtgatcaaagtgctcaacatcaatttttaaaagtgtttctcctcagtttgatgtgttctggaaatttttggagttttccgaaagtcattttcggactttctgaaaatgcacagaaccaattttcgcttctggaaattttcggatatgtccgaaagacattttcggattttccgaaaatgactgagaaggcaaatgtggttctgtttattttcggacttttccgaaattgattttcggagtttccgaaaaactttagcaaagccaaaaacgcttctgtgttttttcggacttgtccaaaagcgattttcggacttttccgaaaacatccataaccgtgtttttggttctggaaattttcggacttgtccgaaaagttttcggaatgtccgaaaaatctctcgttgactttgctgttggtgctgagctggaattttcggacatgtccaaaaaacttcgggaacatctttgtgagcttcatctttggtgactttacttcctccctctccactagcttagctttcttgagccgctataggtatagttgctgtttgtgctagcatattcttgttgtaggcaactagatctaggatttactttgctacttgtgctgactccgaaaattttcagatatatccaaaaatttcggaaatatccgaaaattactgcttccgcttttaattggatttttgaattagcctattcacccccctctaggcctaattgacactttcaattggtatcagagcctaatctcctaattaggcttaaccgcttaaagagatcatgtcgggccaaacgggggaaggcaaagatggtgataagggagctatatttccttatgactatccacctatatctacatcttatgtgagtacctatagcggcaaagctccgtacttcaatggtacggactatgccgcttggaagcataagatgaatatgcatttgaagtctattaacccatttatttggagaatagtcgaaaaaggctatgtgttgcagaatcccgaagatcccaccaaggaggacgacgagaacaagcacaagaacgctcaagccgctaatgcaatacttagcgccttgagtggaagtgagttcaaccgtgtggatggcattgagagtgccaaagtgatttgggacatgcttcggaacttgcatgaaggcacggatagtgttcgtgagtccaaggtggagatcctcaaggggcaatttgagagatttgtgatgttggatggtgagagcccaagtgacatgtacgaccggttgagcaagatcgtcaatgagatcaagggacttggctccaaggacatgaccgatgaggttgtggtcaagaagatggttcgagcaatcactccaaggaactctaccttggtgaccatcattcgtgaccgtccggactacaagactctcacacctcatgatttgctcggacgtattcttgcccatgacatgctcgtgcaagagtccaaggatgtcatccaatacatcaaccaaagctcaaccacaagcatcaagaaggaagacttggcattgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgaaaagagcccggacacttcattgcggattgcccacacctcaaggatggttcccacatcaaggaagataagaagaagggtgagaagaaggatgagaagaaggagaagtacaagcatagcaagcgggaacattatggccaagctcaccttgggatgatcttcggctccaactccgagtcaagctcaagtgatgaagaaggagtcgcaacgttcgccgtcaagccttcatcaccaccgagactcttcgactactcaagtgatgaggatgctcccatttgcctcatggcaaaggagcctaagttaccttctcctctcaagtcatttaatgttgatcttgttagtgatgaggaggatgaggttgaggatgaagttatggatgacgaattgttcaagtccataactaaggaatccctaccacacttgagtgagttgcttgggagaattgaggaccaatatgcaactcttgagaggcaaaaggctttgctcattcgtgagaaagagcggtctcatgaactcaagagtgagcttgctaaggagagagaaaaaaatgaggctttggtacggctttacaagtaaaccaaagagtctcatgctaatcttgaggtggcgaacgctcaacttcaagatagagtggatggcttggacaaagcctacctctctcttgaagagaagttcgaaaccttaaaaaatagtgtctcttttcctagtgagccatcttgttccaaaattgtcccaagtaatgaaccatgtgtgagatgcaaagatattgatattgaagcttatgctactaactctatctctttgagtgccttgcaaaagcaaaatgagaagcttatgggactccttcacaatggcctacttaagtgccatatgggtagtaaggccctaaaggagtacctaggctatcaaagggacaacttcaaccatgagggtcttaggtatgttcctccaccaaaaggaaaggtggacaagagtgtgatgatcaagaggccccaaggtcttagcaattttgttaaggccaaaagtatccttcctaatgattatgcttcacattgttcttttgatgcatcttatgttcttagaaagaatgttagtggtcgtgttgttgctaagtatgtaggcccgaggggcaagaatatttctatcaagagagtactttgggtgcctaaggcacttgtcactaacatgagaggacccaagcaagtatgggtacctaaaactagaaattgatctcttgtaggaatatatctccggtggaagaagttgggtgattgatagtggatgcaccaatcacatgaccggagaagaatcaatgttttcaacacttgatccaaatggcacttcacaagataacatagtctttggggacgatggaaagggaaatgttatgggattgggtaagattgcaatctctaatgatctctccattgccaacgttctcttggtaaaatctctaaactataatcttttatccgtttctcaattatgttctatgggttacaattgtctctttaccgatgttgatgtgaccgtctatagaaggaatgattcatccgtggtctttgagggtgttctcaagggaaagctttaccttgtggatttttccccaagtaaagccaaacatgagacatgcttagtggctaagtccaacacggggtggctttggcatcggaggctagcccatgttggtaagaggaatcttcacaagcttctaaagcacgatcacatccttggactaacaaatgttcaatttgagaaagatagggtgtgtagcgcatatcaagccggcaaacaaattggagcacatcaccccgtcaagaatgtgatgaccactacaagaccattggagcttctccatatggaccttttcggaccaattgcttatctaagcattggaggtaacaaatatggtcttgttattgttgatgagttttcacgcttcacatgggtgttctttttgcatgacaagagtgagacacaagccatcttcaagaagtttgcaagaagagcacaaaacgagttcgacctcaagttcaagaacattcgaagcgacaacggcaaggagttcaacaacacgtgcatcgagagtttccttgatgaagaaggcatcaagcacgagttcttagctccatattcacctcaacaaaatggagtagccgagaggaagaatagaactctcattgagatggcgaggaccatgttggatgagtacaagacatcggaccggttttgggccgaagccgtcaacaccgcatgccacgccatcaaccgcctttatcttcaccgccttcttaagaagactccttgtgagcttcttacctgtaacaaacctaatgtctcttactttcgtgttttcggtagtaagtgttacattctaaataagaaggctagatcatctaagttcgctcctaaagtggatgagggattcttgcttgggtatggatcaaatgaatgcgcatactgcgttttcaacaaaacctccgatattgttgagatcgcgcgtgatgtgacatttgacgaaactaatggctctcaagtagagtaagttgactcacatgtgttaggtgaagaggaggacccgagcgaagcaatcaaaaggttggctcttggggacgtacgtcctagggagccacaacaaggggtgtcttcctcaacacaagtggagccacctacatcaacccaagccgacgatccctctacctcaagcttggatcaaagtgaagaatgcgagcaagtgccaccctcaccgatcaacttagctcgcccaaggatccaacaaagtatccaaagagatcatcccaccgacaacatcttaggagacatcaacaagggagtatccactcgttctcgtattgcaaatttttgtgagcattactcgtttgtgtcttctcttgtacctctaagggtggaagaagcccttaatgattcggattgggtgatggcgatgcaagaggagttgaacaatttcacccggaataaagtgtggattttggtgtagcgacctcggcaaaatgtaattggcacaaagtggatcttccgcaacaagcaagacgaggccggggtcgtaataaggaacaaggcgaggttagtggcgcaagggttcacccaaatcgaaggattagattttggtgaaacttttgcgccggtagctagacttgagtcgattcgcatattccttacttttgctactaacctcaattttaagctatatcaaatggatatcaaaagcgcctttctcaacgggcctattaacgagttggtatacgtggagcaaccaccgggcttcgaggatccgaagtatcccaatcacttgtacaagctccacaaggcactctacgggcttaagcaagcccctagagcttggtatgagtgtctccgaaattttcttgtgaaaaacggctttgaaatcgggaaagccgattcaactctttttactaaaagacatgataatgatatttttgtgtgccaaatatatatcgatgacattatatttggttctactaacaagtcttttagtgaagagtttagtaggttgatgaccaaacgttttgagatgtccatgatgggtgaattgaagttcttcctcggccttcaaatcaaacaactcaaggaatgaaccttcatttgccaaacaaagtatttgaaggacatgctcaagaagtttgggatggagaatgtcaagccaatccacactcccatgccatcaaatggccacctcgacctcaacgagcaaggtaaagacgtcgatcaaaaggtatactgttctatcattggctcacttctttacctttgtgcatctaggcccgatattatgcttagtgtgtgcatgtgtgcaagatttcaagccggtctgaaggagtgtcaccttgtggccatgaagagaattcttagatatttagtgcacactcctaaccttggtctttggtatcctaagggagctaggtttgatctcattggctatgccgatgcggattatgccgggtgcaaagtggataggaaaaacacatcgggtacttgccaattcttgggtaggtcccttgtttcttggtcttccaagaagcaaaactccgtcgccctatccaccgccgaagcggaatatgtttcggcggggagttgttgtgctcaacttctttggatgaagcaaaccttgagagattatggcctcaatgtatccaaaatcccactcctatgtgacaatgagagcgccattaagatagccaacaaccccgtccaacactcccgaaccaaacatatagatattcgccatcatttcttgagagatcattccacaagaggcgacatagacattcaacatgtgagaaccaacaaacaattggaggatatctttaccaagcctctagatgaagctaggttttgtgagttgaggagtgaactaaatattttggattctcggaatgtggattgatctattgtatgcatgtttgcttggtataataggttttgcatagcaccttgtgacaaaatggtcattcaactcatggatgggcactggtcacttttgtggagaacttgaatctatgtgtatggggatctcatttttcaatgaattttggtcctagcacaacttgaaatagattcacacattccctatctcgagggtgaattatcttgtctcatggtaattccctctcttttgatccctcggatcatccatttgacttgtggctattgttttgtgtgattgattgtgtgctagtcacaagttcaattggagcctatagtgctcgaccatccctccattcctaaatcctatccaaatctttgcgaaatgtgtttttgtcaaaaatttcccggagctagtcccctgcaaaattcctttaaaaagtttggaaaactgtttcttcaaaattccccttgcaaaactgtgttttccagaaattttccgactttctgaaaattttttggatttttcgaaaatttttcggaccttccgaaaatttcctgtcctatcgctcttcaatcaaagcaatcccaggatttttcggacattccgaaaattttttggatatatccgaaaaatctataaaagcgtgcacaaccttctggatcttttcggacttatccgaaaattttcggaaatatccgaaaatttcggggtctttttatgtcacctcgtggactcccttctctctcctttccactctttttccccacgggattgactccctcctccctccccaccggcgaccacctcctctctggtgacctcccgcggttcccctcctctccaacctcgtgggagcgcgtttggggcactccttgggacctacattgtcgatctccaccacgttcttcaagtgttctttgcgttcttgaggtattcgccctaaaatcaaatcctttgattcctcaagttttatcttgcgatttcctttggtggagatgttcccctagtgccataggacctgcagattcattttcacaagtttttgttggcggatttgtgcggcatctgagtaatagggttcggccggaatttttcggacttttccgaaaattttcggatttgtccgaaaatccttggccgacccctatcactttggatttgcacgattcttgccctcactcacttgtttcttgcttccttggcttccattcactgatcccttgtatctcttgtgtttgaaggatgcctccccgcaagcaaacctcccataagtccaagcgcccgagggaccgctctcccactccatcctctcatgatgattcagacggtgattggtccggtggagaggatgcggttcctcaggttgcgcggggggctcggggcggcaatcttccttctcggcggtctactcaagctcttggtggtggtggtgatggtgagggctcctctcgtcaaccgcaaacgccgccgcaccaacccaatgttcccattggccctctccgcattcatacccccgagagggatccggcggtgattcgtcacgtgtatgattggaggcgcaagtctgaggttgttgctcctcgccgcgatgaggatccacgctcccttcgccgcactgccacggatccgcggttttggactctttttcagcaagacttttatgagtctgtgatcaagtccaaagctcatcccactgttcccatgcaatggatcaattgggaggagttgcaggcgcacaatgattcggtgataaattctgtgattacaaattgtgatctcatgggtattcgctctttcatgactttgcagcaaaattggtgcaacgagatcattgctcagttttatgccaccgtctactttgatcattatcgtgccatgcactggatgactcagggatcctggtattctgtttcctatcagcagttggctgaaatttggggttttcgtcttcgctccttacttaaccttgatgacctgcataatcttcaaattcctgccaacactgagttactccctctttactctccaaatgatcctaatgtggtgttgggcaaggtcgatggtctcaagccgtactttgcctacttgaaccggatgtttcgccggtcctttgtgcctaaggatggtgatgctagcagcattaaccacctctctcggaccgtgcttcttaggtttgatccccctcctcatcgctttcatgtttatcactttgtgtgggaggaaatccgcatggcttccattcagtacaagaaggggttggtctatgcccctcacattatgcggatgatcgagactgtcactcagcttcagtttcgccatgatgtgactcattctcagcttcacttgcgcctagataaggccccccgctcctcagctgctcgggacatcccttcctcttccactcaggcacctcctgctcctgagcgccctgcccctgtggctcgtcgtgagccgtctcccttattccgcattttgcggagtctttttggtctttgctccgcggaggccaaaaagaaccgccggcggaattcggcgaagaaaacggctcacgacgtcaagttcctcaaggcaaggtattatgaggaccaccacattgatgtccctccttctcctccgggtttcgaggccgagcccgatgagccagaggaggaagcgattgaggatccatttgctgggttgcctcctaacttcgacttcttcggttatggccatggctatggctatcttcctccaccacctccagaggatcctcctcaggcgcccttcgcttgagtcgtcgtcgcatcgtcctctctttttttggtgtcttgatgccaaagggggagattttctctctatctatcatgtctttatggtcgagcacatttggtttttatttgtatgagactatgtgtggttgctaagttaagtttaatgctttgtaagactttattgtttaattatggatgcttgagatgtaatggatcttattatgtttaatgtggtgcaatgccttatcctatttatatggtgcttgtgatgagatgtaattattcttatgcatatgatgtgttggatgtgatgagcatatgtgatatatttgttctcttgtgagcttcaatgtggatgcaaagatttagggggagctctctacttgcttttatgcacactctcacggggagctttcgctaaacctttgcaccaaaaccttaaattatattcattttctcttatgttctaatcgtattgtcatcaatcaccaaaaagggggagattaaaagtgcatctaggcccctaacgattttggtgattaattacaatgcgattagagaggactaacatttttctttaagcaaaggtgaaggttgctatgtcctcaatgagttagagtaatgcatttcccgccgaatacgttgatgagatgtgatgcggcaaatgagcaaatggtatattgtatcttttctttttgtttgagtcaataggtatgctgcactattaagagggatgatgcattgacatatgaggagtgatcaaagtgctcaaaatcaatttttaaaagtgtttctccttagtttgatgtgttgtggaaattttcggagttttccgaaagtcattttcggactttccgaaaatgcacagaaccaattttcgcttatggaaattttcggatatgttcgaaagacattttcggattttccgaaaatgactgagaaggcaaatgtggttctgtttattttcggacttttccgaaatcgattttcggagtttccaaaaaacttcagcaaagccaaaaacgcttctgtgttttttcggacttgtccgaaagcgattttcggacttttccgaaaacatccaaaaccgtgtttttggttagaaccgtgtttttggttctgaaaattttcggacttgtccgaaaagtttcggaatgtccgaaaaatctctcgttgactttgctgttggtgctgagctggaattttcggacatgtccgaaaatctcaattattgtgcataacgggcagaatttggtctgtggctataaatagccccctcccctcacttgtgagggctgctggttctattgcaattatttgtgcccttggcttgctctctctctaacacttttgagccttgctttcttgtttcccctctcacccgtgttcgattcggatttggtgtgtgtgtgagagttgtggattcgagtttgtgtgagtgcttgttgttgacttcgtgaagatttgtgagcacttgcatcatctccgggagttctttgcttcatttgttactcttggaggttgaggactccaaggtggctaggtgtcgcccccgagccaccgatctacttgtggttggccgggagaagtttgtgaaggtcggatctcacctccgaaagggaagagatacccttagtggaaggaggagtgcttagtgcaacctctagaggaaaagggttagctaagacccggctcttagtgagctcctcaacggagtgtagaatcccctcaaggattcaaactttgggaacatcttcgtgagcttcatctttggtgactttacttcctccctctccactagcttagcttgcttgagccgctataggtatagttgctgtttgtgctagcatattcttgttgtaggcaactagatctatgatttactttgctacttgtgctgactccgaaaatttttggatatatccgaaaatttcggaaatatctgaaaattactgcttccgcttttaattgaatttttgaattagcctattcaccccccctctaggcctaattgacactttcaatgtgtattgaactctagccttagtatcccgcatgatctctgaccaccctggacgttgtcttatctccaagccgactcccggtccatcaccgcaaatactctcccggtatcaattcacctacacatgaaacaaacaaagaaaccatattctgagaccaagctatccccaacttgactcattgttagcaaacaacagtattacatacggatagtatccatctagaagtcatattcatgagataaactcagatatccaaacaaacaatccgaaaacgaaaccgacatagtgtcggccggtcagaccgcgggctggccggtctgaccacgcgtataccaccggtctgaccggcaaccactacccggtctgaccggtcacataaaataacaacacctgtaatttacctgcaaatccaatcatctccaaaaccacttcgagaataatattccaaatatcaaaaccaataatctccaatgccaattgttcatcacaaaataataatcaaaaacacctttgattttacaagttcgtggcgccgctgccacccaccccagcacccgacgtcgctgctctcccccagcgcccgacgcagcgtcgccaccacccacccccagtgcccgacgtcgctgctctcccccagcgttcgaccacaacgctcgacgccaccgcccgccaacaaccccagcccgccacctaccgacccacctatggcgccgcccagcagtgagcatgagctcctccccatggtgctggtgagctcaagctcgtttcctccgccgtcaagctcctcctcgtggttgcagtactggcgtggtcgagcttgttccatccaccgtcgagctcctccggttctccccgtgttcaccggtgagctcatccccatggtcgcctcccttcttgcttgcccccatagctcgtgagcctaacaagccagctcgagctttcaaacaagctgagccgagctaggtttctagctcgttaggataacgagccgagccgagctagctcgttatccattatcctaatgagctagaccaggccgagacgagccgagctagctcgctatctacccctatgccctgagcaagatgcttgagagaaatatatgcctgtgtggaaggaaatatatgatgacgcttaactaatcaggcacacccctcgtcttgttgtttggttggagtcctatacctaagataaaacatgtccactttagattgtgacaactattatcaaagagagattgaatggagtaaagccagacacgcatgttccttagtctggcgagcaactttggtggccctggcctgagcgtgggtggtcctcagggtagtaataaacaaacaagcaactaagaattctcaggtaggctttaggctaggcaactcctctctagggcaagcagcaaccaaacacatccccataggttctgtttggagaagtagccaagagttatttgaagatctaatttttagcacaagaaatagccccccaataaaatagcccttgagttgtttagatccaagagctatttggcctttaatgcactttcccaatcatgcgaggagtgggggcggcagtgctggtgggggccggcggtgcggcgggtgaacggccgcacctcctgcgaggagtggaggtggcggcgctggtgggggccggcggcgaggcgggcaacggccgccgcgccgacgaggagtggaggcggcggcggcggcggtgaaatatgaggcgcgtgcgcgtggataaggcagaaagaaggccatgcggagagagaggaaagccaccttttttagtgggttctacccgaaatatcttcaatgagcacctcttggataggatagtttttttatgggttatttccaaatagccctcaaatagctcacccatttagatttgttgggctatttgagactaaaaaatatcccataatctaaacagggccgtagtctctcacctaacttcactttcgagtttgctagatctgtatgtggagcgagaagacgacagaactgatgagacgagatggaaagaaagaaaaacaatgtgggctgggttagctacggatgcacgtgtgcagccactactacttaaaaaaaataaggatctttcatgacccttaagatttattttcactagcggccataaaaaacctcgcttgtaaaataaaaacagacctgaaaacttggtcccaccaataaaaatggatttccacaagcagagtcttaagagcactacttgaaaaaaataaccccacatatgaaaatccatttttactagcggagtctaagggttaccaccaacaaaaagatcataggagaagggcgtgtggatcaagtcgtccttatcccatccctcaactatctctttttcttttccatcagccacttcctcaaccacttcctagatatcccctccctcatccatttcctctcctctccctctcttgcttcgatggcttgatggcggcgacggcggcaagaaaagccatggctgggctcggtggtggcagcatagggaggagacttcatggtggaggaaggaccaacaacggccaggctcggcagtggaaaggggaaccgtggcgggctcagcggtggcaaggagaaggtagtgatggtggaggagcaggacacctgatccggtgatgacaagttcgtctatggcggtgaaggggagtgctgcctccaccatcaatccctactcgaggagagctcaaccacaacgacgaaggggagggcggtagtagtagaggaaggggagtcctagcttgtggatccagtggtggtaggcatcgagagctctagttctagtggtggcggtctttgggagctctggatctgctggtggctacaggttagcgataataaggacaatggcttagcgaaatcgaccaagacctccttcctcatctttcccgaccagatctgagctcgcctgacctcctttctttgaaccggcagcggtgatctcggcggctcccgaaagggcgtcttccacccatttggcgacaccgccatcgacgacgtcgactttttcatcgaccaagacgtgtggatttggggattgggaatttgagacagtgatagtggatcctgatttttaatattttttctcctaaaaacattctcgatggtgggtctctctagctaccatcagcgaaaatcactttttcatatgcgacctttttaccttagccacttgtcaaagttgattttcgctggcggccggctgctcatcagcaaaagtttattattttcactaatcttaggtcgttggcggcgccgctgactgcccaaaaaaacctgttttggctgtgagaaaaagttgttattgcagtagtgaccgaaagaaaaattttagaattataccgttgaaattcatttttcttagaaatatacgagattcgaaagaatttacactaattgacgaaagcgcgacaaaatcgcaaaaccaacgcgctattgtgcggtctcgcagggcgactgtgcgagatcgctctgacatggggcctcggtctcgcatattggccaagcgagatggctggaaatgacgctaatgacttaattaatcttcctaattagtggcaaattaattactaataataataactagttaaacaaaaataactaattaattgctaatgacactaattaatctattaaagacgtgagttcgcgcgccaccagcgcgggagacagcggggtcgcgcactctttatgcgagactgcggtctcgcacttttccttccgcgacagtaccacaatggtatataccatttctgtaattttcttctaaacgtgtatatttctataaaatcagaggaaaaaggttttttttttcgtgatcgaaacgcgtttgcgtgggtctagaccgtattatattactgctcatgtattagctgttctgtacgcctgcttcattctgcataccactgcgcactgccgccgcttaattagtggatatccctaagcctaatttcacaagataatccgttggaaacacattggaattttaactaaactagtgttatacatgtgcattgcaatcgaatttggagtaatacttaatggcgctgtgctttcagtggtaggcgatgtacccgtcgacagtgagacgcctatagtgacttcgtcaatctctccaggatttgccggcccagtcttcgaggtaaggtttgcgtgcgtgtgtttatagggatgagtgcgcgtgcgttgtgagtgtgtgttgtactgtgtaattcttaaaaaaaaaatttggagtaatactggtgggaggggtgggtcggtttgtttttttcttgggattttctcagatagggagggtgggtctgtttggcttttatgggattttcccacgtagtcaggagaggtgggctggtttggttttttacatgattttggctcttttgagattctaattttttttcttcaaacttctaactttttcgtaacatcaaacttacctacacatataaacttctaacttttctgtcatatcgttccaatttcttcaaacttctaattttgacgtagaactgaacacagcctttctcgcgctgcgagcggtaggggatgatgaccgtgtatttaaaataatagagataatgtatagactagaaatatttataaccgggttaaggtcgagttcggcactcacctttcccaacctatactccatcatttttcacgcgcacgcttcccaaattactaaacattatgtttttttaaaaaaaatatacaagaaatttgtttaaaaatcatattaatctatttttaaagcttattttagttaatgcttaattaatcatttgctaatagatcgctttgctttgtgtgcggagaggtggagttcccaacctccaccttcaaacacagcctaaacaagttattgtgaacaaagtggagtaaactgcaggagccatatatatccaattgaattttcacagtgaatttcaccttaactaaatcgtttcttaactaattaaaatattcgtatttttcctttcgtcacctcgtccgtgcgatggtttttcatccgtcccacccctcctccaaaaaaaaatcccaatcggaattccatcatcacacaaacagaatcccacaatgagcacaccttctctccaaatctcaaatcatcacattccaaatcaaaaacaaaatcctagtccaaatctaaatcggaatcatcaaaaaacatccagaatattaacacgagatgacgagaggagagggaggggcgagccagaggccgccacgcgctgctccttgccacctcaccttcggccgaatctggtaaggagtggggcggcgaccactgcccgatgaggagagaaggagccgacgccggatctggcaaggagccaccaccaccgccgctcgtggtgggggagggcgccgccacagccactcgccgcgagggaggctgccgcgtccgccgcttgcgggagggcaaggcattgctgccgccgtcgccgatgctcgcaggaggaagggcgctgccgttgctcgggggagaaggttgccgtcaccactgccgctgctcggtggggaaggctgctaccgtcgccatccgttgggcaccgccggtggggaggggcacgaaaaggtgcgccggtggggagagaggcggcctgcgtggaggggaggaaggggaaaactggaattaggattagggcttatttggtccgggggttttgatggattaggagccgatctgagccgtccatcaaaatgaacggctcagatcgctcccgcgtcgggccagcatccatcatcgggccgcatcactgctaggccgtgctcgcttcatgagccgcatgtaggtcggtgtcacgccccgaactagtcccgaccggaactagcccgtgacgctccaaattaacctgttaatcgataccagtcccaggaaacagtgctggtatcataggaagacagaatatcacagcaacagaggtctctttaatatagagaaggagtacagtcatgttgggctgcggacagatcccgagctcacaactgcattacaaaagggaagcggaagccaagacttggaccaaacaacacaggcgcgacttgggaactaggccgaaaccctaaaactcaacgtagccggcttgctcctagaagaactcctcgtcagtgggatccgcttcatcttcttcagcaactggggggagttatttatatagagcaagggtgagtacgggagtactcagcaagccatgggaaataagtgtttaatgcaggcttcaaggaaaggctgttgtttttgcaattgattttatttgaactcttttctgaaaataactaagtgagtgcttctcaaacgacacggatgagacagtgcgtctcgtccggtcggagtatgtgcaaatgtatcagtctttagaattgatcaagattggcacccggccaacaactttcaaacgaccacccaggccaacaactttcaaacggccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaatgggccggccggcccaacaaggcggcccagagcgcgcgcgcgggcggggaggagagagggagccggtggaccgggctcacctcgcgtggtcccgagtgggacccgcttgttggtgacacggttcaccgtgcggaacgcgcacgcggcgcccgctagggtttgggggagggacgcggtgcacgcgcgcggttcgcggaggacgcggatgcggcgggcccacgcgcagcctcacggctcgcggtggaccgcgcccgcgagtggggccgaggggagcggctgaccggggtcggctcgacccggtcttggccgagctggcgccgacgtggctgccacacgggccggcgggaggtagacgacgacgccggccggaacggacggcggacgacagcggcgagcggcggagcgaaccacggcgatacaggcgaaaacgagcacaccgggtggttgcacgggacgagaggagtcgagccaacggctcggattcgccggagggagctcgacggcggcggattgcggcggcggcaaccggcggagagaaaaggggaaaacggcgacgaggtcacgaggggccgattcctggcggcgagagcttctacgcggctacgggaatccgtcccttgcgccggattaggaggaaacgcatcgagggaggccggcgacgagaggcgcttccgagcttgggcggcgacggcggcgagcacacggcgagcggcggcaacggtcggggcggcgccggctagctacggggaggctactcgtgctactacccgagtctaaggggaggaggtggaacgaggaggaagaacggagggaggcactaccgtgcgggtgggcgcagtgacgagagccgacggcacgaaacgtgatcgtttcggcctctggccgaggaagaggagggggagggcgtgcccggagtccccttccgcgtccttgctcgtgccggctccttcgacacgcgcaacgacgaacggggacggcaaacagagcacgggaggcggtgacaatggcgtggcggcgagagacgaaaacgagggagattgcaggagggaggagcttgggtttataggggcgacaatgtcggtttgggagaggggaaccgacattggacggtcaagccggcgagctggcgcccggctagcggccaaaacgacgacaggaggtgacgccggcgagaggaggaaaaagaagaaaggaagagggaaagggggcttgcctccttgccgctttgggaaaaggaggagggagcgggggggtgacgcggcagagggaggaggagctctgcctcctctccttggaagctagcgcgtggaggggcgggccgagtcgatgacgacgacgatgacggtggggtggtttggagcggggggacgacacgggcggcaggcgcgggcaggcgcggcagaggctgacgacggcggcgaccaggcggtcggccaccacggcacgcgcgcgcggaaagcaacgtgcgacgcggcggtttgagcgg

SEQ ID NO: 59137 - DNA, 7395 bp, Oryza sativa
ccccgagccccacgccgccgcgccgtcccgtcgtcgtttaaagccggccacccctccccgcgcctatataagcccctccccggctgcccattgctccccacactacccccaccacctcccctgccttttccctctctttcccatccccggcgttgccgcctcgttggaagccgccgccgccgccgctgagccgacgcgccccgccgccgcgatgtgcctcgtcgccgcgccgtgctccgccgtcgacctcgccgccgcgtctccgtcgaccccgccgccgaaccggtgagcctccccctcccccaccgcttgccgtcgcgccgtgccgcccgccggttctagccgaggccatgagagagagaggagaaaacagagaggagagagagaaaagagaatggaggagagaggttagagtgggccccacctgtcattaattccatccaatttcccttagaaaaataattctgtagaaaagaaaatcaagaccttgaccccacctgtcagtcactatagctggtggataaggttgtattataaataaatgaattaggaacagtaccatttcacaattattagaattaattcaaatttgaatctttacactagcataacttattcatttcagctccgatttgagtgaaacttgaacctaaattcatctaaattcataagctttccaatgatatataattcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaataaccacacaaactaattttatgtgatgtctcaaatgaatggatgtataggaaaatactagtacttatttaatattcgatggccatataattaaatccatggcttataggttatttaaatcaagtatagccttatgattatgtaactaaaatataaacacacatagatgaatctttaacctgtttaggagaatactaacagagctagatgtggaggaatcactaattaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatgtacagtaggcgaccaaaacattatacgttgttgcacacatatattgtacatcccattatagttatacaattaatttatctttttcatatattaaactggggagtatataacaaacatgcatagtagataagtactaattataaatcttgacctcatatgtttatagttcaattgtaactccggattgttcattaagagataatctgtaactataatattataaacctcccgaatttaacatatagagcatggataattattagcccttttataatttataatggcaagtaaaatatgttcataattaaagtaaagcttccatcaataaaataataatacaaatgattcactgtaattatttgattgatcctaaatccatttaacaacagaacctctgatatgtaaccgtgctatttagatagctgcatacatagccataatccttccatagccatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttgttgcacatatttgattgttgtttgaatattggtttttctcgcgtattatagaccttgtgtatcggttagtcgtgaggcaacgtctgcaatttccaggaggtgaaggttgatcaagattatatcaataataaggattatcctgagcaggcaagtcatcactattccttgaacatgttgatcccaattgcgaaattgttttgtttacaaataaaattacatgcaatgatgaacatcctacttgtgattatgccatgccttgattattgtttacccttaaatatttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccataatgttgatgacatgatttgtgaaaggagaaataaaattaaacaactgttttcgactggggcggacggaggatttgggtggtatctggaaaaggctagtaccgtccccggtcaattaaggaccgagccatgaagttaagcacgaaacgacccccgtacaaccgcacttctcgtatgggtataggcctagcggattagatagccgagcggaggcagtatccctgcatagatggttcacccttgagtgaggcaggtgtgctacggtgggacagctgttaaggtagggccgagaggcgtgccctacatcggtgtcgccattggtaggactgccatgagtgtgtgagagagagagaacttaacttgaaccataatttaatatgtgtgagacttctctttcccgggagcaccagaactcctcacactgctagaaacatggacgcctagagtgcatgaggatttaagttcatggagcgggtactgccaatgcgaggttatcgaaaaactttgccgtgacgcgtctcatgtgttgggacgaggatcatgtgttgggcagtcgcggagtgcgggtaaagtgtacatccactgcagtgtgagtaaaccaaatctattcgaatagccgtgctcgcggttaacgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgtgctaggtctcgttccccagtcgactgcctatggcatgttaaccagacccttatattattttgtcttctgctgttgttctctgatagttgttggcctacctggccctaatgtaagtatttaactcttttagcctaaattcattcgtgatatgttgtgatccaactatgtatgtgtgtaccaactactgatccagggattggtatggataaacacagaagatttccgatttccaaaatcgggggtctacacataatatagcgaaaataagtctattttccgtccctccactttgggctatgaattatatatagtgaaaataagtctatttttcatccctcctctttgggctgacatatatatgtaaaataagtctattttacatccctattctttcgaccgtggcatataatatgtctatttttactccctattgtttatgtgtcgggcctggcatgcggcccatcgtgctgtgccggcccaacgtgccggtggagaggcctaggcacggcccggtggtcgggctaggccggcacgggcccgacccttgacgggccgtgtcgtgcttgggccgggccaaaatgccgtgccgtgggccgggccgtcgggccttgggccttttggccatctataacaccaatgactctatcttcatccgcatgcgtgccgttccacttggaggagcaccacggctcgtcccttgctcgcccaccgtggccgacaaatgtggaggtggtgtcggggaggttgggaggtgcaggatgcatgcacgccacttccgctcggaggagcgacaccgcttgttcctcgcgtgctcgccgtgactgacaagtcatgacagcatacaccacgaccacactcgtccgtcatagcaggcgtgcgagggatgaatgtcggcgctcctctagaacgaaaacgacatgcgggcttagagaaagggaaggaataaaatgggagagatagagagatgatggagacttgctggtaggtcccaccctatttccgacgccacgctgttgccacatcagataatgacccgatcaacatgccacgtaggacgaaaatcgccattcaaaccgttcgaggaggtaaattgatccggtatttatagttgagggatcactagtacagaaaaccctataggtgccggttaggaactggctccattggtcggcacctttgcctcatttttattgctgccggttctaaaaccggtacctatactattaaaaaaataaaaaattgatggcgcctacagtgccaccggccttctccaccgccgccaccaccacctcgcctggccggcctccacgccaccacctagccatgcctgcctccatgccagcggccgccacccaacaccgcgctggaggagggggggcccggggagagagggtgtcggtgagatccagcaaccgcgccgcaacctcgccgtgtcggtcgccacaccacgtcgtgctagaggaggagaagggaagcggggcgaggtccctcgggagaaaggtggccgctgtcactgccacctcgccacgcctgcctcggcgccggcctccacctcacccgcgctgccacgaggagaggaaggcgagaggggcgaggctcctctaaccatcagccgccgtgccggccagcctttgccaccaccgttgtcgccgctacctcgccgcgccatcctcggcgccggcctccacctcacccacgccgccacgaggagaggaaggcgagaggggcgaggctcctccagtcgtcagcaaccgcgctggccagcctactccaccaccgccgttgtcgccgccaccttgccgcaccagcctcggcgccggactccacctcacctgcgccgccgcgaggagaggaaggcgagaggggcgactagcgaggctacaccgccgcaccgtagagcctccctggaggagaggaggggcgagagagagagagagatggcgttgtgtggcagtgtgggatggatggataagataaaggatgtcgtgtggatggcgctgtgggtggtcaaaaaagccggcttggtttttttcaaaggtgtcagttccgttgaaaaaccgacacctatactataggtgtcaatttttttaatagaaccgatacctatatttgtattacaggtgtcagttctgttggcaactttttgtaacaagttgacaagcacgatcgcagcaccttaagctttgcggtgatcctagagtcaccaacgacctcaatctagccaaacggccaaaccaagatgggttttcataactaaaccggctagcggagccgatttgagataactacccgtatcgtgggcaaaacggaaggtttttaggacaaacctacaaagaggtgttgcactcttacagtgacggtgcaaatcgacaaagatggactaaactagggtaaaatagaaaacataactgaaaagtaaagaaaaaacgattcaagtagattgtattagggggattacaatgaaccggccttgtcccttaaataggggttggtcttgccctctacaggcccttctccacgtccaactcggaatagaaacgaaaggaaacacgaaacatagccttcccgagcaaggaaacccgagacccgacgaaaacagacccggattcggaccctgacggtctgaccgcgcacatacctgcggtcagactagccctactagccggtcagaccgcacacatacctgcggtctgaccggccctgtgaaggaaacccgacactttccaaactttgacaattttcccctatttcatccataggtgccaaatttgggtgtaaacatgttctaaataaaaaccgacacctatcgtataggtgccggttttttaatagaaccgacacctatagtatttaaaggtgcgggttctatttttttatcgtgcggaggtgggaaaatgtctataggtgtcggttttaaatgaacttctataagaccggtccctatgagggttttttaagtagtggatgcgatttaaccaaaggcaatagtttaagaaagcaaaataaacttattcgggctcaaaatttacgcgtattacacaaggctcgtgtttgggccaagcccacgaagccaatgcaaacataccaattccggattgaattgccacgtaagcgccacgtcagtgccacgtcagatgaagacagattcaaattagccacgtaggcactacgtcagctaaaaccaccctcgaaacctccaaggaaccttatatgtatcggttttgatagttgagggaccggttgtacctggtttaaggaaaattggattcgttgacaagttaaagagaacttagatggacttattccacaccaaaataccacatcactccccagtcctcgttgccctcttgccggagccgtcctccgccatgctccgtactccatctccgatcggcgacccgccctgagccggcggagccgctcgacgttagggccccacctcaccaggcgacggcgtgggcatcctcgattctcaggggtgtggcggcgtcggcggcggcgcaacggtgggcgccgtccatccctcccagccggctcggcctggtgaccggtgagctctctggaacccgtcacatgaagtttcttttcgtcagtttctattgggccatcgatgatcgatctggtgaatctgtgatcctttgccgtgtcgggcttcagattctacggtctgcatacctttgcccttttgtattagagtataagttggaaaactgataactggccacacagttgaggtgattccaaacaccaacttcgtcataaccttcgaggcaaatagtttcttgttgatggcaaacgatcaatgtgtagcaaatgatccgattttttattattccatggtctcgaactgaaaaaaaaaagtagttcgattttacttgactaaattgctgttcacgttgggctggttctatgcacatactctctgctcctgacactaaatgtcgatttcttgtaggattca

SEQ ID NO: 59138 - DNA, 1643 bp, Oryza sativa
aagttatgaattattttttgatataaagtttttagaccgtcctgtgtagggaccggggtgactcaactgaacaagttggaggatctaaatgactgatctgcaagtttagggaccgggatgacacagttgaataagtttaagaacctaatcgatcgatttgcgagtttagggaccggaatgacacagcggtacaagtttagatggactttactcttttttttattacccccagatccgtctatgtgaggaaccaccggcactgtcgtcttctgaccgcgccgtggattcctcaccctcctgaagctcgagacgacgttgttgttccctccacagcaaggtcaaggtcatgcatgcgcactatataaatttgtacgtactatatgattgacgtgctcgcttatcgcctgtataccatgtggaactatgttttcttatatacaatagttcaattttcataatgcaaaaacgtgcagtcaaaaggagatttcacataggtaatatgaaattgtttgttatagtgttagtaaatagcaaatcattttatcactgtatcaacaaatactaaataatttggagatgaaacattttaaatataccacatttactaaagttaatataactacaacataaatcattttcccaagcggccggaacatattttcgcagaagggcaaaacaacttcaggtgcataggtgtatatgaaaatcattattttcctatgcaggtagtgcaactgcttgcaaaaattgtatttttgcacgtgggtgcgttaagcctcccgtcgaaaaaaagttggcaaaaaattaaaaatttcaaaaaccaaaaatccaaaaaccctagatccattcatagggaaaaaaatatcgccaacacagtctgcgccatcaatgtcgtgccgaagctgcctctgtcatcacgtcaggatccgcagacgttgtcgctcgaatccattgtgtcgtcatcgctcgaagccaccgccgccgctgtcatcgtcgcagctcaaagtcagcggctgtagcggatccgtaggtgagtacggtggagtggcggcaggatccacaagggaggggcacaaatctctagatctgctcctcccgtcaccaccactggcagatccatgtgcatgggggttataggcgacaggattcacataggagagggagagggtacgagatccgcccatcccgtggccgccactgacggatccaagtgcaaggacgtaaaggtggtgggatccacatggtttgaggcggtcgctgctcccactattgtcgtcgctagcccgagtgagaagggctgatgggagtgggatggagagagagtaggggaggaggggataagtgggaggagaggagagggtggaggaaaaggagtgaggagacaagaagaaaaaaaggattgaagacgaaatggaaatggaaatgattacggcgattaccttttttatattatggtaataccgcatttctcatactatttctttatttgattaagagtttataggcccatcgacttctcaattagacatcttacttgagtacaaggttaaaaggagacattttataatttacatagtgtaacttgaatttccttatgtaaagttaaccgtgcgattttatcgttcaatgtttcttatatgttt

SEQ ID NO: 59139 - DNA, 5586 bp, Oryza sativa
cacttgattcccctatagagcctcgcagagcaaataggcatggtacacaatgctattccaggattcccagcattacccctgagtcctgatacacgggttataaataaaaatatgcagctcatcaacgcagcccatccccaacctaaccccatagcctcgcaggtcgcagttgcctctccttccaaaaactttaacttctcgcaagtcgcagcagtagggatcgacgcagacgggaggccggcgagtgcttcaacaccaccggatctgaaggagcagcagggactcagtgactttatagtgggaatcttggaacagcttcgacggtatggattgtgggtgtaggtgtgcacgggtgcagatttgcttttctatatatataggagttggataatatgaaccaaggtacatatgcacctacatggatagtttgactcgtgtacataattcccttcatggtggctgcaaggtttggtacatgttacaatttttgtggtcaaaaatacccttcaagtagtactagagtagtttgaacaaatattttttttacttcatgaacagattagttgttactagttcaatatttgtgggtttccttttttttaagtactgttatacatttatttaatatgttgataaaaatatatattatatttctcaaaaatatatgatgtagatttagtacaacatattatgagatgatatatgtaaattgatattttattcaagaataataaatttccatccccccccccaacggttgtactaactttctatgggtggattttgtgttctctttgttttgcatttgcactttttttttctcatgattgtctagtcaatttatttggtatcagtctttcaaatgtcatgcaagttatgagtttagataaaaattattatctaaatgctatttagagatgtgtcatttgcatgttccattttaagagaaatgtcattagtatgaactttgggagaccatttgcacatttatttagatatataaatcattttctacatgctatttagagatatgtcattaagaaatcatctgcaaattttatatttcatagaaagaaagatatatgatatatcattacaaacatgttcaacaaatctaaatatatatcactcaactataaagtgaagagagataaaaaaaataccaatgtttatctgtaccagtacaagatagaaatttgctttgaatcaatgaatgcttgtgctgtgacatactaatagaaaagggcaattagggaagaactcaaaatgtgacagtgccattgtgtctctcccctatatagtaaaccatcatcttgtcatggcatggtacgtttcactagcacaaatctcaagacccttcaatgttgtagattgttggtgcatacgaaagttaattcacataccagccatatgaagatgtgaagatcgagtgggattaatttgcacagtgaatttgttagcttgtaatgaagtaggagtactcacaacatagttacagatggataattatatattggagttataagtatagaccattgccatgaggttatactacaggacatgcaatctttgcgacggtgaaatcatcgttggttatcctagaaaactgttgggaatgctatggccgatagtttacagtcggggatttgtcaactcgcttatggtgattctatataccgttggccattacatttccaacggaatattgccgaccgtaagcccgtcgggctttcatggatttccactatgtcctctataacagataccatgattccctacaggataatttggattaccgatagattgtaaactattggcaatatttgttagagaaatagtgaataatcgatgacattattagcggtttacatagtataaacccaatattagccacaattatacattgagaagcatttttcggcaatttcccaccacttcatcagtatgataaaattgagcaaatatttggcttgatgcaatagttttcttaatgaaattgaagctaatagttagaatgcatgttaagaatatggcttcatctaagcacaacatccccatgatcatcaccatagtaagtgtgtaataaactatgaacatcttcgagttacctcttgcaatagatctattgcgctctatcctgctgactcgttggttctgaaaggaaattaattatagttagctaaaccatgataggaaataaataaataaataatcagctaagccaccaccctcaggttcaaatccttttgtccataaatttacacacccacaaggttaagaattcgcagctattaattttctctttaagcaagttaagtgacacattcacgggtgtatgtgaatgtgtctcccttgtaatcatgtaaaataaacagacactctgattgcataatatatgagaattttcattcatttgttatgctgattttctttttctgtatctctttttctttcaatcagttaggctcatctccacaatcctgcaagaggagtcagggacgccgaagccgaaggccaaacaaattaatcgaggatgcaagcctgaaaataaacatgcacaactgttgtcagtgtctctacgacagtagatgtgttttcagttacacatatatgggcaaataaactatagttgagatgatggctcatgggagaaacctccatgggttccaatcgccgccgattgagacgaagagcgaccgggctggggcgtggtcgactggagtccgattcgctgccaatcgggatgaactgcgaaccggagcagcccgtcattggcgaattaagtcaatctgatcatgtgccctgttcctcttctgttggcgtccgcatctgttctcttcataacgaaggtagcgagatcgtttccatttgttctgttcttaggaagatatgatcgagaggccatctgaagaaaaaagagattggactgctcgttgagaaaaaaaaacacgtacggtctggttgttgagaaaaaaagcgtaataggggctttataataagcccatgaggttaaattttttatagacagtaatgatagtacgatctaaataatcaatggctaaatctttttaattaatgtgcttgtagaaagtgtccaatttttaaaaattgcccgattattataggtatagatatagatataaatagatatcccgatactttccattcaaattttaatttcttttatttcctttaggcataaagactgaatgtccagatatcccgatactttccattcaaattttaatttcttttatttcctttaggcataaagactgaatgtccggtactttgattgtgtttaagcagaaatataggacaaacgaataaaacgatgagaagaatagcatctaccctatagttcagcaagttgttttactcattactcatttgtcatgtcacacaaccaatgatcatccaacgtcccagatcagcgcgcgtgtcccacgcctccctccgcatcctctcccgcacctccctctgaccctctctgccgcaatcgccgcgcctcctccgcatccgcgtgaccgcgcgcctctcacgagtagagcacctcccgatccgatccagagttccagacggatcacctcccctcccctcggcaaatcacagcgccctccaccccggatccctcgcctccgcgtcgccggtctgccttcgcgccgcccccggtcagcgcctgcgaggaggaacgcctcgccggtcgcctctccagtctcccaccctcctcccagtcgcgcagctcgcgctcgacctccgacgattgcctgtcgccgccgcctcagctggcatcgccgctgtctcctcagcctccgcctcaaccggcatcgcctcgcatcgccgtcgccttgccctcaccgtcgcgccgcattgccgatttcttcccgcctgtttgcatcacctccacggtgagtccgtcgccgaccccacggccgcgttcgccggggtcaccggttccacgcctcaaagcccggtcgcaaaaccttccctgcatcgacgcctcaatggctggcccacgcgtcgtcgaagccaggggagtcgggcgcctgaacggtcgcagatcatctccaactgcctctccgattgatgaagccgcaccctctgattggtgagttcaaccatcggcagcaccatcagccgcccgcgctctctgattggacgaggtcagcatcattggcagcaatatcaccttaaactttgcttgcattatgtgatttcagcatttcccttctcttcagaactaagattattacttcatgttgagttttcatatgaagtattctttatattgcaggttcaaaggcacagagaatccaccattacaagaacattacaagggggtttgtttttcagcacaaaaggtagaagcttgtgacataataagatatatgtggaacaattgtatagtgtataggcaccaagtacagggcttgcgatgctttaatttgattccgttgttatagatcagaagcagcctgctatagattaaaagcagtcctactgtccacaaggatcactagaagataatatgccctttgaatgctaaaacggtcacagtgtgacaacatgctttgaatgatggctttcaaggctaaacatttctttttcagattttcagggcaatggtggtcactggattgaagacaatggaattgtattctgatctgtgaatgcaactgaggtaccacacttcttatgcagcaaaagtatggtgtgattcgtgaaccttccatgaacggctgaactcgcaggtctaaacttcatttgtcctgaacctgaagttctgaacttctacttaagtcaagtagtactgaacttcttaatgaccgcttgttttttaagaaaaaaaacttggtttaatctgtaaactaaccgtacttgtatggttattttgatgattgcagggaggtcaggatcttcaatctctctggtttcaggttagcagagcatatgttttgagttttattaaatatcgatcttcttgtgatatatatatgtactctgtatgcctaattttttcaggaatattatggattcagtttggcaatctgttcttcacatctggtacatcggcaggtactccttaatttcatttcattgagcttttgtacaatggttctcagaattttttttggttatattccttaatggcttcactcaaatgcttcttgcaggggaagaagagttatatgcagcccatttaatttctatgatttttgtagacagcatcagatagtactgtttgttgtttgccatggaggtgcgacagcagggcaggtacgatcacatgtatactccattccaaacttataacttcactaggccatgcaaacttggataaaataagttaagtattggatcgatggaagttgcttctatctatactataaaaaaacccttgcagctgattcggtgtggattgttgtgccccttgaaggtacacttggcagccaccgtgtattgatccgatccatgtgtgaccctcttgatcccaggcactaaaaatttatagcggtgacttttttcggtggattaatttgttaaatcaaataccacatttattaaggtaaggtcaggaaggctgtg

SEQ ID NO: 59140 - DNA, 15480 bp, Oryza sativa
attttctaaagctatgtttcttgtcatcacttgttctggataaataggtatctcacatttagtgatagcatgttatctttttgtcttcttgctgattagggttgcattattttaattaacatatttcctgtacataagagatatgtaataatactggatggtatgtttatctttgcctcttgctgatcagggttgcattgttttgattaacaacatatttcctatatagaagagatatttaataatactgaaactcattagctctttatattaaaaggacatatttcttagaagagagcttgtctaagcatggaagcagggttgaggccaaaagtggcattggaagagagcttgtctatgcatggaagcagggttgaggccgtgctgtagcgtgtagtttgacaacttgacatgttaaatgaaggttgtgccaaagtggcggatgctacgacgaaacactgtattaaaattaataaagttgtagcagtagaaagataatctgatgtaatattgtattttttttctgtacacatgataactcaactataatcaaaggatgtggctggctatttattctttagatggcttcgattgaacttttggctcttggaaggatgtatgccgctggaaagcagaaacatacaacaggaatggcttgcagcttgctgacaaatacttagcttgaatgcttgaatcaatgataaccaaaagagtattatagtcatggcagaaataatcaaaagacaatatatgtttcagtaaaggatattgatttaagacatgcaaaagaagtaatgataagaagagttatatattttgttgttaatacctcctattataaatatttgaggtttactctccggtagggtttaaaaaaaattcaaacttattagactggcttgataacaaaaatgtttggttttgtgttttcggcaagtttaaaaattcaaactgactttaaatttttgacaaaattcaaccatattttacctgaagtcaatggtttttgcagtaatcggttgggtcgttcgcggtgcatacttacccaaaaaaagattcatacttatctatcttgatttctcgaggaatagctcaaccattctttttggcatggatatgcattgtcctcgtatagtgtatattgaattgattagatataatcgttgatgatcttgaataaataattttaagttatatcataatatttttttgatatatgaccttggactgaaagcttaaatggacagattttaggaacattattttaattgcaatcgaattttaataacttattaagaaaaatgttatgacaccgtagcgttaggacgggtatattactagtcactataaggccccgttgtaagcgtagtagtcaacggatttttgctgtaaattatttgcaccatgcttttaaaaatacgatttctcatattggccgtgggtgatctgtttagactacttgttttaaactgttcgttggcacctttttggtaaatacgtactcaatcacttaaatatttacggtgctatgaaatattatcaaccacctcgacctagaaaagctcttgatcaagatgggtttagaaaagataaaaaccgactagcaaaactgatttagagatcaaacacttgttttgtgagtaaattggaagcatatcgcactttcacggtgaaggcatacgatttaccgtgcaaatgcataaagatggatgaactatgatattattaggtagaacataaagtagaaaacatgactgaaaaaagtttaggtaaaattatgattcgattcattgtccagtacaagagtcaggagttagaatcgaatcgaccgtagcccttacaaagcaggttggtcttacatccacaagcattctccatattaagcattctccatattttattttattcagagatcaactaggactaaataaaacctcatgtataagcaaacaaacacgaaaacaaccatagttttggatttggactcggggttgccggtccgaccactcaaacaactaaggtccgaccgtccctatgccgctggttggaccgacatcgtatagaaggcccaggtcctttaatttccaaatcccgctaaaatttactatattttgtacttggtgccatatttggttttcaacactgttttgttacgtttttgtaacccatgatatttaatttatcatcagtagaccatcgatcaacctccatccgcgtttcatccaattcagacgctacctaagaggttgtagtttcttcgtcaactacttcctccgtttcataatgtaagtctttctagtattgcttatattcatattgatgtaaataaatctaaatatatatgtgtgtttagattcattaatatctatatgaatgtggacaatgctagaaagttttacattataaaacggatggagtagacaatattacttggctagtaaactaagcttgatctgttctgccatcttctcatatgattttttttttcacaactaaatgaaaaaaaaaatgctgctgctagctacttacaaaagagatatatagcagccgcgtcagcttattgctggatgaatgatggagaataagtgaagaactacggtacacgcccgtgacttaccccctccgtcccataaaaaataaatctagtaccggatgtgacatattctggtacaattaatatggacatatgtatatccagattcatagtactagaatatgtcatatccggtactaggttgtttttttatgggacagagagagtagctgtagtttcgatcatgtcagacggtcggaggagccgttgaattcatattgtcagacgtttccataaacaaaaaaatccagctgtgtaggacaaattcttatggtgcaagtaagatgtgcatgcagatgcggttactatgcctatagaacaggaatagattagtctctcgaaagaatatcgcattgttttttcatgttatttaaatagttataagaaaattaaaaaaaattgataagataaattaatgtaggatatataattcgagaatctattttataccactgagtttgtcatagttcaacaatttaccattgacattctctttttataatatactgatgacttatcaattattcaacaatacgcctttggcctccttaaaaaaatatgaaagtttatatataggttttatttttttttacattttgacatttttaaaatataacttatatgttatatgctatctaaaatgctttttttttgtgtttttgtttttaatgtaaattatctttaacatgctccataagattttttttctattatctcttgtgtaagcagtttgtctcgatatacctaaaaatatttttcctaaagtataaaaataccaaaaaaaacttaaaacttattatatacaaacttctctgttgtgtaagaaggtcaaataaaaagtttcatattttgttttaaattctaatgagataaattaattgttagcctcgtatgtctctaagggtattttggttttttttctgaaaaaggctcagcacagtggtatattataaaataattgataaaatcactggtattgttgatttctagtatcggcaatataatttataaagtgcactagatcaatgagagatggtgacacaaatttatactggttcataccctcgagatgtggtaataccctactcaagttggtgcagattggatctatgccggtgtgcgcaagtcagtgatgaagcagccaatggcgcgtataaatgacggagtgtctaacccctaagggtttctcccggcgcggcgccctttatataaagctagtgtcaccggtagccagttgatacatgccatctatttacaagggataagattgatttccctatcctatatctctttcttagattacaagttagccgcatgggcgttgggcacttggcccatcccatgccgcacagcccaaaggcctttccttaggtacccaggtaccatgtaccccataggtaatattgtagaaagagaatattagtagtaaatcgttgaatgagataaactcagtggcatataggtagattctctcaactctataagcaagcaacttaaaattcgatccacacaagttgtaacaaaaaaaaataataaggagtattgtgcacatacttcaaattcaatttcattctttttatacttagaaatgcagacttgtagttattgaactaggtatatttataaagattaataatattgtaatttaagttcttagatttgtttgtttcaaattttaaaagaagaatgaatcacaagcaaaacatgaaacggaacaagtattgaaaaaaacataaataagtctatgaatgatggggctcgaacaagttggtaggagtaaaccaatttaaccaccgcactagcttcgctaactaggcagcggcgtggggtagggtgaccggtggagaaggcagtggcaatgcccggcgcctacgacggtggtgcgacggagcgagcgcgaggggtagggtaaacgggggagaaggcggcggcaggttggcacactcaaccgtgagcgaagattccttttttttctttttcttttgattgatcggtaatttctgtaaccaatgtttatgcggagcagagatttctaattccagagatggatcgaactcgtggcatgaaccattggatgaaaagatctaagggttagaaaagacgtgtggatgaaactggtatatttttttattagtatagatttgtaaaaagcaccacatatgtcacttgaagtttgatgttctatcccataagtccccataagtccttttgttgcaaatgctcacctatgtaatcaaaattttttttttcaaaaaccaccctggtgcatacgtgattaaccaaataaatatgttttcatatattatgagccactaatcaatatgtctttatcaaaattaaatacttctagagtatagtcttgacatgataaagcctgagttccactcgaaatactcacggccataattggcccgatcttttggtgagttgatgataactacgatttgggagaaacgttgacgactcgactacgaccgtacaacacgttgttgtgttgcgccttaccgatcgatacacctctccatgcgttgtttatcttgctgatgcagatcaaccttattcctacaagcaaatcgaataaacaagtaagaataataaaaaaaacaatctgaattacaaatataaattgaatacaaatgataagttggggttctgtaacgagtaaaccggtgatctaaccgatcacggaattacacgacaaagtaagtgaaactaaactttaatctaatcaaacccgagaaacgatgcagaggtacctagctatttaaggtggtgggaggacgacctaggtgccctaatagtcatgatccacctggctgtggtgcaccctacatggctggggtgcaccccacatgggccctacttgggccggggtcccagatgaagttacaatcccatgaggtccattataggcgacgcagcatattgtttctttgattgcggttatgatggaatttgggaacacgactggatcacaggccaaaaacagagctcgtatgcagatttggcggcagtttgaagttagcaatgtagctggtggccgaatcggattgtaatacttggaggacttgatattgatatccttttattgattcatgatgtgagcacggttgtatccatagtagccatagttatatcatgacactttttgagattccacaaataaaaaatgcttatgagagcttaaatgttttcgcactaagtttcgctatacccaaaacaaaattttaatgaaacatgaaaaaaataatctaagattgagacttggctagcttagcctgtggtagccctaaagcgatattaggctgattcacttaaaaatatatggactgagatggtttttacaagaaaacaaagtaagggatggacatttgtaataaaataataaaatgtcaaacgtcaagtgacatatgaggtgcttttacaattttccccaaatataaggaggctgttgaccatgctgtaacacatgtcctaaatattttggttacttctacaatatgctttctccgtccaataatataagagtattatttccaatttagcacaaattaagtaagatgaaaaagtgcatctaggacttcaagagtacacattggatctgcacgaagtacacttttgaggaacaaactattgaacttcggcatattagtaccaagtacacgtgattttcgccgtgcttttctcaaatgggaacgggtgggactactgatcgttgatgtactgatcctatcgggatcgggataaccaaaacttcctataatcctgaacaaacgcccggggtgggggtgggtgttgtgtttagtatgtaccacattggatgtttggaaactaattagaaatattaaactagactattaacaagacccatttcataaccctgaactaattcgcgagatgaatctattgagtctaattaatccatgattagcctatatgatgctacagtaaacatatgctaattatagattaattaggcttaaaaaatttatcacgcgaattagctctcatttatatgtaattagttttgtaagtagtctatgtttaatactccaaattagtgtcaaacatctaatgtgacagggactccaagttggtccctggatccaaataagatccaaagttgtgttcggcaagtactcttcctaactttactttctcgttttatgtaatcatgttttctaaactgttaaatattatattttctaccagaagaaattgagaaatttgtcttaaaattatattaatttattttttaagtttttaagctaatacttaataaatcatatataaataagtagctcgttttatgtacataagagatgagttacgaccacagccaagagaccattatcccctatagtatagtgctggagagagggagtatctggttgtcgttctccgggtcaaaacagaggtttcccctacgatttgacaattgtgtaagcaaacgacaccgatccaacaaatcatagtgtttccttgcttgttgccgagttgtaaaagttcgattttgacaacgcagttggggaggaaccactagtgttgtgatggtagagtcatgggtgtatgacttcacccaccaagatttaaatttcggtgtccataaatattacacacatgttgctaggttttcaacatgactttagtgacatcagagatgtgttgttgtttttgtctcttaagcatttaggagacgcattcgtagggatgactgtggtgttgcgtgtatagtggtgtgtgcgtgcgtatgtcatgtttgcttctttttttttttacatttgatccttttagaaatttattttacaaatcggccctaaaaagcttattattgaagattcttttcgtggcgtcagtgttattggcgctgtggtcaaatattgttgtgccaattatgttggtgccatgtcctaaccctccggtgaaagcaaagtcactaatgtgaaggggatggcgccaatgttgtcgacgccgatgaccaatttataattttttaaaaagaacctattcgtaaaaaaaaattcaaattataataaaaaatatttacatataggaccctagagcaattattggcaccgaagacctatttgtaaatacttttattacaagtaggttcttttctgctacgagtacatcctttttaaaattttacaaatatattctcggcacccaacgataattggcatcgtccccattcatattagtgacttaacttttactggggcgagggggatgacgtcaatgttattggcgctgttatattggaccacagcgccaataacgttggcttaaaataagtttttcaaaagaacaggaaggtgaaaaatctagtctgtggtgtaattaaaaaaataaattttgacaacgcagttttgcgagcccacaggccgaaatacctgactcacaaactccggagtaagttcactttgggtccctctatttgtcacccaatctgatttttgttcctcgatcgcaaaactgggtataataggtcccccaacttacgaaaccgtttaaataaggtccctcggcagtatttgactccggttttagctaaggtggcgcctacatggcaaatttaactcggtctttgtctgatgtggcattgaagtggcgcttacgtgacaaattcgatccaaaaaataagaaaaacctatgagactcacatgtcagtttcacacacactgtaacaagaaaatggtggggtcatcctcactaccccttctctctatccactctctttatcctctctctctccctcttctctctccagccggagggtggggtggagcagtggcggtggtggagcggcggccagagttgagtggggaaggagcggtggcaaccttcaacatagtatgtatttggggtaaaatttgtgtgtgtgctaccttctctcccatgacttcttggatttgggcgacatcgccggagatgctgtgcatcacctcgccggtgctcacctccgtgtcaaagaatccgatctcctgcctcagcaccgccttcaggtactcacgccgcatccgcagcgccgacctcttgccgatgatcctccagcaggtgatctctgcttgcacagagtcagaaactcataattcgattcaagagattcccaagaattgaactttgtcatggttaattcgcaaaaatgctcatcaagataggctcctacgacgagacctgcagcaaggaacgccatgtacacactaatctgcatcaagcaaaaaaaaacgaaaaggagaagatcggatttgtatcaaagctgagaaatcgaagaaggagaaggagacgtgtagctgttcgtggttgtcgcgcgagaaggagacctcgcgggaggcggcggtggcggcggccttagtgtcgctgtaccggcgtcgtggccgtgcgcggagtagacggcggagtcggcaacgacgctgtcgtcgttgctggcgaaggaggtgttgtgttaggcaccacgacgatggcgcggctcgcgtcggtcaccacgctctgcagctccagccgcctgccgccaccggcgacgggtctgtgcgccgacgaggagatgtcgcggtagtgcgggcgggtggaccgcctcgacatgtagtagtccctcgccgtccgccgaaacagcgcggggcggggaggagtgggccaggcacctgatggcgacgacggcggagggcggcggggtggaggagtcggagtgaggaggagccggaaggaggcgatgcgggccggcggttggcgtccgagggaaggaggcagccacacggcggcgccagacctggcacgacgatgggccgggccgaggcaagggcggtggccgcagtggtcgtcgtcgcgctccacccgccgctcgtcgccgctccacccgccgcctgccacctctcagctccgtcgccacccatctgcgccgcccgccgccgctcgctattctcaggggagagagagaggggggagagagggaagaggaagtagagagaggatagagagaggggatagagagaatgggtagtgaggatgataggtggtgtccacgtgggccccatcatttattattattgtgtgtgaaactgatatttgggtcctatagattttattatatttcggatcaaattgccacgtaaacgccacgtcagataaagaccgagccaaattagccacgtatgtgccacctcagctaaaactgggtcaaatacagccaaaggaacttatttaaacggtttcaagttggggacctatcgtacccggttttgtgatcaagggacgaaaatcagactgggtgataaatagagggatgcaaagtgaacttattcccacaaactcctatgcccgagaagctaaacaatcctggcccggcccattacttttgatgggccagtattgcgggcccaaaaaacaggccttatcgtctcgtggaagcaatccgccaatcacgccttccttataaacgcccccgctttgattcctctccatttcgaaatttccgaccgttgctcctccccctttcctttccccacccaacggcatctcgtctccacgcgagggatggcggcggcggcgagggaggcggcggagagcccgaaccctaggtcggcgccgcggcgtgcggcggcggcggcggccaaggacgccagcagcttcctcagcccgcgtttccggtcggcggccgcgcaggccgggtgggacgaggagtcgctcctccacgcggcgctcgtcgtcgaggacacccccgtccgcgagtcccgccgcaggaggcgggcctccaccacctcctcctccgccggcggcggcgggagcgccggatctaacactaggtaggtaacccgatcccgcctctgccttcctcaccttccccttggttggtttcttgtaccttttcttggttccggagaaaacgttgcgttgctccaggaagcggaggtcgtggaggcagccgccgggatcgatcccgccggtggtttttctgctcgacgacgacgagaagaagccggataccacggcaggttggcgattgcttctcgcttgctttgctgatcgatccatttcttgagtgtttcttggtggggtatctcgaattctcgatccgttgttaatttgggggatctgcagatggcaagaaggaggtgaaggaggaagaaaagaagaccgtcgtcgttggggagaaggaggcctgttccgagaaagcagcggcaaccagcgagctgccctgtatggatcgcctccgggaggagctgtcttgtgctgtaagagggatttgctgctttattttatttcgactgatattttgctctcgcatagttgatttgacgttcttggagagtaatttgtctgttggatttttttttccttttttgcagatatgtttggagatctgcttcgagccgagcaccacgccttgcgggcacaggtaattttatactgtactgtttattcgaaaggaagtggcttaaattcagtaaaaaaagtatcatgaaacaaagcattattagcttctgcaatcgaaagggatttggcatagagatgcatgtatgtatctatcaaaaaagcagtgcactgacaatttcaggaattagtatgctttttgctgaattgtgttggtgttttgcatcagaataaggcaaattttatttgcaatctggatttgcagtatagatatcctgcagtttgttgtctgtgagttatgattttgctaatatttggtcattttgcattttattatgtagaacaacattactcatctcactcgataaattgttccgtaaatcatttactcaaatcatatttaccactattcagtcatcaactactaagttcaatatcacttccttgaacttgattaggtcaacacattttagtggaaactggaaaacatgaactggaatcaatttgaacatttccttgttctgcataacttttggaacctcgtaatagttgcccttttcagttttcactagtcagcttctgaaaaatatgcttaaatttcaggaattagtattatcttttctgtttagtgaattattcgtcgtcatttgaatctggactaaagtgaaacatatttctagtccatatttacagttttgagataccttgagttttttgctttgagttcgacaggcatctgcctggaagaaaaatgataactttcatctatcatagctggagtagacagaacagatactaaatatttccttaaatttggaatttaccaccttttacaagtggtactcatcttagttttcatataaccgttcataaattgttaattgaaattctctccccaaattgtatccaatggtaccctggtgtttgattcaggaacaaatgttgtgagtgaaatgttgtttcctgagggaaaattccgttgtcatttacccatttggacctggattaaaacaaatcatatttgtcatctaaagattacagtttagattaccttcaaatccttgctttgtctgtgttgatagtttgtcagctggaatacggtagttaattttcatccattatagctggagtagacaggctggatactaaatatttgtttaaactggaaatttatcatttttacagtactactcttcttagtaatcactacaaccagtcataaattattccatgaaatcatctttatctccgaattatatctaccactacctggttaaatactgttttcaacttgacttacagaacaaatgctttctctctgaattataatgatttctctctgagtttgattgagagaacaaatgtgagagaaatgggagctgtcaaatgttttattattcctttctcaatggtacagaattaccaagctcatatttttgtcactaattttgctgaacagcttctgcatgaaatgcttaaaacatgccgcagctaaatgtggaaaaaggtgtcctaagtgccggcaattaatcaggtaaaaagctctacagttgtgcaatgtcattttctcgtagcatgtatagtaaagaactaaacgaattgtaccctgcagcaattcaagatcttgcacagtcaacacagtgctctggaacaccatccagctgctatttcctagtgaaaccgaggcaaggaggacttcaatcgcttcatcctcggaaaccaacgacgacttggcgcaacaaatctctcaaagaagtaacagcatggcacaaggtggcataagaagcagcagttccaatggcatcggctacatcacgcagcgcagcacaagaagcagcgctaccaacaacaggagcttcacaacaacaggcagcagaagaagcaccttcgtcgcacaggagggcagcagcacagcaacagggagaggctttgtccgggcttcgcagctggtccctagtgccagggtcgtctcagtgagatcacaccagtctgatgacgcggcattggcgtacaggctgcagcaggaggagttcatgacggctttcgagagcgagggcgagaggcagccacctcggagcagcagcagcacggtgtccgctgctcgagcgaatctgagagctatggcctcccgggccattcgtctccgagctcgtggctggcctgtctagttttggttgcctgtttgttctaatcttttctgcttactaattgctgattcttcctcatagtcatagcagaagtgtcgtggggtattctattgagtggacagatgtaatttgctacgaaataatggttcttcgctgtgtcaagtggccatcattcgttggcactcacaaggttcagtttgtgtaacagtcatatggcatgtcaagttaactcaacttgttcagtgttattgttccttgctaattcgaacatagtcggtttagcctgctaatgtgcctgcttagcttttattccgttttgtttttttttcccagtcaaacttctttatatttgaccatgcttatagaaacatttagcaatatttacaatacagaattagttacattaaatactatattgaacttgataatatgtttgttttgtattgaaatattgctattttttctatagtttgatcggaaaaagtcaaaccgacttacaagatgaaacggacattgtacattataagggtaagtgttaaatcttcccttcaactcaacggtggaaccgcgcctgggcttgagacatggaaaatttttgatggtcttatacttagaaattgatcagtaccatgcctcagccctaggcttagggagtgtttagatctagagtataaagttttggtatgtcacatcagatattatatagagtgtcgcatgggtgttcgggcactaataaaaaaactaattatagaatatatcagtaaaccacgaaacgaatttattaagcctaattaatctgttattagcaaatgtttactgtagcaccacattgtcaaataatggagcaattaggcttaaaagattcgtctcgtaaattagtcgtaatatgtgcaattagttatttttagcctatatttaatacttcatgcaggtgttcaaacgttcgatgtgatagggtgattttggggtgagatctaaacaccctcttagactgattatttagactgcttgtttggactagtaagaataaacatatagcctaacaatcctacaaacaaaaccatatgcttcagcgtctcgtcctccaactcctagaaggctagaatcactgtgatatagccgcggcggtgcatccgcttcaagttccaattctcaatgaaactgacttgtttcaaataaactgcaaaagcacgcacaaacgcatcactatacatacgaacaaactagctttatttttattatgttgttgtttttttagaaaaaaaaactgactttactatactaaataatagatatgcttctttccatctatagatgcgctataatttattgggtaaattgtaattgcgataatttattgggtaaattgtaattgcgaggatagaatgtagagaggggttttatggaccttacatcgtacttttggatagctttagtctttagttttgagcgctaggcttagagaaatcctggctctgccactacttctattcgctccatcgaaaagtctaaaacatatttctttttatacaaagaccaatgagcaattaactcattcaccatgtgacaaaaccaatgaatatgtaactactcccttcgtcccacaatataagggattttcagtttttgcttgcaacgtttgaccactcgtcttattcaattttattttgcaaatataaaaaataaaaagttgtgcttaaagtactatagataataaagtaagtcacaaataaattaattaataatttcaaaaaattttaaataagacgagtggtcaaacgttgtaagtaaaaactcaaaatcccttatattataggacggagggagtaataagcactaaaatagtttcttgggttccaatcaataatttaatttagcacattgtgactaaaaaaaaactttttttttaaaaaaaaaccaaagaatgtactcagtcttaaactttttgatggagagagtacctggcaagaagcattgtgtgattaataactactccctccttcctaaattaatcatcatataatagaatccatgatttctcaaatataaccgcatggagacacggatttaatcgaaatacaatttttttagcatgctagggtgtaattggcatagtgtcttaaacgatgcatgcattatgggccggagaatgtgtgcatgctgtcttgattgatgtgatttaaattatgcttagtataggtgtataaatatatatatatatatatatatatatatatatatatatatatatatatatatgatgattaatttgggaaggagggagggagtactgctcaatcatatggttgctatcggcaacaaggaataattaataaattatgctatttgcagtgtcaatgagtttttgct

SEQ ID NO: 59141 - DNA, 3467 bp, Oryza sativa
acttagaatttttcttagcaacaccaagatccttcatctcaaactcactagtcaattgtttcttcaatatagtgatttcttccttgctcttggcagcaatcagcatatcatcaacatataatagtaagtatataggtgatccattaataaatttaatgtatacacaactatcatattcagacctcttgaatccacgtgacaacataaatgaatcaaaccttttataccattgacgaggagactgtttcaaatcatataaggatcttttcaacttgcaaatataatcctccttactaggtattatgaactcttctggctggtccatgtatatctcctcctcaagctctccatgtaaaaatgttgtcttcacatctaactgctcaagctcaagatcatgcatagcaacaatactgaagaatgtacgaattgaactatgctatacaactagagagaacacatcattataatcaacaccaggaatctgactgaggccttttgctattaaccttgccttaaacctccgaagctcactaagagataaaccctcatttcccttgaatatccatttgcaatggatggtcttcttctgttttggcaagcgcacaagctcccatgtgccattcttctcgagagactgcatctcctcctgcatagctgagatcaacttctcacgatcatcagaaacaacagcttcagtatatgcagccggctcatgagtattcacttgttcagcacaactaaaagcataataaaccatatcacattcctcaattagatggactagagctccacaactcctctttgttctgcgatgtgcaataggttgatcttgtggctgcaaaacaggggatgagtgcttgacagtatcatgaacatcattatcaacaatttcaatttcctgatcatccacgtgctccacttgcacgctgacatattggtgctcctcatcaaaaccacctggtataacatctgtggacaagctctcattaaacataacagattcattgaaaacaacactcttgcacatgacaatccttttagtttcaggattccataacttatatccttttactcctaaaccataaccaagaaacagacacttaatagctctatgctctaattttccattatcaacatgagcataagcagtgcagccaaaaactctcaactatgaataatcagcaggtataccagaccatacctcaatgggagttttcttattaagtggggtagaaggtgacttgttgatcaaggcggtgttagtagcctctgcccaaaaacgcttgttcatacgagcgttggacagcatacaacgagccttcgagatgatggttctgttcatgcgctcagccacaccattctgttgcggagtgtacggggtggtgtgatgcctgacgatggtttccttcctgcagtaatcatcaaaagcatccgaacagaatgcaagaaataaggccacacttttctagagtaattatcgataatggtaagcatataacgagcaccaccattagagggcttacgagaaggccccacaaatcagcatgtacataatcaaatatacctttggtgcaatgaactgaggtattaaattttaccctcttgtgcttaccaaaaacatagtgctcacataacttcatgttaccctgagtacagctatccagcaggttcctcttcatcaattctaccataccaagttcactcatatgtccaagacgcatatgccacatgttagtcttactaggttcatcattagaaacagtggtagcggtaacagaaccatgcaatgtacttcctctaaggacatataactttgcagaattcagatcacctatcatataaacgagagagccttttgatacctttacaactccacctgaactggagtatttgtatccttctgcatcaaatgtgctgagagagatgagatttctcaccatccttggtatgtgtctcatatctttcagcgtacgtgtcatgccatcatgcgtcttgatctgaacagagccaatgcccacgatctcacgtgggttatcatctcccatacgcacgacatctccattctgcacaaacttgtaagaactgaaccaatctctgttaatgcagatatgaaacaaacatgcggtatcaaatatccattcatcatgaccagcaacacaaccagcaaaaacaataagacagtctcctgaatcagagttttcagcaccgagacgacagaggccttaccattggatttccttttctccttattctacagcttccaacattcttcaatgaagtgatctttctccttgcaatacttatagaacttcttacctctggacttcaaacaatctccaccggttctggctcttgccacgatcgttgctgttgttgtaggttctttgctctgacctgcaatgcttcgcccttggaggatgacacgtcagactaaaccatacctttcatcttctccctgttctggagtgcctcataaacttccaaaaggattagttcttcacggcttaatagtatggtgtcacggaaatttgcatacgaactaggaagtgagcataacaatagaagacctaaatctttatcatgaaactgtacctcgatcgacactaggttggcaacgatctccttgaagactgatatgtggttcaacatagaaccagtttcctgcaacttgtgcgagaacaacttcattttcatatgaattttactggttagatccttagacatgcagatcaataccagtttgagccaaagttctgcagcagtttgttcctgcaacacttttgacaaaatatcattagatagatgaaattgaatcagtaatagagccttacgatctttcctcttctcctcagcggtccattcatccttcttctttttcccgaagctttccagcgcctcatcaagatccgaagattgcgttagaacagcctgtgtcgtaacttgctacagcgagaatctcgtcttttagtctagcagcagtagatcatacttcatcgatgccatcccggaaccctaatgtgagaacaaactctgataccacttgttaggaaatgataggaaaacaaacaataaagaacaatagatcaatcatagaaaacacgagatttaacgtgaaaaacccttccaaagcaggagagaaaaaactatgaacaccagccagcaaaatatcttcactatatcggggtgaggttacaatgccgaacggcggcttacgagaagtgtgttatatatatatatatatatatatatatatatatatatatatatatatatatatatatatatatatatatgaaggtgaaatcctaaaaggataaagatccgtaccgtgacccccctagacgtcccgggccttcgcttcgctccgtccaaaactagcctttatatgtgcgcaaatgaatttggatcacaactcaacaacggcgacatgtggaacaggagaataaatcttcatttccaatctagaa

SEQ ID NO: 59142 - DNA, 17212 bp, Oryza sativa
cattaaatatatattaaaagaaaaactaattgcacagttagagagaaaatcgcgagacgaatcttttcagtctaattagtctataattagccataagtgctacagtaactcacatgtgctaatagcggattaattaggctcaaaagattcgtctcgtcgtttctaggcgagttatgaaattagttttttcattcgtgtccgaaaacctctttcaacatccggttaaatatccgatgtgacacccaaaaattttaatttcacgaactacaggccctatatttcttctctgaagaagaagtttcagacgatgggttcaaatcgcttttaagaccaggaagtacagcggcgccagtctagatccaaaacttttcttcaaatttctaattttttcatcacatcaaaacttttctatacacaaatttccaacttttcaactaaacttttaattttgacgtgatctaaacgcacccatactgtaagcagcgtgaaccactgaactggcgctacgctacatctctgaaagtccaacgtttgtaaaatcattgacgctgtccaggaatttttccatttgaccgtcaccatttttcccttgaagaatcatgttgtccggtgcatatgaaatttttggagatattatattttttgaagtataaatttagttttttttcttttggatttattttttctttttttctttttttgccatgtggggggtggttagtccaagttacccaacatgtggctctgtccctctttccaatactacaaaagaaacacgagcttttctccgctacatgaagacgtccgatcaaaggggaaaagtactttttcggcaaaatttatagtattaagctaaagtttggcggtcattaatcataacaaaaagaaccataaattaatctctaaagtttaaaattcgatatagcttacaagttacaagagaaatacgccacttattgacttcttttattcattaggcaccatatcctgtacttttacatcgaaatcacacaggcttgcttctctgcttagtcacaatattaccagctccagcctccaggttacttagcaagcacaaaactttaacccttattattatcccaaaacataataaaaataataaaaatctatctatcgctaatcattacttaatttaacttaaacctcactaagctcctctcccttaaactcgtacgcgtcgctcttcctgacggcgacgaagagcggctccttcttcctcgtggcgaggccgaacgtctcgtcgaggttgacgtcctcggcgcgcacgccggcgggcagcgcccactcgaagtggtagagcaagctggcgagcgacacctgcacggtggcgagcgcgaacgtgtagccggggcaccctcgccgcccgccgccgaacggcagcagcttgtagtccgggtccttgaggtcgatctcgccgccgccgccggcgctctcgaacctctccggcgagtactccagcgggttgtcccagatctccgggtcgcgccccatggcgaacgtgttgatgaacacccgcgtcctcgccgggatgtcgtagccgcccagcgtgcacggcgcgacggactcgcgcggcactagcaacggcaccgccgggtgcagccggaacgtctccttgatgatggcgcgcatgtagtggagctcgccgaggtgggactcctcgacgcggccgctgtcgccgacgactcgccggacctcctcctgcgccttcttgaggatccgtgggtggcggactagctccgtcatcacccactccagcgtcgcgaacgtggtgtccgtgccggcgacgaacatgtcctggtggttgttgtcacgtcatgtcaagatcagaggaggagcaacaatggcggcgagtcaattcgagagttttaatggtgggtattaatggcgtaccaggacgagggccttgagattgtcgtcggttagggggacctcgaggtcgggggatttctggacgcggaggaggacgtcgacgaagtcctcgtcgcggtcgccggggatgcgctggcggttgccgctgatgtgttcgtccacgatcacgtcgcaggcctcgcggaggtcggcgaggcacttcttgaggcggcggcggagtccggtgacggtgctggcgacgggctcgagctcggggaagaagtcgccgatggtgaacccggcgaagaggtcctgcgcctcggcgagcaccgcgccgagcttgtcgccctcgccgtgcgggaaccggcggccgaacgcgacgcggcagagcacgtcgttggcgaggttgaggaagcactcgctgaggtcgacgggcttcgccggcgaggtgttcttggtgaggtgcgcgagcaggcggcggagctccttgaccctgacggcgccgtacgtggcgacgcgacgcgccgacaggagctccgacaccaccacgcggcgcgccatccggtggtacggccccgccggcgcgaacgtcacgtcggagcagccgaacgacaggaactggccggagagcaggtgcggccgcgacgccagcgcggcgtcgttggtggtgagcgcggcgcgggcgaggtccggcttggagatcaccaccgccggcacgctccccagccgcatccggaacagcggcgcgcgcatggtgcgcgccagctcggccagcgcgtggtgcggcatgccggacatgaggtggaggtgcccgatcaccggccaccccggcggcgacggcggcagccgccgtggctttgacgacgacgaccggctcctcctcaacgcgaccaacacgtacgccgcggagagcacgagcagcgcgagcgacatcgtcgacgccatggtgagctccatatcgtcgaacacttggggtgcacgtttggtccaagaaacttaagcagcaatggagatgtgttggtatgaactaaccgtggttaagtggggaagggtttatatagtgggtggttggttggaggagaggtagatgcacacgttgggcactgaagattttcattagatttatcacatgagttgaagagatcaacgttatctgagatcaaggtgtggaatgcgacagatagtgtatacttgtgtagtactctaactagtaagatggatgttgaaacagcgaattaatgtggaattaattgcatcaaattatttatgcatagactactgtagacagaaatatataatcatcatgcatgattgcattagttgctaccatccaagataaggaaattaatattgacggcatgaacagtaatgtgatagaaagatggcacgtgtgaagtgcgtatcgaccaagcacgctcctcctatactcctgtgtctagttcgcgaaaagaatttttttaatgtcacatgggacgtttgaccggatatcggaagaggttttcgaatacgaatgaaaaaaataatttcataatttgtctggaaatcacgagataaatttattaaacttaattaatctatcattagcacacgtgagttaatgtagagatccaaaagcccaaactgattaatgaagcaattcaaagccctaatttctgaagtttaaaattggttgccacggctcagtcaagcatgccccaactaccaaccagagaggtctgacctctatattttatactttatatgttctccctttgttttatactataagccgttcttttctaaacaaccgtagttaggtttcactgaatttataaaaaaaattaacaacttccacaacaccaaattatttcttttaaatataaaattgaatatatattttgataatatgttcgttttacgttgaaaatgttactatatttttctataaaaaattatcaaacttaaaaagtttagctagagaaaaaaatcaaaacaacttacaatattaaacgaagggagtataatatgcccactttacagtcacagatgttacatataaagcacaaaggctttgtttagatcccaaacaattttggccaaaaacattacattaaatgtttggacacatgcatgaggcattaaatgtggggaaaaaaccaattgcacaatttgcatgtaaattacgaaacgaatctttcgagcctaattacgccatgatttgatatgatgctaccgtaaatatttgctaatgacggattaattaggtttaataaatttgtcttgcagtttacaagcgaaatctgcaatttttttttgttattagtatatgtttaatacttcaaatgtgcgtccgtatactttaaaaactttacacccaaagaactaaccacacccaaaagaaataaaaatcatgcacagatgtcatttgagaggaatatataatgtgcccgctgcactttgacttagtgaaacggacaaatggacaatactgcagaaaagtcaacccccataagggctgtgcttagttcacactaaaataaaattgaaagtttggttaaaattagaacgatgtgacggaaaagttgaaagtttatgtgtgtagaaaagttttaatgtgatagaaaagttaaaagtttgaagaatctaaacacggtgaaggttcaacaatctacccagaagccagatccggagtcagaaaatttggttttccattattttattaaaaaagtagagaagagttttgcctttcaaatatcaccagcaaataggtacaacgggagtagaacgtttgcagtatgaaatgcgcaccgggtggagatatttcatcatttgtgttaattagcattttgaaaactaaccttacttaaaaaacataatagaacttaaatacatgcatgagtgccgtacattaatatggaaaacaaaaataatttgacatgttgaacattcttgatataattaagggttaattggattggtgccaatataactttaacggttttcaaatacatcgttactatttaacaatttgtaatcatgccattataatttccctattatttgatatatgtcattacgtaccctttagaccattctacaattttttttggactaaaatgccctcgtcttcctcctccaccctcctttctaaacttcatcccttctcccctttcttctactggctgcagctcagcttctctcctccatctctccatctcctccatccctctccagtctctccaagcttgaaaaacgtgtggcactcgcagcgtcgccgctaattcatgtgcacgcgctgtgacttaagagcatggaaggaggtgtcgggaaggccaatgttatcaaatgacaacagcgttcagatgtactgtgtgcgtggaagctgaatcacttggacttcggtggcactgcatgcacgagttaagttcgctgcccccgaagtagcagccactttgaatacaccatgaaaagacaaacatttaaataccacaagttcagtggtacggaaccatatttgaattccatgtggcatatatgtcacatcaatattacgtaagattatgaagggatccctgcaatcttggatcgaaatgacacactttatattggtggagaaatcatctttgatcggtctggcaaaatccactttatacaagattgtttttagtcccagttataaaaattttgatctttagtcccggttggtaatctttagtcccggttcatcccctgtcaaatatatgtcagggggccgaggatctttagtcccggttggtgtcaataaccgaaactaaagatcaccactttagtcactgttggtattaccaaccgggatgatctttagtcccggttgataaattgaacacgtatatataatccctatcacttatcctctcctccacagttacaacttaggcagatcgaatctcgccccctctcctcagatctatcctctctaactctcttcctcatcccctttcctccaactcctccccttcctcctccccttcccatccggcgggcggcggctagcgcggcgggaggtggggcgaaggccggcggggccgcgcccagcggtcgtggcgagcggcggcagtggcattgttttttctttttttaaaaaaaaaattgtgattcactaagatgtacaaatttatgattcattgtttggatttgtgatgtatttgagtattttttaggatattgtgatgtatttgatttgtgtgtataagtaactttatgatttgtgatgtggatttggtgatgtgaatttgggacgttactttgatttggggattgatttggggatttgcctaattgattcgcgagaaaataaaaagaaaaaaagaaaaaaaaaggggaccatctggtaccgccgctattatctctttagtcccggttggtaacattaactgggactaaaagatcctctctctttagtagaactaaagatccctattatttcaaccgggactaaaaatagacatctttagttccggatccttactcccggttgaaaaaccgggactaaagaagggtttccaaccgagagtaaagatagtttctccaccagtgttaagaagtttaaatagctgtatctataagagttttagaaactaaatgacatggcctcaactttagatagctagcgtacttcactcataatatattcgcagtatatcaataaatataaaacaacatcgtacgttgtattcgatcaggaggagcactgaagtacagtgacgaatccaacatgaggcaggtgtgcttgagcccccgctacatactgttcaattcttccggataaataagttgttagggaagaaaaggataaataaatacaagatcactattaatttcataaagatgcttatatgtaaatattagatttattttatatttagtcaacttggaatatatttagtcaatgccattcttctccggaggaaaagatgccgcataatgtgtaccctaaaatttagttctacgtttgccgatgctgaagtacggtgtacgagactacataaacaacatcgttgaagtatactccctccgtccaaaaaaaacaaaccctaaatttccgtgtccaacgtttgaccgtccgtattatttgaaaaaaatataaaaaaaattaaaaagataagtcacgcataaagtattaatcatattttatcatctaacaacaatgaaaatactaattataaaaaaatttcatatagaacggacagtcaaacgttggatacagaaacccaggtttctcttttttttttggatagagagagtaaacttgaattgcactagaatataatcattcatcaataaattaagctcatgtacattttttttatctttttagagaagggtaatttttacccggcctccacatccaactggatatatacggccattgaaatagagaacttagcaccgtaaacaacccaatctaaaattcgctcctacgaagatttgaactcagaactttaaggtactactcggataactgcaaccactgtctctcgtaagctcatgtacatacatgtatgaaatagcttaaaagttaaaaagatgaaaagaacagaagttgcgccgttcgttcactggatcccccaaacagtcaaacgtcgggaaggacatgcgacgtgttcctcttacgacgtgttcggttcataggccgttcctcttacgacgtgttcggttcatgcctgcgagactttcgtcggttaatccctcctctaagaaaatcaacaggatttatcttgtttctattatatgtggaattaatcccttcaattcgcttatattagagattaaccgaccaaagaatgagcaaactaattaaaggattaactaaataaactttagtgaggttaatttggcagtagcatgcaggtccgggaggtcagccacggaatccaaggtgccgcggcgcccatcgatttcgattctattcgatttgaccgggacaacccgatactactctctccgtctcgaaaaaaacaaattctaagtttccgtgtccaatatttaactatccatcttatgttaatctttttataattagtattttaattgttattagatgataaaacataattaatattttatgcgtgacttatctttttattttttttaatgattttttaaaataaaacggacggtcaaacgttggatatggaaactaaaggtttgtcttttttttttttacgggggagtacgcttcaaactactgtagtatctaccaacctagcggtgagcttagccaacgccggggtttttttgagaacagccaacgccggggttgaccaggcgtttcctggcttggctgctcgctcgctcgctcgacgacgatgacctacatgaccgaccaatcgcgcacggcgtcgatccggccgcacaggcttacgtatacacacgcatattcggaaaaagcggttggaaagggtgacatgtcgtaatcgctacggtgggcacacgcacgctcgtgcccatttcctgaatttcaggcatctaaatatttataaattttcagtcacctagaaactactctctccgtttcatattatatgtcggtaagcttttttcttagttacaattctttagatttgacgaaatttatatagaaaaaaagttagcaaaatttacatcaccaaattagtttaattaaattgaacattaaatatgttttgataatatgtttattttgtgttgaaaatattagtatatttttctataaatttgatcatacttttaaggtggtgtttgaatctcctgaagataaatatcaagataaagattaagtgtttcacgcaaaacgagttggtaataacgtgtgcttaattgagttttagttattacaaacttgaaaaatagattaatctaatattttagaataacttttatatagaaagttttcgcacgaaacgcaccgtttagcagtttgaaaagcgtgccatgaaaatccaaaacttcatccggtatttctagtgaaaacgaatggggcctaagtttgactaagaaaaaaccaaacaacttataatatgaaatagaggaagtacatggtattaaaatttcatatcaactgaaaaaattggtacagtgggagtggtgatttgtaacgattgggacagtgccatatattttatcgtgccgagcgtgccgatgtgctgctaatctgaactaaatctttagttacggttattttacgtgggactaaagatagccatatttaattttagattcatggtcctggtttgcaacccggaactttacgagagttgcaaaccgggacggtttctccaccagtgagacccggtgggggaatttgggatcactaaactgatgattaaaactgattcactgaaggtgacaaatatgtgcctcaaatagaattcgataaatgatttaggacgtgaaaacaatactaaatggattcccataatcaaaggtggtgtggactcggcgctcgccgaataaagttagtcatatgttagctgaagaagatgtttttgtagaggtgttttatgacatgggtttcggtttctccggaattcatttattaatgtttggcagatgactgtaagcccgatatacatgttaatagagctaggcccgatttattatattaaatctcaaaggcccataataaatgttaagaataataatgccacctcaggaattaaacgaggagtatctcaacttaaatagggagttattggaggctccctgttgaccggttgaggtggaaatcggaaagccacacgcgcgccggggcgagggcgtggcgtgcgttgtgtctgcctgcctctatcctttttgcaacgaccgatcccacgattgcctccgtaacggccaggcgattcaattccaattatcgcgtcggtcgatatcagtcctgcgatataaggaaaccgctaatccgatcagatctctctcgcttgctttccatctctggtgttcttcctcctccgcgcgcctgtgctgcctctgttctacctccccgcttctgatcgtttgcgcgcacgagagatcggaacgagcagggcctccggaaccacaccttcgcctgagatctgcaccggataggcgggtgatcaggtttttggggagtgcttccgccgccgccgtcgccgtccctggagccgctgccgccgtccctggagatggcgcgccaggagccggagccgctacaaacgtcaacgtcaacgaaggcagttctgcctcacaatccagcggagggacattctcggggtatatctttctcctactgttaactcattctttgatacctctgttagtcgtgttagtcgcaattctattgcgtttttggtatgttcatgatgcttattataccttaaacatgctcctggttatatttgattttatcactagatcaccccacattgttcatgccatgattattgtcttaatattttggattaaaatatgccgatatatgactatatttccaacaatccaaaaacctgataggtcattttcggtagttggctttgctgctgcactaaaatcatatgcatttgatggttctaactataagaggtggaaagcacgtacactattgtggttgacagcgatgcaatgcttctatgtttcacggggtaaacgaagtgaaccacctctctctcctgaggaagaggttaagttcgaggcttcggattgcctgttccgtggagcattgatcagtgtactggctgacaacatagtggacgtgtacatgcacatgccttccgggaaggacatgtgggatgcacttgaggccaagttcggagtttccgacgccggcagtgagttgtatgtcatggagcagttctatgactacaagatggtcgatgaccgttctgtagtagaacaagctcatgagattcagatgctggctaaggagcttgagaacaacaactgtgagttgtcggacaagtttgtgtcaggtggcattattgccaaattgccaccttcttggtcggactttgccacttctctaaagcacaagagacaagagttcagtgtttctgatcttattgggtctttgggtgttgaagagaaggcgagggcaaaggacaaccggggcaaaaaggttgagggaggttctagtgccaatatggtacagaagaagaaccctcatgcatcccacaacaacaagaaagtcaagcctgatgtcaaacccaaggctacaaccaattttaagaaaaaaggcaagggaaaggcaaagggagactgctttgtgtgtggcaagtctgggcattgggccaaggattgtcctaaacgcaaagacagaaagtctgccaacatggtcattagtgagagcggaggaacatcggcgtacggtaaaatattacctatagttctctctgtttttcattcacctgattggtgggttgatactggtgctaatattcatgtatgtgctgacatttctctgttttcttcttatcaggtcgggagaggttcctccttgttgatgggaaacaggtcgcttgcggctgttcatggtgttggtacggtcgatctgaagtttacttcgggaaagaccgtgcagctgaagaacgtgtagcttgtcccttcaatcaagaagaatcttgttagcggctctctattgtgtagagaaggttttagacttgtgtttgaatccaataaatgtgtcgtatctaaatatggaacttttgttagaaaaggttatgacagcggaggcttgttccgcttttctttggataacatgtgtaataatcataattttgtgaaccatattagcgacaatgatgagtctaatgtgtggcattcgcaactttgttatgtgaatttcagttgtatgacgcgcttatttaacatgagtttaattccaaaattcactttagtcaaaggttctaagtgccatacttgtgttcaatcgaaacaacctcgcaagcctcacaaggcatctgaggcgaggaatttggcacctctagaacttgttcattccgatttgtacgaaatgaacagcgtgttgactaaagggggaaagaaatatttcatgacactgattgatgattgcactagattttgttatgtgtatctattgaaaacaaaggatgaagcattgcattactttaagacctataaagctgaggtagaaaccaacttgaaaggaaaatcaaacggttgagatctgatagaggtggggagtatttttccaatgaatttgcatccttttgcaaagagtttggaattattcatgagaggacgcctccctattcaccccaatcaaatggggtggctgaaagaaagaaccgtactctaactgagatggtgaatgccatgttagacactgcggggctttccaaggaatggtggggtgaggcagttttgactgcatgtcatgtcctgaataaaattccaatgaagcataaggaagtgacaccattcgaggagtgggaaaggaagaaattaaatctctcatacctacgaacatggggctgtttggccaaggtaagtgtacctatagccaaaaagcgaaaacttggaccaaatactgttgattgtgtgttccttggttatgctattcatagtgtgggttatagatttttaatagtaaactctggagtacccgacatgcgtgttggtacaattattgagtccagagatgctacattctttgagaatgaatttcccatgaaacatacacctagcacttctagtcaagaaattgtcataccccatgagcattttgcaccgatagaacacaatgatcaaacgcctgagggaaatcctaaggaggacaacattgtagatactcgtaagagtaagagacaaaggtttgcaaaatcctttggagatgactacattgtatacctcgtggatgacaccccaagaaccatagaagaggcatattcgtctcctgacgctgactactggaaggaagcagtacgcagtgagatggactcgattatgtctaatggtacttgggaagtcgttgagtgtccatatgggtgcaaacctgaaggatgcaaatgggttttcaagaaaaagcttaggcctgatggtacaattgaaaagtacaaggcaaggcttgtggccaagggtcatacccaaaaggaaggcggggattttttcgacacatactcaccagttgctcgcttgaccacgattcgattagtacttgctctggcaacctctcatggtcttctggtccataagatggacgttaaaacagctttcctaaacggagagctggagaagaagatctatatggatcaaccagacgggtatgtactagaaggtcaggagggaatggtgtgtaaactgttgaaatccttgtatggccttaagaaagcacctaagcaatggcatgagaagtttgacaccacacttacatctgctggctttggtgtgagcgaagctgacaaatgtgtgtactatcgctatggtgggggagaggcagtgatcttgtgcttatatgtcgatgacatattgatctttggaaatagcctcaatgtgattgaggaggttaaggactttctgtccaagggttttgaaatgaaggatttgggagaggctaatgttatccttaacattaagctactaagaggagctgagggtgggattacacttgtgcaatcccactatgtggacatggttttgagtcgctttggatatagtgactgcaagccagctcttactccttatgatcccagcgtgctattaaggaaaaaccgaagaatagcaagggatcaactgagatactctcaaatcattggtacattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatgaaattcactataccgggtaccaaaagtactagaagggtatagtgactcaaactggatatctgatgctgatgagataaaagccacaagtggatatgtgttcacacttggaggtggcgttgtttcctgtaagttttgcaagcagaccatcttaacaaggtcaacaatggaagcagaacttacagcactagatactgctacagttgaggccgagtggcttcgtgaactcctaatggatttgctggtggttcaaaaaccagtgccagctatcctaatgaactgtgataatcaaacagtgattattaaagtgaacagttcaaaggacaacatgaagtcatctaggcatatcaagagaagactgaaatctgtcagaaagcagaaaaactccggagtgatatcattggactatgtccaaacggctaaaaatctggcaggttagtttatcaaggggctaccacataatgtgttagacagtgcatcgagggaaatgggcttgatacccacctaaggttgcacaatagtggaaacctgtccattgtgatcggagatcccgtgaatttggatggtgaaataaactattgtgtgaatgagagaagagacccttgaaaatggctcattttcatgatgtacttctcttcttttctgcatggtaggatggctgatgccttaatgtgatccgagtggcttttctaagcagagatgttgacctgcagaacatctcaaaaggaacacacctatatgagtttgactgctagtcacagtctatgagatttgggcgatctctagatactcatgaaaaggcctgtagtttgacttatatgctccaaacagaggggatgcgaacggcagcccagtaccagtcaagggtttgagtgaaacctaatcacacaagactgataattcaaggcatagtccattgttcagttgtggtttgatgtagctcatttcctaggtggaagttcaacttaacagtctccaccaaaacactggtatatcaaacagtcacaaccttgagaacatttcttgtgagccttgaaacttggtggggattgttagaataattgggctaggcccgatttattctattaaatctcaaaggcccataataaatattaaggataataataccaccacaggaattaaacgaggagtatctcaacttaaatagggagttattggaggctccctgttgaccggatgaggtaggaatcggaaagccacacgcgcgcgttaaggttgtcacgaccggaaataacccaacgggcgttccttacgtgcgtgcattattccttgttccaggaggcaaggtacaccaaaagttgatacagttcagagtttaacaagcggaagcgtaaatagttaatttattacatgggcggcgaaggcccagcacacacaaagacaaacgggaaacagtggaagactagggcgacgaccacaggcgcttgacggtaggcacgagctagacaccaaagccttcatcttccaggggctcctcttctgggtttgggaaaaaattgagcaagactgagtacaaccaccgtactcaacaagacacacccacaagtgcagcataaatgtaagggagtacaagggagttataatataaaggattagggtttgcagtaaacagcattaaaagacacttagttgctcaaagctattttgcaaacacgattctagagctatacaatattattaatcaaggccgtgaacccacacgaacctgccttaacccaaggcctacgatgattcagaccgaactggcaacccgaccctgagtcccagctcgtcccaagccaacccaggccaaccattccacattttagttgttaagcatgttttaagaattaaaacactaacttgggtacattgctcggctttcccataaccgaaggcgcggctattcgaatagattatactctgatcagaggtgtacatctttacccacaagacacatcttcctcacgtgtaactacgtgccacataccaccacggtatacggccggaagatgtgacatagtttccaacccatcctagccatagacaagagtaccaacccaatcccacctacggccggaaaccccgggacaggtaggcaggactgagcccctagcagcaggacaccggccctgtgccatgacatctcgactaccgggccgcagcttgtgtagccttcatttgtcctagagatgtccatcgacccccgacttcgtccatctctatccgtgtacttttgtttataaccagactgagccacaaactaagccttacccactagacttgtggaagtacggtagtgctttgcaacagaggcccgaagaccggtccttatatggccgaggtgctactatcaaaaccatacaccccgagcccagcctaaaaccatttggaggattttgaatagagggggaggtgtgaatccaattccacaataatccaaccattccatagtgtccaggtgataagaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataataaaggtacataggcatggctagataaaatagtgataacgcgggaatttaaataaagcgataatgcaataatttaaatcaaaataattttataaactgggattcaatatgttcaaggatgatgtgacttgccttactcgctttcccaaacatcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgcgtcagccgaggggagggggcgcgcggaccgggtccacgggagtggggcccacgcagcagcctcacggtccacggtggactgggcgcactcgggctcgcaccggccagcgccgtgggtcccacgcgtcagccgcacctaagggcgcgggcggctgatggccgggccccacgcggcagccactcggtgcgcccgagggcagccaagccggcgcagccggcgggaggcggcgcccgcgcccctatggtcgccggcggtggccataggcacggcggagcggtggccgagagaggggaagggaagagggaaaagaggcggcggtccacggctcaccctaggtcgacggcgacgacgaaaaaggcggccggagcgaaggaaggcggcggcgcggctcgggtcgacggggtcgacgga

SEQ ID NO: 59143 - DNA, 8431 bp, Oryza sativa
cggcggcggaccggagctcgacgacgacggcggagagagagagagagcgatggcgcgagcttgattccggcgaggaggaagggcggcgagaggcggaaacggacggaggaggtgcggggagggtttaaatagagccgggacgagagagggcggccggggaaggaaggaaaccggcgcgggaggtcggccgccatcaatggcgccggcgagatttgcgggggcaaatctgcccgtttgaacgcgggagagagagggaaaaatggggggaaagggagaggggatcacggggagtgattttcccctctttattgcacgcggggacggcgggattcgcggcggcggtggcgctagggcgcgggcgaggcggcgggagcggcgggaggaaggggatgacgggtgggccccacccatcagcgagggtggcgggcgggcccgcccgtcagcggcgcgcgcgcggggagaggccggatgggccgcggggagaggagagggagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatccttcaagccttatttgacttttaactttgcacattttaattgttggaggctttcacacggattttaattattctaggtataatttagaggatgtattttagagtcgttttgagacgcgacaaaggtgggcatgggcgagggcgtggtgtgcgtgcgtgcgttgcgtctgcctgcctctatcctttttgcaacggaccgatcccatgatcccacgattgcctccgtaacggccaggcgattcaattccaattatcgcgtcgttactatggcaactggcggatatcactcctacgatataaggaaaccgctaatctgatcagatctctctcgcttgctttctatctctggtgttcttcctcctccgcgcgcctgctatgatataaggaaaccgctaatccgatcagatctctctcgcttgcattccatctctggtgttcttcctcctccgcgcgcctgtgctgcctctgttctgcctccctgcttctgatcgcttgtgtgcatgagagatcggaacgagcagggcctccggaaccacaccttcgcctgagatctgcaccgggtaggtgggtgatcaggtttttggagagtgcttccgcacgactgctctcgacttctgctctattcgtcgtcgtctcgtcatccaccatgtttgcaactggagccgccgccgccgccgccgccgctgccgccgtccctggagatggcgcgccgggagtcggagccactgcaaatgtcaacgtcaacggaggcagttctgcctcataatccagcggagggacattctcggggtatatctttctcctactgttaactcattctctgatacatctgttagtcgtgttagtcgcaattctgttacgttcttggtatgttcatgatgcttattatacattaagcatgctcctggttatatttgattttatcactagatcacccccacattgttcatgccataattattgtcttaatattttagattaaaatatgtcgatataagactatatttacaacaatacatcaatctgttatatactaaagtccattaaaaatcgtacaaatgttcctgtgacatcttatggtactactacaaacgatctaaaccatcatgtgacgttctaatctctatctctactattataaaaattcaaggtgtttttttcaaggatttttagtacgtcactaggagatcatgtcggacacagttatcgtaaacttcagacgttcccatttctttccgttttttcgtctgttggaatcgctcgcgtcggatgtgagaatcatggagcgaaggagacaacccggctgctcacgaagatacaataaagtggcgagcccacaggccccagcccaccaccgcacggcccctctaggtgatgagcgtgtacaggtaggcattgaggcttacagccggccagcgatattcaacggagaggtgaatcaatctactcatttatccttcttcgatccattgtgccttgggttgtgtttgtatgctcggtgtagataccatacttctgcagacctggctaccagttccagcccatcttaaattcaggaagttgttgcggtgcatatctatatatctatatacctaataaaaatacgcaatgactccggtgaaaattttcgtccgtcctcacctaaattttttttcgttcgtaacatctgagttcaagaaacaaaatcatctagagtctgcgtcaaataacacaaaaaaattaaatcaattcgtgttacatcccaaatacatgaattgaaaaatggcaaacgaaggaaaaaaacaatcgaacaaaaatctagccaccggacctcaccggaaacacgagtggtacgagtttgccaccgtggagctcgaagccaccgtcgtcgccttcgagctactgccactgcctcccaaggccagatccggtgaggaggaggcacggagtggccgccggtggtggcttggttgagttgtcactgccgcccgccaccgtctcccaaggttagatccggtgagcctcaagcctgatttggcgaggagcgggtagcgttggcaccctgacgaggaggaaaggggctaattgtggggagagggagagcgccggtgaggggagggcgagggggagcagtgccgcccgtgaggaaaggggagggagggggagaggcgccgccagtggagagagacggcccacggcatagagagagcggtgacgccattgggattagggttttggcgattcctgggcgaccgggagacgccggcgatatcccacattgtgggatggcttaggatggagttcttctccgatccggttacgtcgtttgcagggttttcgcctgccttgtttaacatcatggaggggtttttgtctcgggatcttacgtccttgggacaggtgattggttctcgactcggaggccagttcaagaaaattagtttttgctacgataacttaaggttggtaagtttttttcacatctatgatccatacatatcccctatcagactccgtttcagggatgttaggatccggaaggggaagaagtgccatgttcaatctaatctgttggagtctgtctcggtcaaggactctgtcgttcagtgctataaattggagagcctagggcaaggatctgcaccctgtacaagttccctgaagacaatcttgcaaagccgcaattccaatctgcgtctctcctgcttgtttggtgttctcatggcgtagtctgccggtgggggtgataaagggatcatcactgcgatggttgcccacccgaagccggccgggggaggtgagatcgtcatggcgaatcaaagggaggaggttctgaataaaggtactttagcaatcggggtagcaacaccagatgaaaaccaaaccacgatggaaggtgcgggtactgctgttgaggtggacagtacgactcatcaggggccagcagctttcattgagggggaggttgtggaggaggatgaggacgcaatcgaagtggttatagaggaagaggaagtgcagaaggctggccaatggactatattagcaagattctattccttgaagtctccaaatcttgccgctctctttgaagacatgcgtcgtgcttggcggctgcgatcagacatgacttacaaatcgctgagggataacttgtttatcatatcttttggtgctgagggggattataggtttgttatccaaggtggtccatggattcataggggggatgccctgttggtggcagagtttgatggcatcacctgtccgtcaaaggttactttggatgtgattccagtatgggtgcggatttatgatcttccactggtgctaatgacaaaggcaaggggtgagatatatggtagcaaactgggcagagtacgggaggtggatgttggggacgatggccgcaataaacatgacttcttccgtattcgtgctgatctctcagtcaagcgaccactaaaggataagttaaccatcaaaatctctgcacaaggtagagtggaaacaagaagttttgcacttcgatatgaaagagtgccacacttctgtttcatatgtggcttcatggggcatgctgataaggactgcgataagagaggtgcaaatgtggagaatccctttcgcttttcagctgatttgagatgctcacccttaaaaccgtttgagcgaaaagttaacaaggtcagagcaatgcagaacactggagcagctcgcaatctgttcttccgtggagctggaagtgctggctcatcgtcctcaaagcagagagatgtggaacagtgggatgaagccattccacccagagtggatgctcatgataattttgatgacaaggagaaggagggggatagttcagtagatgagcaattggctctgcaagccaatctgatgaatatggcagggacagaagggatagacaaagagcatgatgatagtcaaggtccgaagttaaagagtgggtctaatgttgtggccctggctggatcaacaggggaggccataccctcaaaagagatgattcatgctattgcaaatcttcagcaacaagcctcctttggggatgggtcgtcagatgactggagtggcgggaataggaagagaacgcaagacacgacagaaattaacaagccggggcgggtccagcaagcgctggtaatataccagagtgcaacggtgaaggatgcggcggatagtagagaagccggcaaggacacaagagcgctgaagcgttccaggaagacggaaggaggttcggaggtgtctaattcggaggcaaccagccatggggccgctggtaaactgacaggacctatgatagggtctcgtcaggagcaatgaattgcttggcatggaattgtcgtggtattgggaatgccacgacagttcgtgatctcattgccttggtgaaagaggcaaattcccaggtggttttcctcagtgaaacgagacagaagattgaaagaatccgcagacttcgttctagattaggtttaaaaggttttgttggatgtaatagtgatggtttgagtggtggtcttgctctcttttggcatgagtctatctttatggatgttaagagtgtgaatgaaagatatgttgatgcgtatatgcgtttgtctccggaagatcctctatgtcatgtaacctttgtgtacggagaaccgagagtggagaatagacatcgtttatggtctcggctcctggatctcaaacagtcctcccccctcccttggatgattattggagatttcaatgagactctttggcaatttgaacatttttctgtttctaaaagaggtgaggctcagatgagagctttccgagatgtgttacaaatatgtgagctggttgacttgggcttctcaggggtcccctatacttatgataaccgaagagaaggtagatcaaatgttaaggtgcgtctagatagagcactagctgataatagttggagagacatctatagtaattcccaggttgtgcatctaacctcgtcctgttctgatcactgtccaattctcctgaagtttgctgcggacagtagacagtctaaccgaaagaagtgtttccactatgagatttgctgggagcgtgagccggcctccactgaggtgatttctttggcctgggctgaagtaggagaaaaaagaaccttaggggacattaattttaccctcggaaaggtaatgggagcacttcaggggtggagcaaggtaaaatttaagaacgttagccgtgctatagaaaaggccaggaaggatttggcaacccttgttagccacaatgctgactatagtgagatcaggcgatcctctgatgtcttgaatgaattactttatagagaagagatgctttggctgcaaagatctagaataagttggttgaaagaaggtgatagaaataccagattatatctaaattgcgtgggcctgatggtaccgtagtgaagtcgactcatgaaatggagaaaatagagacagattacttcaaggatatgtttacagctgacccctgtattgatcagtcaagagtatcccgtttgttccaggaaaaggtttccccggagatgaatgtggatctttgcaaagatttcactgagcaggaaattgcagatgctttatttcaaattggaccgatcaaagcccctgggctagatggtttcccagctcgtttctttcaaagaaactgggatgccattaagaaggatgtggtttcagccgttaaatctttcttcgaaacatcaatcatgccagagggtgtgaatgatactgcaattgtgcttattccaaaagtggatcagcctatggaactaaaagattttaggcccataagtctgtgcaatgtgatctacaagattgtttctaaatgcctggttaatagacttaggccaatcttggacgaattggtctcacaaaatcagagtgcctttgtgcccggtaggatgattacagacaatgctttgctagcttttgaatgttttcacttcatccagagaaataaaaatgcgaataaggcagcgtgcgcctataaacttgatctttcaaaagcctatgatagggtggactgggtgtttttggagcagacaatgtgtaagttgggtttcgctccccggtggattaaatggatcatgacatgtttgtcctcggtgagatattcaatcaaatttaatggaacccttctggatacttttgctccctcgcggggtcttaggcagggagaccccctttcgcctttcctcttcttatttgtggctgatggattctcgagactaatggaagaaagagtagctgctggggatattacgccggtcaagatatgtcgaggtgctctaggcatctctcatctactttttgtggatgatactctgctgttttttaaggctgactgtgagcaggcaagactgatcaaaggggtgcttaatgagtatgctttaggcacaggacagctagtgaatccgaacaaatgttccattctgtttgatgatacttcccatgctgaaacacaggacgcaataaagaatttactgcagattgtgtgtcacaactttgaagacaaatatctggggttccccaccccggaaggaagactgaacaaaggtaagtttcagagtttacaggagaaaatgtggaaaagaatcatcttatggggagaaaactatctgtccagtggaggcaaagaaatcatgttgaaagttgtgatccaagctattccggtttatgtgatgagtatctttagactaccagagtcggtatgcgaggatctgaacaaacttgctcgcaatttctggtggggagcagataaaggaaaaaggaaaactcattggcgggcctggagctgtctgacaaaaccgaaacacaatggtggcttggcttttagggactttcgtctctttaaccaagcgttgttagcaagacaggcctggcgtctgcttgataaaccagatagtttgtgtgcccgagttatgaaggctaaatactatccaaatggatccttagtggacacggcttttggggggaatgcttccccgggatggagagctattgagcatggcttagcccttttaaagaagggcatcgtctggaggattgggaatggccggtctgttcgcatctggagagatccttggatccccagggaccattcttgtagaccaataactactaaaagaaattgcagggtgaaatgggtttctgatctgttgggacaggatggatcttgggacgttcagaaggtttcccgggtttttttgccgattgatgctgatgaaattctcaaaattaggacatcggtgcggctggaggaagatttcctatcctggcatccggataggttgggacaattttcggtgagaagtgcttataaactggcaatatcccttgattatgcagatgaaagttccagttcctctggacagaatccacagaagatatgggatctgatttggaagtgcaatgtgccccagaaggtgaaggtcttttgttggcgtgctgcaaacaactgccttgctaatcaggaaaataagaagaaacgtaacctggagcgttctgagatctgctgcatttgtgggaatgaaacggaggatgtcagtcacgctctaagtcgatgtccccacgcagtccacctctgggaggccatgaaagctgcagggagcctatccctgaatgttgccggaaatgctacaggaggctcctggtttttcgaccaaattgaaaatacaccagctgaggaaagaatgatgttgtgcatgatgctgtggcggatctggtttgtt

SEQ ID NO: 59144 - DNA, 5822 bp, Oryza sativa
cggtggtgtggagggcggcggcggcggatccggcgatggggaaggttgtggcgacggatccggaggcggggaactcggcggcgggccgaccgtgtgtggtcgagcttctccgcccgcccgaccacgatggtggccgtgctcgccctcctctccaccggcctctccctgtccctctcccgcgcggacctcgccgccgtcgtcgtcgctgagccgcggctgctctacgcgaaggccgaccgtgcgtcgtcgcgcttctccgcccgcccgaccgcgatggtggtcgtgctcgccctcctctccaccggcctctccctctccctctcccgcgcggacctcgccgccgtcgtcgtcgctgagccgcggctgctctacgcgaaggccgaccgtgcgtcgtcgcgcttctccgcccgcccgaccgcgatggtggtcgtgctcgccctcctcttcaccggcctctccctctccctctcccgcgcggacctcgccgccgtcgtcgtcgccgagccgcggctgctctgtgcgaaggccgacaccatcgctgccagcgctcggttgggtcatcccgtccgtcgtcgtcgccgagcccaccgccgccgacgtcgcccgagcccgccgccgccgctgtcgcccgagccgtctaccgccgccgtcgccgagccccccgcagccgctcatcgacgccatcaaggaggccggcggcgaccacgtctggaggtgagggcagaggcggcgtcggccatggttgttgcaaacggcgttgtcggtggttgtaaacggcgctcatcccatccctccctcgttccttgaaccaaacaaaaaactgggatcatcctattctacaaaccaaacacccgaatggaatcatcccaatcctcaaatcagggatggtttcatcctatcccacctagtcccagaaccaaacacacgctaagtggccgaatcaaatccgatctttccaacccaaatacccaattaaatagtccgagtacagagccaaattaagtgtcaaaatatacagctgagagtccatatacacagtccaattacaattatacactcccattacatgtttgcagtccatctacaaatttcaattacaattggaatgtacaaattctatttcctttttccctctccctcagcccagctttcttccctctgtcggcccagcaggaggtctgcttctcctccctttccctcagccaggcaaagccagcacgcacgcaaggtgttgggtgaaatgcctgcaagccatgccatccaaccaagccacagcacgtgaccctaccaactcgaacgaatgttggtgtcggccttcaagtcgtgggtccagccacgacaacctctctcccctctgcacccaaacatccagctcacaggagccctccccaaaaatcggcaacacagtgagaggaagctcacaccgaatgcaaagccgagtacacaccgaaaatgggagagcaagcgcagcatgaagcttaccttatacagtactcctccctctgtggatgtcgacctcgtcgccatccatcccatccgccgccgacacgtgctcgggggaagcctttgaccgacggtcacaacgccgcctccccaagccgctactcctcgtccacacgctcgtccttgtcctccactgctcatagacgggcgtccacgctgcacgccaccacgccgccactgtgccccaccgcgatccttctcctcgaagccattggcatcacaagcaaaaccaacgccaggagcgactcttcctccttgtgccgctctctcccctccgccgccagccacctctttccccgcgcgagctccgcctccacggccacgccggcccgcgcgacggcctccccttccatcgccgccgccgccgccggctgcctccccaaccggcgcccgaccacctcatgcccggcgcaactcccccacttccctcctctgactggcgctgcccccgcaactcattgtatagcaacgttggcgctgcccccgcaactcattgtatagcaacgtttgttaaaatatataacaagtaaatttaatataaaacatatgcacatttggttgattacatggttatatctgagctattgtctcctcatcaccttcttccccatccacccgaccttctcccccatccacccgacgccccctggccgccctcagatcgccgcccagccgggaacggccgcgccgacgcgggccgctccgagcaccgcccacggcagccttctttcccctgccgccgagctcctctctccccacctcgccggccatcctccctcgccgcgccgccgtgccgcctcctgccgcgccgctcggcccgagccgccggcgccccagcctcctcttccccaccaacgccgctccctctctcctctctcctttcccccaccgccaccctgtgccaggccaccatcgccggcgcctgtcttctctcgggcgcgcgtgaagtgaaggagccgaaggcaaagaagagaacgagagagagagagagagaacacaggaagaatcgggaagaggggaagaaaccggaaagagaagaaaaggataagaaaaggaaaaagggaagtggcacccacagcggggcccactgtcttgactcatctcggtggaacactttgactcaccaaaagtctatatcactaccctcttgctcgcctccactaagaagttggaataagttcactttgagtctttctatttgtctatttgtcgtccagtttgattttcgtcctttaattgcaaaaccggtacgacagatccttaaacttacaaaactgttaaaataaggtctcttagcagtatttgaccccggttttgggtgagttggtgctaggggtggaaacgagccgagccgagccaggctcggctcggctcgtggaagctcgcgaaatgccaggctcggcttggctcggctcggttctccaaccgagctgtacattaggctcggctcggctcgtggtctggctcgagccggctcgagctggctcgtgagctttgcaatagcagcagttgtattgccagcagcagttgtgttgctttgcaatgacttagttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccaagccaggcgagcccgagccgagcttgagccgagttcacgagcccgagctatttgtccagccctagttggtgcctatgtggctagtttaactcggtacgtggcattgacgtagcgcttacgtggtaattcgatccgaaaaataataaaacctatgagacccacattgtcagttttacacaacaataataaaaaaaaatggtggggcccacgtagaccccacctgtcatcctcattacccttctctctcatcctctctctccctctctctagccggagtggcggggaggagtggcggcggccggagtggggctgggaggagcgggtcgggcacccgacgaggaggccaaagaacaggcggtgcgcggccagggcgacggaggcggccgccgcggcgccgcacgccacgacgaggcactcctgagatatcttcctgatggccctcaccacctttagcttccttgccaccttcctgtggctcgacttgatgccgcgaagaatggacgagtacatgtcgtggacccgccggaagctgctccgcgtcgctgaacgggttgctccgcacgacggcggcggcgccgccgtcgtcgctacggcgccatcggtggcggcgacgctgtcggagatggtggcgaggaagcagcccatggatatgtagttgctctgtgcgttcttgatgttcgtcaggaattgcctgcagatctcagacgcctcgtcgctgaagttgaagtagcctaccatcgccagctcgatctctgacgacgtcctccggtgcatcatccgctgcaattccgcggggacgacgcctctggtgcagcgtgctgatgcactcctcctcaatgctcatggattccatggctgtgttccaatacaaaccagaatttctctgcattattgatggcaaaatgaactgagtaacggacacacaagaacagataaacagatgacgaaaagctcaatgttctatctctttttttcttctctctactgatctcaccatggtgtgatgggcacatgaattgtccccattccaaaactcaatttcttcgagtttcttgatcttttgggacaagcactgtttgctttcttggagttccttgatctttttgacaagcccatcctaggataagtccattatacctcctcccgtccagaggatacccttgagaatatttctcccaaaattaaaggaagcctcttccaaattttgggtatcctttttcctcggtatatataaatccatatgaacttcagaaattcatatcttgcgaactccgattggctccgttcaacttccgtgattctcctaaaattgagatccatccaatggcactacgggtctaggatgattgttactttatttggaggattttgtatggttttcttgtattgatcgcatattaattaaatattcgaatagtcgtgctcatggatattgagcgccgggacttgtactactcttggctagcctcatagattgtaatcttgcttagattaggaattgaggtgtgaccttgcccgatgggcgggaaggtcattatgatgttgggaatgtggaaaactgaatgggagggtaaaccggaccaagcgaggcttggggaagatggatgaaccctcgcggattaatgacaacttcaacttaacgttgtttttcagttaaaactgctaggtcataggtttgtgaaatgaattatgaaaactagctttatgcaaagaaaccaagccatcctttaacccctgtgtgcactaaaggcatatgtagtggcggcttgctgagtacggttgttactcacccttgcttaactaaatcttttagataggaattggagttgaccatacatgcactatgctgatgaagagatgtcgaagacggtggagtcagacctaggttcaccagtcgatgcctgtggagtatattagaccaccgctgcttcgcttcctctatctcatctatttgttttggtactttgtaacgtacatgatcatgctcggtctatttggatcctgttttggctaccttgtattattaatttataaattaacctgtgtaacgatgtcagcctgtgatattcaactgtgccatgtgtgtactatctacggattcagagaatggtaatgtaaaacacatggggttttcggtgtacaaaaccgaaggcccatggtaggcctattatttttaaccattagatcaaatttaaaaaagaacaaataatttctgcctctacctccctctctgtaggtgacaggttagatcaaacttaaaaaagacatgtgcatgatgtctcctcgggtacgtatatacgtactctccgtccattacactggtggagaaaccatctttcgtcggtcggccgatttccacaatagtcccggatgcaataaaaaccggggctaaagatgatctttagtcccggttcaaaagggtaacgggcatatttgatctttagttccggtttgtgttaccaaccgggactaaagatcatctttagtcccggttctgaatgctgtcagggcctgtcaggccccccggggatctttagt

SEQ ID NO: 59145 - DNA, 28899 bp, Oryza sativa
ctggtttatttcctgaattttgtaactgtaactttttaaatctaaacgaaatgttaaactgtttaaaaatcttaattctaaaaagaaattacagctatcacgagctcagctcagctcaaggaagaggaagaagaagaagcagcttcaccacctcagctcctcttgcacacacacacacacactctcttctcttgtctcgctgtggctcgctggacacaacacacacccacacccactcccccactctctctccggttcatgtcctgctgctccccatgtcgcccccactcgagctcgactacataggcctctcgccgccggtgcccgccgccgccgatgccgccgccgacaacgacctgaagggcaccgagctccgcctcggcctgcccggctcccactcgccggaccgctccccgcccgccgccacgcttgaccttctcccgctgccaagggcgccaagcgcgggttctccgacgaggcgcgttcgctgccggggtccgccgccgccgccgccggcgccgggaagggcaagaaggcggcggccggcgaggaggatgaggatgccgaggaggaggacaagaaggtcgccgccgcgccgcaggcgcctgctggcaagtatgttcggaattgcggattgtggctttgatttccttctttggggttcctctttttttcttgggaaaaaaaataaaagatggttttgtaaattgtgaagctctggcctctgggttgctataaggagaattttggtgaaaaattgtttttgtttggtatgatgaagcattttcagttttgtagaaatatttttttcccaggctgatatgtttgatatggtgttttttcttgagttttgggaaacaaaagtagggagttgagagagttgtgggcaaaggttgaatttttgtgtcaatagatcctttgtttcagttcaattttgcctctccttttttccctgtgaatttggcttctctgccgttaattagaggagggaaggaaaaggttttgagttattcttcctgaatttccacttttgctcttttcttcaaatttctcactttacaaagttgcctcctttttcttttaacttgagctttcttgcaactcttttttttttcctcaaatccttctattaccaagttttatcatctttaaggtgttcctttctgctgcattttcttggcagccttttgatctgacattactttgctcgaattcttttgctcttgagcctaattggtttctgtattccctccctgcacatgagtagagctagaacatgtagtgatctgactcctccttgtgcatgatgtgttgttgtgcagggctcaggtggttggatggccaccaattcgcagctaccgcaagaacacgatggctactaaccagctgaagagcagcaaggaggatgctgaagcgaagcagggccaggggttcctgtacgtcaaggtcagcatggatggtgccccctacctcaggaaggtggacctcaagacctacaagaactacaaggacctgtcaactgcgcttgagaagatgttcattggcttcacaactggtgagatgtctcgggttaccctgcttgcatttctctttgtaattgcatttccttttgatgtggatgctcttacaattacatcgtctaggatgcctgtgactaggaaccaatatatgcttgatctgtacaagtaacttttgccggtaacatggatttgttcctagtagttttaagatcacaaaaggcgggttatggttcatttagttgttttaagatcacaaacagcaatttatggttcactaatttttacaagaaagcgaaagaggccttatttattatgtgctgattgtatttgtactatacatcttccaaaaagattgtatttttaaagataaattaaaattggctctaattctaattttgtgatcatcgtacaggtctttttttagttctgaacattgctcaatgcagatcatctttatttctgaatattaatcatcgtcaattcggatggcatattgttttaattgccttttccgaatgtatttcaattatttcttgctgttttgattatttttatttcagattacgtaggaaatatactttcattatactaatagttataccgccttttctcgataattaatagacacattgcttagtaatattttttttgtaaaaatctagaaagtgagaacaagcgcgaatttttgcaatagaaattttagtacaaggagagattctcttctgtttgttttatttggccttacaggttagtgtggatgtattgccatatcaggcaaggatggcttatctgagagccgcaaggatggtgaatatgtgctgacttatgaagacaaggatggagactggatgcttgttggcgatgttccatgggagtaagtacactagttcttatctagttatcatcgcaaagaaagaagtaataacaccaatgagatcgaagaaataaaaatgctgttactgaagaacttttgatttaaattgcaggatgtttgccaactcttgtcgcagactcaggatcatgaaaggttcagatgcaattggacttggtaagtttgtatgtttattatgttgaattgcacgttcggctgatctcattttatttccctttaaattgcacttgtagacctatgtgtttttgacacagagtttaaatgcatcatgtgacatacttgctcagtttcaaaatataagcattcctggaatatatttggaacagagggagtatcagtttaggaatattggttttcttgtgctttctttcaaattcaacttagcaattcatacttcatgctgtagggcatgttgaaccagggctggtgacataactcaaaatactctaaaatcaaggaaaccataactcattatgctatatcgatatgttggatgcttgtatttaagaggtagatgtgcaattacggttgaaggtgtcatgcatgtatctaaccagcgctataaaaaagctaactgattgagatctgagtcttactattgatgttcttgttctaatgcattgtttcaccatgattcctttgtgcactaatcatggaatgaattattggatgtcaaacttataatgctttgaatggcattatgtggttgttagctgttatcattcaatggcttcaccttcttttagttgttagtttgcatttttacacatggctcggtaatttacttgtcttgtttctttctcatgcagctccaagggcagttgataagtccaaaaaccgcaactagaatggtttctgccccacagtcaaaagcaagatggagatcaaatgactgtagggaattttctgaaaaccaagaagtctaacagttttaagatggagtctgccttatggtctgtactacatggtttgctattgtgaaagttaaaaaaaaaggtgtcttgttatgttagcttcgccaaatctcctagggacataaactctatttgattgtgcccaagtctttgtacgtgtgttaatgctattcgtgtaaatggtttggacaccatgtgctactgctatgattgagcacccctacctactttgcaaaatgttgtcaatgaactgtttgttcgctacataaatgttcaatgaagcttgcaaatgtattgtccaccaaggcatcaactgttcatgctctgttccatacatctcatctgttttggagtctgatgaagcaaccttttttaaggcagtaactttctacagttgtgttctttcaatttcatgtccatgctttttcatggtgaaactgtgcttcctagccagctttagtgtgtagttgctgagtgggggcatgtagtgtatgcagttattatcttccaaggtaatgatggttgtctctctagtgtcattttaaaaggtttccatctcaaccatcattcaggttggatattatattatcatttctagagagatggcaatggcttatgatcccttagaatcaggcttttctttgccttggtgtgtatcttcctccttagaaatgatgctccactctgcttactttttgctgcctttttctccttactagtgtctgttagttggtatgcatgtggagtggtgtccatttgttccaatgaacacataaaaattctgattctgttcttgtttcaactcaaaaggcatctttcactaacccaaatgagccttcatctgcatttgtttatctcttgtagcttgcaggctgtcgcatctcgggcgctgaatttattcgactatgctgaggcgcgcatcggctgaaagtgactgatagagttcaccattcgtgctgattggcagtgcatgaagcaatcctggatcatctggtttagttttctaacacttcttcatcttcctttgttacctcctgttgttttccaactctgaacttgcaatatatatttaataccagcagcatccagtaccttataggctctggattcctttgttccctggtggtcctgccatgccaccaagttgctgatattttaattaaacctttgcttgatccctttaattaacagataaagtcactcattaggatggtagtttatttagcttctgtgtgtggctgtttgctccatatttcactgtgtttcatggcctgcagataattgtgaatgtctggactgcagcattgctttcactttcatcttttcaggaagcatgagtatgcatatgttccctctagcttattaggtatatcatgcattctgtcatttttatttaagagataaatcttgcatgtcaaggaaggaaggtgagcatcttcccacagtagcttctcctgtgaatgaaatcaaaattctgtttttctatcacaccctttcagtccttttagttcatgtcctatggattttgatggtgttgtgtacgaatggaatttcgacaaattgtcgcagatagtgatttgcacgacatgattgatcttctttttttattattattattaaaactaaaaccctggctcgtcggttgtttttttttttctcattttgtgaacaataattcgtgcaacttttacagatcgatgttaacttcgtactacattttacagacatattgatatttgctctcataattctgcatttctcattagcatatcatcaccaaaaacttcagcatttttgtctacatagttgacaaaaggaggccatggctggtaagagacactgtcagcctttctttgtcagctgtaaaagcaacatttgtgaagcaaatgctgagcatagctgctcatctcagtgaagcgtttatccccaaactgcctgcctttgtggtggctccagattttttttttagaataaaggaaactagttgcagctgcaaattgacagcactgttttgtcaactgaaaaattctgagccaaattccaacgacgtcacatgatctttgtctcatctagcagcataactcatctgtttgtctctgcgaagttggaaacattatctctttgttttaaccgagtgtgaactagacagtgtttccttagatgcaaatattattatagcccagataacaattgctatagcctaaacacaatatgttaaagttgtgtccaactttttggcaaacaagattcatatttatgaggaccattgggttcaagggaatttcagaggattttcctaggaactaaactatcttgcaaaaaattaccgcgttttaaaaattgcctcgaatttcacagggaattagtttaatttccataaaattcctgcaatatctctctgttcaaaagagggggtaaattcacaagattattacctagactctccgtccttaaaaaaaagtctagatttatagttaaaagttattttttttacagagtagtatttatctagaacagtatcctacactgcagatgttatatgtgcctcacttgcgacatctgaactgaactgaactttatatccatgattcatgcaccggaggagatcatcaaagtatgaagaaatcatgggcattaccaacactggtcgctcgctggccccattaattaggaaaaaaaaatgggaccatatattcttattaacataaagatcccaacaacacatttttttttctcttcagcatatggccattcccagcccaatgagaacaatgtccatagcattaaataatctgtcacgaaaattaaaaaaatgacgtggcaagtgaataaatgaggaaagagaagaaaatcagatcttacatgagatatagtttctacgcaacatccaagacatcatgtgagataaataacattaaatttaagtatgtaaaagttgtgtttgcattaaaataatagtgtacagtactagtttctttataattggagttaatggaaactactggcctaattaaataagccatctatttctgacggtcaaaaaaggcaaaacaaaaacaaaaaaaaaccgaaaaaagagtgcagaaattatgagaggtcgggcccaccattgggctggactgagagacacaattatgacgggcatggacgcccaaaaaaaatgagaaaaaaaaataatttgcaatgcgccccaacatccgctgccccacacgaaagcgacgtaaacacctcgctcaagccccaacacccagacgctgacagtgggcccggggatgtcaccggggcccacacgtcggtggaggtagggccgctacgtgggagtgggggtgcggggggagagacggtgcgggtgggccccacagtgaagtggagcgtggctgtgggtaggaggacagcctgggccccaccccctcccgtcgcgagcatcgtgggccccgcgcaaaaaaaaaatgaaaataatgcgccgcgcgcgtgcgggcccacacctgggatggatgacaggtgggccaacgaggtggtggggccggggtgtcattgagcgttgtgggtgaggttgcggggggaaaaaggaaaaaaggaggtgtgaggtggcagctgggtggggcaagtgaacatgggcgcgggtgtgtggagggcgacgcggttgggggggtgcaactgcaggaggcgatgggtacgcgggaacgaggtctctcgctgtcgggtgggcccacggacgtgacacgctggcaggaacaggcgtctgccgtgtacccctgtatccctgtcaagttcctgtcaaggttgacggtgtgtgttagctgtgttcagattagtaggattgcaacgtagtatcatgtttagcattagatttgtttttttatgacatgtactcgttgaattctagtatgttagaaaatgttatattttatattagatttatttattttgaaacagagattaaacagagtatggtttgtttaaggaaattgcttatgagtatcgttggtactatgggttggaaatactttgcttcgcaaagaaagcagtataactcattttaataagtgtggttaattaaatgttagttgaaaaacttaaaaataaattaagatgatttttttaacaacttttgtatgtaacttttttctttatgaaaaacacagtgttttactgttacggaaaacgagagtgaaagttgataaaggtgaggaatgaaatcagcctactcttagagtgtactttgtatatccatctatttcaaaatataagaattttcttatactaactccaattcacaaaaattcttatatttttagagaattagggcttaggaagggaatttaagtaatttaaaattttattaacactgaggtgacttaaaaaaatatttattcataaccaccaaactaaatgcttgctagttcaaattgctagtgaggagagtcgctatggtattctctaaagtaaattaatttcagtgacgattagtacgtagtactagtacattacgagtgaggtatacgaacgtaaattgtctctatcacacttattttcgtatcaggcatatacacattctccatccgtaaaaaagaaaaacccatttttaagtttgaatctaaatatacactatatcatttaaacctagaaatagtttttttatggagggagtttctttcgtgtcagctacagcagatgtacagtgctttctcattggtctttgcgttacacactacttttggatcacccatacggccatactccgtataaactgtgagtttatgttggcctactgttaattagggttgttgtatgagtccaccaatcagatattaataagtgtatctagttgaacaactctagagtgccaacattagtcaacctagccatttctttttcaaataattgtgaataaagggcgctaggagtgaagtgttcaaccgtctctaggctgcgcattcagagcaagaaaaaatagttactcctatttgactaacacagccttttaagtccctttttaattttagttattcaccagattgtttatcctacagtatgaaatatatgtttttgttaaaaacgtttttctatcgctttttagaccatttattttaagctatttaccaattctattttcttgaaatatttaattgattcttatagttaagtagataatccgtgacaataatctacttaaatttgtctgctgtgagatccttcccattgtggcaactggcaagccgagtaaaatttcattgctagtggtgcccattgcttagctttttaaaaagggcgaatcaattgttccttgttatcgcatctcatgcaaactgacggagtaataagctccatcatgcatgcctgctagctaggttgttgtttaccggtagcagcacaaattcatcaacgaaatgccaccactaagcaatttcgaaaattcctagttcaattttggtcggataaggcctatgtggttgttcaatttcctagtatatagaattgggactttgggagatacagatcaaaattaaatttaaagtacatgttcccatacttgtagtagccatctcatgggttttatatacggccccccgcctatttggattatgacatgcaaactgtcagtgtctatctttgtcctctccctttccctgttttcttcttttctttattccctacttatctaaatcacatcaacaaaaatctggctgtcaacacaggaaataacaatgttgtatcgtcgccaacaaaaccacaatgtagaactacattagtgttaatctgtttttgcatatttcaatctcagtacttgcatgattaagatatgcggctaagttgattaagtgggctttctttgaacggcctgaaatgttgttacaagtgctaccatatgtaattcgcataaagtgttgtagctcaacgcacaccaacacatttgtgcacccaggaattcagcatagttatcgcaagaaagtgcagtcgcgtgtaaacaaaatgtcccaaaaccatgcatacaattatacaaatctggatgaaagtacaactttgccaatattattgtcaataaaactaggtcaaactcaacttacactgacgctggtattcatagaatcttttgctatataatatgccttcatatgttaacagtgatgaacactgtcgccatctcgctccatgtcaaatgggcaccatatcaacgtaaaagatcacatgtaacctttctctcctttcttccagggcgcccatggataaagcacaaaagacttttcagttctcagcgtttgtgctcctcactcgctgattccatacttaccaccattcattcatattccatgacatagaatacaaatgacaagaagtcctacagcaggaatgctaactttcgaatgtaaaatggattgattaagaacaatagttctgacccggaaaacaaaatttgtacatatgatttgacttcgctaacaaaatggattgcgcatctacatcgcttggaatgttgtaatctaatgctctattaaactaccaactgtggaatggtagatttgcatggcctatctacaaacctcagttcgaggtggtgtggcttttacaagatttcaagggcgcaagatgtcaaatcaaggggaaaaacctctgaatcctgtaccaagatgagatcattggcaaaaactcattcttccaactccttgagaaaatctacattatcaacaaatacctgcaattatggtaattaatgtatcagacggaagaaactgcgggttcttcatgaaaatagaggcatggcacaaaatatgtaatgcaacagactaataatgcatatgcatatacttttttttctgacaaatgtacttaggagtattattattctgaagatcataaaatcgcacagaagacatgtacgactacttcacatacttgtttcaagatggggaatattcatggcaggtcagcagaacagttgacttggtctaattcatcattattgtacacagtacaataaaaaaaaactactactccctccgtttcacaatataagtcattctagcatttcctacattcatattgatgctaaggaatctagacatatatctagattcattagcatcaatatgaatgtgggaaatgctagaatgacttacattgtgaaacggaggaagtacaatttctgttctcaaattacacaaagaataatgttaattttcttaaatatgcctttactgtatacatggtaataaactaattggatatccttttttctagggcagtgagaatcactaaagattttatggtgcgtatgtattattcaagacacaccaacaaaatagcaacaaatttcttccaagtttagttatcatggaaagtttatcgccataaagtgtaaatggcccagaaaaagctcatatggagcagtcagaaacagccaagaacaaacaacctttagcaaaaattatgacccccttatctacacacacacacacacacacacatgcacgagagagctgtgattctcaaacaaaaagaaatagtacatactgttttccagccatctggatctgtgcaagcagttatcttcgtattaattccaggtaatgggccaggttcacgagttatttgtccaccattttgtctaatgacttccgcagtcttgtagacatcatctgtgctaatagcaatctggaagggtaaaaaaattaaactccacgactgtaatgtaaatacgagggatgaaccctcatgaaatgaaactcctattatactcatatttgacccaaaccctttcggatgcttctagtaaccaacgaatggcaagtgatccccgttgtttagatcatattcaatcagaaatttccacatagatccttttttattactaacacagtatagaagagaaacttccaaatccaatctaaacactcaaatataatatacctgtgcataagcatttcctttatcatattccttgacaccatagttgtaggtcaactccagtacagcatttttgtcttcaggaccatatcccatcattgcaatagtatactagagaaaagatacaattagatttctaatagttataaatcacataaggaaatcataggctatgaccaaaagggttaggtacatgcagatttggttgcaaaatattaacagacaaaattgtaagcatctagatataacaaaaataatacttcctccgtttcataatgcaagtctttctagcattgtccatattcatataaatgttaataaatctaagcatatacgtgtgtctagattcattaacatctatatgaatatgagcaatgctaaaaagtcttacattatgaaacggagggagtatatatcaagatcattcaagacagacaaaacctgttgtggtgaaaaccagtaacagaaaatactttgaggtctattttttatttgttatacgtgcatcaatttgacatgactaacgccaagcagctgtagcatattctctaaaaccctgtgtggactgtcatgaaaaaaaagtgaaaatattttttaacataggtttcgctatcatatatgcttctatgaaattgcaaggttatgttgtcatatatacttattatgaaattacaacttaacacatctatattgcttggtggtggtggtggtggctatggccccttactggtctcacagcctgacagcctgatgtatggggccaccaggctatgagaccagtacacaaatgagtgctatgctcactgtgttgtctctaatagtttgcttctttttcaccttgattcaagtgaaaaactcaaggacattttagttttattagtagttcactgcacaatttattattaatacgtgtttcattattcatgtcaaaatgcattgaaggttttatgtctcactttggaaaacaacaatcctataaacatgtacattttctttttgtttcttaaagatgaagcgttttgtttcaaccaaacagaagcaaacaagttctttttttcagaaaatggactcaatatttttatttctataatctgctgcaatgcacgggtatttgactattgttttgtataaggagaaacaaaatagagaaacattggtaaggagtaaagtaggtcgattttagtagttcaggaggtaaaatgagtaaaaaaaaatacttcagaggattaaatgctccggtgaaatagtttgagggagtaaaatggattttttttccttttttttgttaagtcttgcatcatttgtatctgtagttgcatatccagtgtaaattatgcatcagagtttctagattaaaagacaatcacttttacatttgtaagtttagaacttaagatatactcccttcctccacaatttgattttgccaagtttagcagaaattaaggtagaaacaaaaagacatgtgcccctaaaaaaggtgggggacaagtttggattggcaacatttcaggataataaaagtgcaaaaaggtaaggggattgaatgcaaggctgagtttgtctgctgtagttcactccccgggttctcaaaaccccttatatttgtggacaaacgaacagggccaaaatcccttatatttttagaaatttgatatttgttcaatgcatatagatgagtaatatagggaaaaaaaggtaatctgaaactttgtttcacgaatgagtggcataataactcatcagaagaaagttaacaagcatttggactgtaataatatcggatcacagggttctagtccttttgacagtgacccttatccatagcttggatagcaactgtgccagagaagtatattttgtttccagattcatgagtgaatacgaagaataagacaaacatgacacaagatatcctgacagagaacagacaaagtttgtgatcaaccctatgcacaaggtaccagaaaaccagatggcacaacatgcttgagactaagatttcaaaagaaaagaaaaaggcttgtcaacaccagaaaatgatgcctaaaaacaatgaagttcccatctctagaaagaaatataagaaacaatggcatgtataatgaaacaaccagtaaatgcacatgcggaacttgctatcacttcggttttatcaataccatgcctactacccaagtctgaagtctgaacccagtgtatgaatgtagcaaaaatcaggatacaaccataatagctacatttaacatgttctccgtaagtcaggataccactgtataagatatggaactaagcaaatagtttacaaacaaaaagtgcatttaacatgttctcatatttcgaggtagtagtgcatgtttttccttatctcacttaagcaaggatcagattagaaagcatcagggcaaacagaagccatgaggacaaacagaagtcatagcaatggaggtgatgaggtacattgatggaagctcttttgaatgtttttctagtactttgtagtagagcataacattagaaagcatcagggcaaacagaagccatgagtgtcacgaggtaaatccatgcaatggttttgaaaagtaccaaccttgtattggggattgtctcgtttccggagaagttccatgccaaatgccttatgatgaaaatatagtacagattagttgctgaatgaataattatgataaataccaaatactacaagttaaagacaataagtttaccttctcatagaaattgatagcatgatcaagatctcccactcgaagcattacctggcataaaggctcaggtgtaggacctctttctataagctcaaatttgtaaccatcaggatcttcaataaaagcaattacagactttccaccttttacaggtcctggttctcttgttaccgttcctcccttggctttaatgagatctactgtttttgcaacctacaagttttttgtaatgaaacttatcaatcaaccaagcacatatccatctttgcaaaggcaaaatattaaaacctataatcagatacattactaactgatggcatgtttaaaactctagtcttatccagtgcacaaaaatagattacattattcttggatgtttgcatgaccagagtaacattttttaccactattaatgaaaaagggaagattatccctcaatgtgtgaactgaaaacatgagtaagttattgttatgttatgaaaaaccttttatgccatctccatggaagaaaagaaggcattgtatggggtttggcatgatgagattaatcatgccaaaatctagcatcctaaaaaggctatttgttttcaactagttccctactacatggttcaatgaaaatttggacaaagcaatttaagccagatcacctggtttaaggttttatggcactcaagaatcacactaacccctacgtaactaagcaagccaattagttgtaggcatcaaaatataagaaaaaaagtgtattattaagtcacaacccctgagagaaatcttatctggatgatacatggataggtctggtaaaaaatttaagcctaaaaaccagtgggaactagcttgaaattctacaagcaaaagggactagtatctttttgagtagccaaaaagaaaaaaagcatgcccagttgaaggaagtggcagttatacacacagggctgaatgtcaaacaactcaactactcaacaaaaatactaagataagcagcagaatcttacgtcctcgacagcaatcccgaagtgaccgaaagcagtcccgatatcataactttccacaccataatctgccaatagatgtacatcaggggtcttgcacggatacaacagataacgcacactatgtgaggtataaacatatgataacagcatttggactgtagaagcttactgtaagtgagctccacaacaaaatgcgagtcctcaggcccgtacccgagaaaagcattggtatacctctcctccggaatgtcgcgcttgcgcaacagcttcatccccaagcactcggtgtaaaacctgcagaacagcaaatcaattcaaggctaacactatggtagacgccagagcaaattttagttgggagtaaatttcattttgggccaccttttattaccgaagtttcgctttgtataaccttctaaccaaagtaccccaaagtggcataaaggtaagattaccccatccaaagtgaaaacatcggttaaaagatgatccaaaacatcggtaataaaaggtgaccccaagtgaaatctactcttttaattaacaactatacgggttgtagttttttttttttttttttttcgttttctatacttgatcgtcttgtcgaggtcgccgacgcggtagacgacatggagcatgcgcctccggtccttcttgacccactccaccgcctcgtcctgcccgatcacctgcgctgccgcggcggccgacgacgacccgcccgcctccgccccggcgctcacccctctcctcgccagcctcaccggcgccctcgccgccgccaccctccccccgaagagcagcgcctcacgccgcgccactgcaaaccaatcaaaaaaaaaaacaaacaaacccaatgaaaacagaggccctcccacacgaacggggaacatggagagggggggatgataggaggtcggcgtaccggaggaggagaggacggggaggcggaggcgggaggcggcggcggcggcgatggggagggggaggaggaggcgagccatggcggtggcggaggaggagggggatttggggggcgagagaggtggggtggctaatctcctttttcctgtcgtgtccgcgattgctgcggtcgcgggtttggatctgtgcggggggatgtcagtgaggctggcaggtggggcccacgagatgggggggtgggccaaagcggaggctgtttgatttgatttcggaaggtttttttcttggccgtccgtgtgctgtcagagattttggaataataaaggaatgaatggaatttctctgtattttctctcatgttatgtcttccttttttttgtgtcttcaacttcttttgctttttggaataaactacaaatcagatcgaaaaacgagtagtcaaatatttcagctaatcaatgagtaaaatattaagctatggacgtgtctacgacgagacggtgcactggattatcataaccagctacctcaatctaatatcaagttgctaatagtacacccaaaagtacatacatttttgttcttttcatagaattttctcttaaattactcatccgatttacaatctaattacaccattgtgtttgtaataattaaatctttataacaaaattttacatgattatattttttataaaaaaatacaaattacttatataatatatctaaattacttttagatttcattaaattactttttagtcataaaagtaaatttaataaagtttgaaagtaatttacatatattatagatatattatagaagtaacttaaaacaaaagtaaagtaacttgttacggcattaaaagtaaatctattgtgggggtaaaaacatgtctatctagaaattagatttaatcaacatattatagttacccccataacggatttacttctaatgacaagttactttctttttccttttgttttaagttacttctataatatatgcaaattaattttaggctttatttaatttacttttatatgtctaaaatgtaatttagtgaaatcaaaaagtaatttagatataatctaaaagtaatttatattttttaatcaaaatataatcatgtgagatctaaactatagagttataaaatatgagtgagagcaataatcctgaaaatcatctaaaatcaaagttcactcctgtttctacccttaccactctcacccatctagcttacatcgacctaggcctacttggcagccacttgggcttgcccactccctgtccatctcttccaaccgaccagcagagagagagagagagagagatcgagggcgttggcagtgctcgacgcatgggagtgacgtgtcgacgccctcaaaatgccgagctccttctctacttctctcccagacgcatcgccattcttcactttccatcccagtgccgatccaaccgagaaaaaggatgccaccgatcgccaacgagccatctccttccctatctaactcacgttctattatcttctctccatgtcgatcaaaactcgttttgacaacctctcgattcgtgcagccaatcgacgggaatgctgccatgcccaccggagctctggagcgcgctctgtgcaccgccgttcccgcttttgtggaccaagccgggccaagctgtcgtgccaccaccatcgtctcatcaccacgaccaaaacccctcaagaaaccccaagattcatgccccatggacggtgatcggcattgtcttctccggctccggccaattgtcgccatcgccgattccttctccttcggtgagccattgtccgatactttgcacgtgaagcatccttgagacctcgctaacaacgtatgacctcatgcatgccagttagattggtagatcaagccgtcgacgtcatcccagagtgaagcaccgtcgccaagccatctatctagagcacagacgtctcccgtgaattagattaagtacagggattagttaaccaaattattccttttactcaactcaatcaaggagtaacatgttctggtcataaaactctcaagacatacacctgtaaaacactatatgcctacaacatgttataacttgtaaaaatcataagaaaatcattataactccaaaaatcttgaaaccaaatgtgttactcttagaaaacacaccaccacacctctgtaaagtcaaaactaataaaaatttctttgcaaaaatattttataacaccacctaggtaattactgcaatataccgacataacttataaattcataactcactaataaaatataataaaaatagaaattctttcacctaaattcatcttagaccagtgcctattcactgtgcacaaatcatgtattttatagcattttggatttttcgcatatttcggtgtttaattgcataacgtgtactttgtatagatgattgcttaagcggtgaagaagtgatttaggtggtgactttttctagttacaaggctagtcccacctccctctctctttgatcaagttgatcctatattttggaggttattgaggttattgaaaatgtttgcaaatcttgcatgtcgattgtacactattatacattaaaattttgtaaaacttgttagacaaacatctattacttgcattatcaccttaaccccacatatatccatatccctcattcctaaccttaggaacaatatgactataccactttatatatgagttttgatgtcactaggttacttataatgcttagtcatgcttggaatggtcttccttgtcattatgggctcattacaaacatgaaaattgtttttgaaataatctggatagaacttgaatacttgtgattttgacaactcacatcatgtgggtaaagtatacgaactctgaagagtaaaaactaatcgattagccgtgctcgcggtcatgagcagcgtgtggatatgcgttgagtatagacttgtgtttattctcctaaatgatgaattttatcttcaaattatgttgagatttgggaatgatctccttgctaccatggagggcaatgaagtgtatatttatatatgattaatgcctactttgatgccgatatgctaagtactagcttgctgaaatttatctgaaagcaaatctgatttgaaagtgttttatgcaaataaagcttgccttatgctaaaaagaaccatattatgctttctttggatatatgccatgcatgtagcgtgttaggattgcttcttgcttgccagtacattatttctaataatatactgactcttgctattggattaactatttgcttgcaggttgtagacttagtattttgagtgatgtgggtaatcgattgctttttttggacttgaacttaatgggggtatatccctaatcagtgtgcttgtgtttaggtagtcaagcttctgctattctctgatatatctatatttggccagtcggcccttgtaactataaagtaattgtaaattttagatcactttcatcttaaatgtattttgctatttatttccatgcttaagatgaaagtgtgaatctagttcacatcctgggaactagattcacatgagtataagttaagaatatttgagatgttgtagatctttagccattttttcaagtctcctgaatatgtaacacatctggtcaccgccttcgagtggtttgacaggcacatcccaggctaaagttgactgacaagctaaaggctcaacaatggtcttcaatattcttctctctaggagtcggatatttcattatatttgtttgatgacttgaataattcacttcatccttcaaatataatgagaggtccgaagagcctacgacaacgatacatactatttagcagtttgaaaagtgtgctaacgaaaatcgatgtagtatttgtattttaatcgaaaagaatggagccgtgcatgatgatcgaagtgcatgcacgcaaggctcctaacctgggaaatcaattgaagaaaattagaacttgcgagagttccattttgagttaatagaaaaaaaggatatagtatttctgtttaaattgacagtttccaagttgaacctataagctaaatgaggcagtagctaatgtttaacacttgattgaatgaaagatctgaatgacaatatcacacatgtaatgcctgctttaatgtatagttttgattgaatgaacgatctcactgtaaaaaaaaatgcacaacggagacatgaatatttacgtgaaaaactcttacattaaaaactatggatgccaaccagcaatgaccagtatagacgatttggttacaaatgtaagagatacattgggttatcgcacctactagaaaagactagaaggctaatagctaggataaggctagaagtcctactagaatactaatctaaccaattaaaaactaatacaaacatattacatgctgaaattcggataacatgtttgataatcttcatcttgagacgaatttcccttttagcataagcaccttcatcctccaaacaacctcatgcagacaaactattgtgcgccaattagtcacttggactataaaattgtaacacccttgattcagaagaggtagatcatatttcaaatttgccatcggcaataaatcctaaatctatggtatcaattggtgtgtgaaccaaaccgagatgcgaaacctggtgcacaaacttcaaactcgccatgggaataaaatcctgaatcttctatatgaaactcttgtactgaaaacgaaatttttatatctcctgatgaaacctcttggtatgctgggtgtgatgctagcaaaatccaccaaaaatttgattaccttgtaatctagacaggaacaatgctccatatcagcgacttgaatgtgatgcttcttttctgcctatcgggtgcatgacattattagtttctcctcctcagtagatgtgccatctcgtatcttcacttgctataacgataattttgtgtcaatccaatagtggtggatcaaacttcaaactcgccaggagcttcttttccttcatttgaagttgatgctgtcaggacgctcaattccgaatccaaaatgtgcaaaacttttttctcttgccttttatggaccaaaagtgacatagtgatatatgagtagacttgagaaatgttttggtttttgttcccaatcaacttcttagatcatccatgtatttcttacgctcggtctctttcccttcacctaagtaagtacctatgcaaatgagagcacacagaactcatgatgcagtaatgtttgttcaaatatataatatatagcacataatcttacatagaaataatgcatctttggttgattaagtagcggttgcggcggcgatggctcatggtggagatggtagtggcgatttggctagggaaagaggggaaaagatgtgacggtggcatctatttatataggaggcatgagagctatgatgttttttttccattataatgcaccggcacttaactaataacaataaaatagtatatgcattgagccctttggcacctaacgacatagcttaaaagagtggtatgagataaacttttattagacattggttatatagattcatagattaatttattttaaactgccgacccattaattgatgagttgttctattttccgcatagtcataataaatttcgcatagtcacctagctaacatttcttattatggggtaaatataattttttagggtaatggggtaaatataattcttcttaatattcctccttgaaactctagatactcttttatttatctcttatttattgtctaatactccctccattccaaattgatctacatataggttttttgaggttattcctaaatgatctacatatttgtgttcattcattaggtctattcgttatttgtgcattggagtaaatggacattgatgcatgcatccatgcacacaagtatttataacccacatgcaatatcttgatttgctattggctaggagatagtggggatggtgcatgcatctagtttgctgctagagtaaatatagtatgagagagttattagcttttcttggtcttggtgtacctatgaaatatgtagatcaatttggaatggagggagtataacatgtacatattcttttaagacaagtagatctagtcatctagaatccacatataagtagtcggtaaaactaaaatagcatggttagattgtctgtcagtaaaggttgtgtctatcagtatactattatcgatgagtttttctgtgacacaccctttctgtcaagaaagggtttcaatagacagaaagggtttcaatagacaatatgagctttgtcaatatatgcatcgcctgttcatttaggtcatgatgtggggatactttacatatatatatttgtactacaataaatggcttcttgtgattactcactaaaaagaagacataccttgtttgcgatgcaagatcattattttgcttgtttgcatgttttgatatgtagttgaggcactggtagctgaccttctaaatagcccaaaacttccttacttgatggccgcatgtgacgatcgaattggacgcagagaagcccaatgagtataacacgtttcatctgctcctcatcaaagtcaccgtttaggcgtcgatcgactgcatcaagcagtgaattgctgtaatacaatctcctaaacttctcaacgagaccattacccttgagacactgaggtatttcaccggaagcaatctccagaagcaccacaccgaagccgtaaatatcagacgccggactgatacagcctgtgctacaatattgagggtctatatatcttgaagacccaaatatggtcattgggcaagaagttttgtcaatggggacttgcctcaccagcccaaagtcaccaactttagcattgaattcttcatctagcatcacgttgccaggcttaatatccctgtgcaggacgcgcggatgattcccatgcatatagttgagagctgaggccatgccaagtgctatcttatacctacaattaatacatagaaaatcaaagttaattcagctgcaacattaaataatatcagttgacatgtggtcccatcgatcatgttttggggcatatattgcataccttctactccaacttagtattgtatttgcatagtgaagatgataatcaagggtgccattgtgtattagttcgtagacaaggagaagttccccattttcatcacacgaacccacaaagggaacaagattgggatggctcagtttgctgatcactttgatctcattatcataatctcgtgccgctcgttcatgatctgcaaccctcataatccttttcacagccacgggagttgtccaattcattagctgagccttgtagacagcaccaaatgcaccctgaccgatcttacggctgtccgagaagttctcggttgcagctaacaagtgtgcatatgagaatcgtcgtgtgttgtgcactgatacgaatacaattccattgtgagtttgtgacaataaatgatttatttgaatggactaacagtctattcatagtgtaagaacgacgaaatgatagcacctaccttcttcttccataggcatctcgattaatatctctgtttttctattgaggcggtggtggttgaacctggcccgcttacgcataaagcaaaccaataagacaaccacgccagccaccactgctattgctgcagtgatagatccagctactacctttgtactaaaacttttagtattgaagccagaaccttgttggttacccgcaggcacaaaactaaaaaaagttttagtaaattaagagtacgtgcaaaatgaattaaaaataatacaatgttttgttatgagtgggtatctttaccagtataatcattagtagaagtgaactacaccattgatttatgagttctaccgcaagttctatcagtagcagtagctgagatgatagcatatatagatacattccattaaattagaaaaagaaaatttttactcccaggagagaccataatttttactaccaatagagaccataaattaaagttctatttatatgtgattttcatcgaaatcttgtggtaactatacacttcataaatgtcaggaaaataagaaaacacgggtttatacacgtcatcaggactaatttagattttattattttgatataattacatgtataatttttagtgtgtaattagtataggctgggcatatttatatactccttctgtttttttaatatatgacatcattgaccttttaaaatacgtttaaccattcatcttattaaaaaaattatgtaattattatttattttattgtgatttgatttatcttcaaatgttctttaaacatgacttaaaagatcttatatttgcacaaaatttcttgaacaaaataaatagtcaaacgtttgtcaaaaaaatcaataacattaaaaaaacggaggtagtatgtagtttcttgatctagacaagtactccctccatccagttgaactacaaaggtagctatacttagatagatgaagtagtaaataaaaaagacgtgatgaggatgttgaattatagtcgaagaagtgaactacccaccatgaattaatttcgtcctacctattttgaaattttgaatggattttggattatgcatggaacctcatgtgcgtatatgcatgccatgcttacacaatacgagttaaaccaaacttagattgagatcctgatctgcaatcgagtctaccgcgcctttgtcactaacatgtgagctgttgtccacatgtcagtgataaaggcgtggtgcagtcgactgcagaggatcctcatccaactaactctcatttcaatcgaaggtgacactgttttgcaaccaagaagaacaagagtagcagcatctcaaacctataactacaatatactcacggtgcttggttgttcgacctcggcggcgacgaagacggcgaaggcgtttgataaacattattctgagatttccgtcttggatccacagtgaaagtactggagttgttgccagccgtagtcgagcaattcaagactgcatccgatgtcgcaaggaatagagtcagaacagaaagaagaacagctacatactggagatggagtgccattgcctctctcataatacacagctgcttaatttcagttagacacagccaatattaagcactagctagatctcatcaactgatgctgcaaaattggaaggatgcagatggggtttatgtacagctagtgcggttggcaaccaagacatactcactctgttacaaaatatagtaatctagaactggataagacatattctagctagtataacgaatctgaatctggatataccttaatctaaatttgttataatagaatgtgttttatccaattgtatatttctatattttaggatggagagagtacatcttgacgaggacattataattgatgaccaggttcagcgtacgtaattacgtatcataagttgtgtttaataattacaatcgtactagcaaaagatgagttaaaataggttttgttccgcaagtgcatgaattaatatcgattatatatacgcaagtgccaagtgcaactgaatattacattcataatctctctcctagtctcctatatttttttaacaacaaattaaagcaaggtttgacagtaagccacataggcaacgatctacagatcgttgtcacggaaagcctttagttttggaatcaaaccgtttacttttgaaccgtttacttttgtctacagagatcgtaagctttgcactttttttttgcaggtactatttattgggatagtgaaaatacaattggtctattgcagaaaaataaaatcatataggaaaatcatttgactcaacaaacgtgcccatggaaaaatattaccatttgatttgaatcgcaatatcaaatctgctaatctactatatacatctctatctctacttattaaaaatattgaatatgttcccgccgttcttatttgtacgtcacctgtcgagtctgattccttaaggcacgtcgtaacgtgtacgtcacttaatttcctatgtcatcacaccaaagcactctcatcagatagaaaaacatgactcttcccctctcgcaatcttttcatgaccgcttcggccagacacaacaccgagcccacagcgagaaggcgtgccgctgccataggaactatagtagaagctcgttgaacttatcttaactaggtgggttccactccagcaattgagcttatgaatacctttgccgatgtcaaaactatgatttatgatagcctgagggtacaggcaatcaaaacgactaacccgcacacacaactgctagccaaggcggctgttggggcggagaaggccagggtgaagaagctggtggcaccggtcgccagtaagctctactagaaaaaccatttttcttgataatggcattttttttcaggcaggtaggcctctcggagctaaatgactgcttgctaaagtgacaaccgcggggtgagatggttgtccgcatgcaaaaatctattttcgaaggcggacctcttatgtggtccgcctgcgaaaattgacgtggcatataaataggcgacacatcgctaaattttttttctaagtctcatctcctctcttctccctcagctctcctctccctcagcagccctcatctctcctctccctctcccttagtggccgtgggcattcgacggcaggggcggcgggatccggtgatggcgaagcgcagggtccgcgtcggcgaggcatgggaacggccacggcaacacgcggggtcggcgacgcgcacgtgggggcaacggcacctggcacggctcccctcccagatctggccggagggagggagtggggggcgggacggtggctcccccccaccaccagcatcggcggcggccgtgcttcccctcatctcccctttctctccctctccctcccaaaaccctaaccctagatcggccagaggtgggtaggagcacgggtaggggtggtgacaattcttttttgtttgtcaaaaagattttcacaggcgagtgactgggccatgcaggtgtttgtatataggcgcggggacggccacctgaaaaatgattttccctcgtctagaaaaatgatttttgacctcctgagaaaaaaatgatttttctattagtgaagggcgcttggccagatttttctattagtgaagggcgcttggccagccaccaccaagtttccgaccaagcggtgagggaattaagatgcatcagtgtatggtgttcgatttttggtatacgtctgtgatcaaacaaattcccaatgcttgtacgtactgctcggagtatcatgttccgtatgctctttgaattttgtctatccggccgtcaatcactgtgtcagtgctaatcaattaaacaagtaatactgttgcttttgatcagagtccccgcgacatgccagtcgaatttttttatgagagttgcttgttataaagtgtgtttcctactacgtaataggggagagggccgcgtcaccgcaccctcttcagccaccgctgcctcccccctcccctgaggtggacctggtagtgagggagggaagggccgcgctgccgcaacctcttccacggactgccgccacaccatccgggagaatctggccgggagagagagagaaagaggaagtggataggggagggccacgccaccacaccctcttccgccatggtggccacactccctatccacaatggtatctaggagggagaggaagaaaggggaaagggagggccatgccaccacacaccctcttccaccaccgccgcaacacttccccctcttgcgagatctaggggggctgcgccaccacaccctttttcaccatgaccctcccccctccgatgttgctgatgccgccttctgtcataggagaggagagaggctgagggagaaggagtgggggaggatgtggaggtcttgggacttagcggatttaataactatctccatatttcgcagtcggactacttaaggtcccaccagcaaaaaaaatattttttattttcgcaggaggacctcttaaggcttcgtctgaaaaaattcgattctcgcaggtggggctagatctaggggttttagctatttttgcaaatggtatttttgtagtctgcctaaaaaataaaagtcagtgttggtaaaaaataatttttctggtagtgtcagtgcatccaccaagttactcagctgattttttttttgcctcatcttgtttatgcactgttactgaaaattaatatatttggcaattggcaaagaaagtttgcatgaactgttaacgtaaatgtgtttttacaaatacatgtagctgatgaaaatataccacaagtagatttaatttattccataaatattgaacatgtaaactaagagaaccacatgatgatgcaatctagatgtgtaatacggtggacacataccgagggttcttgttcttttgtggatcaggttggcaaggagtagcgcacactacaggaacaacgcgtgatgttgggtgttgtcgtcggcgcgcaactatcgagcgtagaggaagacgagccgtcatgaaagatcagcaagcatacgcgtgaagtgcttcgaaaaatcttattgatgccttcttccggtgcaggacgtcgaaggcgaaggttttcagagacatgctctcctaatcgccggtgcatgcgataattttaataaataagtccacaacacatttatggttcaataaataagttcataacaagatcgccggtgcataaggtaattacataatattcaataaataagtccataacaagaaaatacaggaaatgctaactaatacagttatagggagaatttactatttgccactctctcaaaatgccagtgctcaaatgctactctcccaaattttcattccca

SEQ ID NO: 59146 - DNA, 4490 bp, Oryza sativa
tgggcctcggcccgagcgaggatgggagagggagacctcggctgccacgcagagggggaggaggaggtgggccgaggagaggaggaggcccgggagggagggagagaggaaggaaaaggccaagtgggtcgagggaggaaaaaagtactttggcccatattcggctcaaatagagggagatgattatttttaggttttaaactctgaaattggttgttgttgtattaaaattatttattgtgctctaaaaattcaagtaaaaaaaatgaggcgatatttcggagcatggagaatactccaagtcacaatccaatttttgttgttatttgagatttattttagacttttaattttttttatttcttttagaaaatgatttttttaaatttagaatggatttatcagatgtcacacattcttaccgatggtgtaatttcatttctcactgatacgttggactatttgagtcactggctgtgttccggaggtgatgttggaaactcagatcctgcgcacgtaaaacggagtgacttattttgttatgattaattaagtatttattatattttgaaaaatagattaatatgatttttttaaaagcaactttcgtatagaaatcttttaaaaaatcgcaccgtttagcaatttaaaaagcgtgcgtgcatatagcttcaatgcatttagcaaaaaaattagaccaaattactccatccctccacttcttccttcttccactttcctctaatttgtgtaatctcttccactagatctgacccccattgagcccactggcatcaacgctcccacaattctccgctctcatcggccgccggtcgtcgccccttccctgcccaaactagttgctcaccgaccatccccaacccactgagctaccactgctccatcacttgtcacccccatcgagctcaccagagcttatcgctaatctagccgtcctcttcctaggcaacagcggagctacccattttgttagagatagcataagcaaatatcgggcctagcgaaggtgaggtactggagagcaccagctaggctgcgataatcggtaggatctgccacaggtggtccatcagaagcagatagcttggcgcaagtgtcgaccggcgtggaacatggtttgcagtgtagcataccagctcgctcaaggagttacacactcctccgacacgggccaccttggtttattgtgacaatgttagtgcggtatatctctccaccaaccccgtacaacatcaacgaaccaagcacatcgagattgatttgcactttgttcgggataaggttgccctcggtacagttcgcgtactgcatgtacctacttcgtcacagtacgccgacatcttcaccaagggtcttccaagctcggtgttttctgagttccgttccagtttgaacgttcgctccgtccacgttccaactgcgggggtgttagagatattgtatttgtatccggttcggtttccctcaatcctatcccgattctatttctataagtcgggtatagagataaggatgtaccatccctatatgtactcgtgtccgtgatcaatctaattatcgcgttgactctatacgctttcacatttgagtccccaccaactgcgacgatctcactaaggagtaaggagtgatttgtggtggccccttcattgtggggcaacagcaaagcgcgtgcctccgtgaatcctataccaccaacccccccccccccaccccccggcatcacgctgccgccttgccctgcgcacatgagcatggcggccaagtcctcatcgcagtcatcggataggggcccagcatgggtgctagtgtagcgtcgagattccccatgggatttctgtgcgtatcctaggggatttggaacagaacatagatgggtttggtaactgaagcactgtacctaatttctggagaatactcccgatcgtgcggcgcacagccgctgtatgcttcatgtgatgttgttgccatgaatgttcttcgtggttcgctacaggaattttcgtcatacttcgaaattatgtaatatcaaaattacatttgttttattaaaattttcgctgaatttaaaggataggtgctcctatgccaaaatagaagaccacaaagtggaccatgcccatgggccccattctcttctcgctctcgagacgccaggtggtgggccacctgaattcatcgcgtacgtaccatgtgattcacgaacccatctgtgaattctactccactcctattagaccattcacagtgcacacacatggcgcgtggcaatgtttggccatagacaaatcgcttacgtggaggaaagaaggcagtggggaccgttctttccattgcttcgcgtgatcaagtttggccacgagaacctcctcgcactcggtcagaaaacctggtcatccatgcgagaaagagagagagagagggggggggaagaaaggtgatttgactgaagagaaactcgatctgcgccggtgaagttcgccggagaagggtgcggaggtggtgaagcggcgacggaggagacgaacccaaccccgacgaaggtgccctcgccggggacctcgctggcgcgccgcttcacgacgacgccgacgaaggtgccgcgccgccagatccgtcccgatgaaggcggaggagcagctcgacgccgtacggagcctccacccgagcgacgccgccgtcgaccacgagcacacactcagaagcagttggtaagaggagaggcacaagcacagtcgcccgacgccgtcaccgccgccgccgcgcagctgcccgacgtcgccgcccgccgcctcggatccacgacaccgagatccgagcatcggcgcgccggcttgggaagaatggccgcctctccgcctgagcgacgccgccgcggtggaaggctacggcgccgccgccgctgcgcgccccgacgagccaaagccaccagatctgggagctcggccaacgcctctccgctccaagccaacacccgcctccttgactcctctgcgcgccgtcccccaccaagctcccgagtgccgtccctcgccgagctcccgccgcaccgccagaatcctgtcgagcgtgatgccgaggccgctccggcaccttccactcgtcggagatgaaaaaggcagaagagagagagcgttgagatgaaaaggtgaaaaagtaaagagagagaagagagagtggagtaaagaagacatggtggaccccgttggatgcaacttgagctgtggcttgcactgtggagcatgtagcttatacaattcttggtctacgtggcatgcgaagaacgccaaaacttggtggcgcactgtgaatggccttagatgtcacaccctgaagttcttcccctaagcctaaatggaattaataattggcctcgagaaattacccgtgttaatgctaggggtgaaatcggagcggattcggatggatagtggtcgtaccatatcctaaaccatatttttaagcggattcggagcgggtgcggatagtatacggatgcggatgcagagcggattgtttcggatgtcggaaatggtgcggagtcggtgcggaatcggttcggaaacgtattaaatttatcggatgttacgtgtatatgcaatcaatgcaacatcgagttagcaatctaaggaacaataatacaataatcaataaatgacccgtcgtaataattatatgattaagtgctaaacaatatgaacacatgatgtccataatataaaaaatatagctatgtgagtgtgacatgatacgataaaagccttagactaaaaaatctttgttaattgatgaattagggcattggatgtaccaacttatgttatatgcaatagatagagtggttatatatgttgataatttcggattatccggcaaacggcttatcggataatccgacaaaattatcggataatctgcatccgctggattttagagataccatatccgcatccgcatccgcctcatactatccgcatccgcatccgtatctaccggatttctaaaaacccataccatatcctcgttttggacggattcggagcggatcggatcggatattatccgatccgttttcacccctagttaatgcaagagagaaaccctaagtgaattaatgcaagtaataatcggaagtggcatttggaatttttcttgagttctacatgtcaaaatatgctaacaagatttttagtggaatttttagagctctagaaataattttaaccaattaaaaataagcataagcattatttaaatccctggaaattcctttttcccttttttttctttttctttttccctccctcctcctaatgggccgccggcccatttcctcctccctcccgcgccttgctgggccggccaaaggccacagcccagctgagcccgcaccccttctctctctcccggggtcgccgacaggtggggcccacctgtcgggcccgtccccaacctctagccggaggagg

SEQ ID NO: 59147 - DNA, 3670 bp, Oryza sativa
ctttttcgctttgcaatcacccgctcccgtgccctctttcgctctcgcaccgtgcgcccgccaccgccgccgcttttccgctctccggccgccgctagccgccgcgccgagccgcgccgtcgacgtcgtcgcgttcgccgtcgtgcgggccacctcgtctacccctcctccgtcggaatccgccgccggaacccctccttcatcactcgccgatgagcatcgccatggccgccgccttcggccggcgtcctcgccctctcccaatttcctctctccctctaaccccctctcctcttgttcactaggtgattccggagaccgtccattgttcgccgtcgtctctcggccggtcctcgtcgcccctccgtgccggccgaacccccggtgagaaacccccgcaatctcctcccctctccctcctagcgccgacgccccttgccgctcggggtcgcgccgtcgtcactcgccgtgcggcgccactcgccgtcagtcgccgctgtttgccgccgccgcctcacggtagtgccgctgtgcgccatggccgccgggtcggcttgagccgtgcccgcgcgcgcccggccgcgagccgcctccgccgtccgatctaccgggcggtagatcggagccgcccgtcccgtcgcccgcgtggtcacccgcgtggctgccacgtcggtgccgcgtcggcaccacgtgtgcaccacgtggtgtgccgcctccttcccggtccgtggaccttgtccaccgcggactgccaccccgagccaatgacatgtggggtccgcatgtcggctccgccccctctctctccagggttttaattattgcgcaataaatcctttaaggattttctgtttattgtaaaaacacagtgaatcttctaaaattcatagaaaattcatccgtgctccgtttaaacccattcaagtctcagtaaatcaagaaaaatacaaagaatccattaaaaatggttttattctctgtttcagtagtcttatggcctatttgtcttgtttgctttgtatgttgcttagattccggttctcccgacgctccggtgtactttaaaatagtcgccgaggttcgtccagcagcagagcaaggcaagtcatgcttgtcacttgaacatattgaacctatattgcaaatgctctatcgtttccctaaaatactgcattgttttacaatgttaccatgggatggttacctactgtttgagccatgccatttgtaccatggtcctttgttagcttgggatataacatgactagatattggactaaggattgcttagccatgcttagttcaactagcacacaatgggggaatcacattaatgcatagacttcaggttctagtgttgatgttgaattagtgtcaccgtcctggtgttggtcaattaaaatgtactatatggtgggctgtgggtgtatggttttgatggtcgcgcccatggtacttaaggaccggtttgcgagatgccctggaagaacttatcgtacttaccacaaaccagcatgggcaacggctgggcttgtagtgtagctttcctctagctgacgcatccaggtaagggtgagcgtgatggagttcggatgggccccgcgacggcttatgcggctttcggattcacctaggcacgagaggggactgcccgctgccttgcgaggagtgggggtaaaacctgaggtgtggtgtacttggttagagggggttatgcgaagggtcctatcacggcctctttccgttatgtcgtggtggcatgttggcgcacggaaacgtgtcatggggctatgtcttgtgggtacagtggtacacctctgatcagaataaaactattcaaatagtcgtgcccgtggttatgggcggtcaaccagattcaccatgattagtctcaccctagtctagtctaatggaattgattagttcaggtgggtggttgggcctgttgcaacgtggtatagcgttggacagtggatggttaatattgattaattattacaactgttttactgctttcaactactgtctataaatgctcgctttatacaaatgatccgctctagctatcctttggttatatcctgcatcataccccctatttcggtatgacttgctgagtacagtgggtagtactcagtcttgctctattttccccaaatccccagagtttgagtatgcgtcagatggtggcttttccgaggagtaggcttcgtccgtgccgtcgaggatgcctgtggagtggtgttcccgctgcagtccaagtcaaggcttagctccagttatcttttattttccgctgcatttgtgtaagacttttataatgtttgtaagacatggatctatatgtcaactttgtcgtttgtgtaccccggccggtcttggacgggggttttaatacacattctgcttggaattctattcgggaatttctgggcgtgacattagagcaggtacaatagtaaactattatccagttataaatatattttagagagataaaggatgagagagaagagcagcgaactatagatctatagccagctgtagcacagactccaagacgcaacgtgtgtatgacaggtaggaccatatattaatagtatagtaagcaactattgtataaattagctattaaattgtctatagatgatttggagctagtagtctgctatactattaagggcatgtttggcacagctctagctccagctccagctccactttttccggagctggagctcagccaaacagttttagctccacctaaaatagaagcggagttgagtggagctgggtttaggcaactccataactccactccaaacctaactcctgaagctaaatttaggagttgaaactctaccaaacagaccctaaacttgctcttagtgtccagtccaacgctagatgggccggtaaaaggcctatgcctagtacaccaaacagctctttcatggccgacacacaaacaggcacgggattcgacatgaaccgtgtccatgcacaatgcacacacacacacgacattatctcgatcttatccggccccaattaacgtgcgctactgagcgtcccccaccaaagccgtcgtcaagtgaggctaaattagtggggtttggcagggttagcgtctggtcggccagagaccgctgcaacgctgctagatttgtgcttgctgttgctgctgctgactgctgttggttagccggttgccatccaagtggagcaagcaagtacgtcgtcgtggcagtggagggacgtactacagtacggatcaagcccttcctcgggaccacaatctaggacgacacatggatcgatctcctaccatccatcatacacgaccgtccacctaagcgtacacgcactgaagactggttttttttgccatattataatcattggaagattctttacaattaatgtcggctttgatttgcttgtgtttgtgaacaattgagatcactcctcactgatatatgggtatgagggtacatgagattcacgtgtctacgtgtaatgctgtgacatcctgacccagggctcaataggataaatagaatacccaaggctcgataagattaataggatactcatatctataagtgacgaggactctctctctcgttcataaatgctacttcctccgtttaacaatgtaagtcattct

SEQ ID NO: 59148 - DNA, 16600 bp, Oryza sativa
  unsure (1)..(16600): unsure at all n locations
tacattgttaaacggagggagtactctagatttgcatcaaccaagtttgactagtaattcgattgcaatataggtccatccaataactatatactactaagagtactaatagggatggtaatagtgacatgaaccccgacagagaattactcgattagggtacgtaaatgggctaaaattatcacccatgaggctgaaatcttgaaaatattgccccgtcgggtaatattaagttagtgacctgaccccgttcaacagcccccggccccgagtattaagttagtgacctgaccttgtacggtttttctatttgattttaacttcatcgttatcaccatccaaacggcattacaagttgtcctttttatccccataccaaaacgtcgatcggtggtgtagttggcttccgggctaaccgagcaatcgtccaggctctgtcatccggtgttgttattgtctcaatgaaaattaatgactgtagaagtttttttttaataatagaatagaatattatctcggtctttgataaatgagctacataaaattattacaccaattcgtttaaagcgagcgcagttcaaagaaaatttataaaaacactcccaaacatgaagcaagcacaaaactaataaagagtaagacacaagataaagagtacacaattatttaatcctatttgtgaacttccattcgaagttgataaaaggttgcatgagaattgtctcaagattacaatatgcaaactttaaaagcttgttgttttcatcacacttttgtgagccaatgactgtagaagtttgtcaaggttacggataaggcatatctcctatcttacaatttactgaatatgcaagattggtataccatcttctatacgatatatttccatatgcgataaggaagtatataagatattatggaaaatatcctcacggtctggcgattaacaaagtcctacttgaatatgataggattagtctatatcatgtagggttcattgtctccgagttttactcgaagactaaggcaactcatggtataaaaggcacacccctagagaggttcaggatcatcgaatcatagtgccaaccctcccacctcagtttacaaagtcgaaagacacaagccgaagctgccgggagatctcgtcgaacgatctcgacaaggacctcgtcggtatcgtcggattcatccgttctctatactatgcggttttccatatcaatctcatataaactggattagagctattaccttacaaggggcctgaaccagtataatccttgtcttttatccgttttgatgtcgtatcgtgtagatcctcgtaccaacgtatcccaatatcctatttatccggtctacgggtatcccccgtgacaaagttagccgacgactagaaaatacttttgttttcatctgggcttaagaacaagccacctttgcttaggaagaagctatggtggaggcagattgctatgctaccgctcatatggttttgtgagaggagttgagctcgctggaggtgaaaaacaagctccgttaagttccaattgagggcttgttatatctaccctaaaattttacatcttgtcatattgaacgtttgaaacttgcgtgaagtattaaatataggctaaaaaaataactaattgcacagattgcgactactttgcgagacaaatcttttaagcctaattgctccatgatttgacaatgtggttctatagtaaacatgtgatattgatggattaattaggcttaataaattcgtctcgcggtttactgacggatactgtaattagtttttttttattagtgcctgaacacccccatgcgacaccctatataatacccgatgtgacacgccaaaactctacacccctggatctaaacacccctgaaactattttaagccagctgactaagggcctgttcagatcccatgacaaaatttttcatcctgtcacgtcgaatgtttatacacatgcaaggagtattaaatataaacgaaaaaaattacacagtttgcgtgtaaattgcgagacgaatcttttaatatttgctaatgatggattaattaggcttaataaattcgtctcgcagtttacagacggaatctgtaatttgttttgttattagtccacgtttaatactttaaatgtgtgcccgtatatctgatatgacccactaaaacttttcacccctggatgtaagcacaatctgactccattgccagctagcaaatctgtacttcatgatttttttaatatgtcttccatacaaggttgcccggggggaggggaggacaaaacgtgaaaagcagcccctaattaaataaccgtggaaaattcaagagaaatagtcaaagctgagaccgtacaaaatcatctcatcacccatccatgtatccaactaggagtaaatatgaagtgtaaaccacatatatattctagaaacttaaaaatcatcgtacgacaaaaaaaatgtactttcgatatgtatccatattattataagtaaaacatttacttttggatttaactgttagtagaagttttaagagaaataaaagatttactcgtggtgacgtgaataaatattatacattcattttaatatcctagggtttccaccacatatttttccttacatcatgatcggttaatccccatgagaccttgttcgatttgaagggggaataagggaaaataatttcatattataataggtgttgaataaatccctccaatctccctctcttgaggattaaccgataagatctaagggagagattagagggaatttacttcgcatctattacgatgtgaaattattttctcattctatctaatccatttcaatcccctcttaatcgaacaaaggcattaaccggaaccatcctcctacctagcctgttttccctattctggcctctcatagtcataggtgagcacttgcctgccgccgcctccctgaacgacgaccatcatcaggtccgatgctctctcgggacgccaccggtggatctggccctcatcggcatgacaaccattaagccgccaagaactaggccaccatcccactgcacgcaagtaggaggcgtagctagcgactggtggccggcgcagccaacgcacctccccactaccaattgtcactgcatctccctgaacggctgccgttagatccggagttatccgggggtgccacagttgaattgggcccttgccggcctggcaactaccaagctgccaagaaaacttccaaaacaccaagaaaacgaaactggagtagaaagagagaggaaaaaaggaaaggatttcacaaattgacttcaataattgttttctccttgtgtgttggtttattatttatgttcttattgttgcctgggcatttgctttcttcgagagaattttgtaataagttgatgtatcttctttgaagcaaagactggaatttttattccattataagaaaatggaaaaggaatggaaaaaggaatgagatggggaggaaggtggtgggtggagcggctgcccagtctcaccgccggaggcgatgcggtggccatggattggccctttggggtgtcgggaatggcatcccaggccgctcgaacaagcgacggccgaaagtttatttttacaattaatttttaaccgagtccgatctttaaataagtgttctaataaaagagtaaattagacaaaaaaaaaattttgttctcactcactcccctgatgaagactcaacactcaacagtagtcaagtcgccgtggcggcctgcgccacgtggtgaatattcttggtggtcgctccacccattcggctcgcggtcgcgggttctgcacccaaccaaacgtctaaacccagaagtcgtggaccatgccaatggccccccgttctctctgctcgccagtttgctagctaggtgcgctgggctgcctggccctggggatgcatcgcgtacgtacatctgcaccatgtgattcatcacgaacccatctgccaattttactcactcactagtaggagtacttctactccagtgtccagtcgtccatcacgaaagggaaacgcttgtcctaataccaaacgctcctttcatcgcccacacacacacacaggcatatggaaccgaggaatcgtacgtgttcatgcacacacgagacgggacatgatttcttcggtcttatcgccaacgttcgctactgagggtgtgtttagannnnnnnnnnnnnnnnnnnnnnnnnnnnctgggtactatataggtgtcgtatggggtgtttgaccactaataaaaaaactaattatagaatctattagcaaactgcgagacaaatttattaagcctaattaatccatcattagcaaatatttattgtagcaccacgttatcaaatcatgtaccaattaggcttaaaagattcgtctcgtaaattagtcacaatctgtacaattagttattttttagcctatatttaatactttatgtaaatattcaaacgttcgatgtgacagggtaaaaaattttggagtgggcctgtttagaagagctttagattctgacaagcagctgtctggtagccagcttctgagaatctggaaaagctctgagacccagcttctccagcttctggtttcagaatctataactacagattctcagaaactgtggactgtttggggcaacttctagccgaagcggtttttgagaaaagctatagctggggcaagcttcccaaacaggacctaaccttgaccagccccaaccccaagccgttacaaagtgaggctaaaatagcgtctggtcggccagagaccgctgcacgctactagattgtggtcttgctgttagccggttgccatccaagtgttgcaagtgcgtcgtcgtgggagaagaggggacctactactactactgtacggatcagcccttcctcgggagcacaatcgaggacgacatggatctctctgtcctaccatccacaccctacacgaccgtccacctatgattgggctgtgtttagatcagggcgaaaagttttagcgtgtcacatcggagtattaaacgtatactaataacaaaacaaattacagattctacatataaactgcgagacgaatttattaagcctaactaatctatcttagcaaatatttactgtagcaccacattagcaaatcatggagcaattaggcttaaaagattcgtctcgcaattacacgcaatctgtgtaattagtttttctttttgtctatatttaatactctatgcatgtgtctaaacatttaatgtgacatgctggaaaatttttgcggaactaaatatagccttggtttttgccgtattttaatcatttggaagattctttagctttaattattttccatgtgttttgtggatgcctactgtagctttgcatcaaccaaatttgactaataattcgatttcgagtgcaatataggtccaatcactatataagtcacttacctgatctattttaaggtttttctagtggattttaacttcaccgtctaatcaccatccaacggtatatatacaagttagtcttttttttctttttcttttctttttcagtggtggagttggctccctggctgaccgagcaatcgtccagctctatcccgggagttgctattgtttatcagtgaaaataactataaaaattaatcgacgatcagaaaacattttttgtcacccaggttctagaagaagccaccttgcttaggaagaagccatggtggagcgcagattgctatgctagcactcacatggttttgtgagagggggcatgagctcgctggaggtggaaaaacaagctctgttaaattccaatcgaaattccaatatttgtactttcacgataattttttgttaacatgttgtcttccacaggaggttgccgcgggcgcgttagcgggaggagggggggggggggggagacaaacgtgaaaaactactgcctaataactgtgaaaaatacaagacaaaacatctctcacccattaatcctgagaaagctaaatatgtagttgtaaacttaaaaactaccgtaaaatagaaaatgaacgttcgagatttgttcacatcgccatgattaaaactttactcttgttagattaatgggctacacccaattaaatcctaataaattccattagcccacattaagtgctatgggtaataataccactgtagaaatctaagtgaagaggtctcaacttaaatatggagctagttgagagtctctgttgaccggttgagatggtgcgtggacagccagccggggcgggacggggcgaggcgaggcaggctacttctctctctcgttttgtaacggacggtaataacgtcgtgaattgattccgtcttgtaacgggcggtaataaaacgccgtgaattgattccgtcggttatagaattaaacgtcgtagaattgattctgtattaacaagtgtgtcggttacggaattaaacgtcgtgaattgattccgtcagttacgggattaaacgtcgtgaactgattccgtatcaacgagcgcgtcggttacgggattaaatgccgtgaattgattccgtcggttacggaattaaacattgtgaattaattcaatattaacgagcacatcggttacgaatttaaacatcgtgattgatgatcccaaacgttactctcgcgctcacatatatatactccgcagcgactagaaggaagaagataagttcttcccgacgtctcttgcacttcaccggttcctcctcctctgttcctccttctctgttcctgcgctgtagaatccttcaccggttatgttcacctgcacgcaaggaactccgtccgtttgagaacctgcacgggtaggcgggcaatcatgtttttgggtaacgcttcaagcgcgactgctctggttcttcgacgacaacattgcatcttcctctacttgctttaccatggtttctactagagagaacggaggaaacaacatcaacggagccaatacgaatgcttcaacatcttctgcaccgttctctgggtataaaattgaactttatttgattttcttcttgttatttacatgttaacaatgttatccataggatttcaatcctatgtgaatataaacgatgtctatgcttattttaccttaagtatgctcatgtttacgtttagtctcatcgctagatcgcttctaattatgtatgttatgattattctcttaatattttagattaaaatatgctgagttatgattaaattttcaacaactcttaaatttaaccatcaataaaagttttaatagaagttaaagatttactcgtagtaacgtgacaaatttcaaatgtccatgttaaaattctacggtagtttttatgtttccggcatatatttttcttttaacgggagccatcctcctatcctacctagcatgttttccctttcctagcctctcatagtcataggtgggcactggtagctaggcagcgacgccgacctgtcgccgccggggaccatagtcatcactgtagtgacattgttggacctcttcaagctttgccttctcccctcctccagtcctcttctcagatattttcagattttttttttgttgacctactagtgtgtaaatgtttttgggatagtactccattttcgaagaggagaactgaacatgtcactagactcactactccgtagcaatctacggagaagtaacaatgagggcacgtttggtacagctccaactcctaaatttaactccaggagttgggtctggagtggagttgtggagctgcctaaacccagcttcacaactccagttcattttatgagagagctccacccaactccactcccagttttggtggagctgaaactgtttggctgagctccagctctaggaggggtgaagctggagctggagctgtgccaaacaggccctgattgatgattagtcaaacaaggcggcagatactttgagatgttttgtgcgacacacagcaacagcagctggaaatatctcttgaacttatcgataaatgtatggtagtaataagttgctaactatctaccctttcctgtctaaaatatgacaaaccagtactgtattaaacataatttagtattacaaatcaagatttaagtattagtgttgtttaatcaagtacaatattttataacgaaatgagtaattcgacaaaaaattactttatccgttccgttctttaatataagggacttccgtcatataggtgatagcagaattaacaacatgtgtactatccacaattctttcctaaatacacgttgctttaagagatggagaagcattaatttccccctcactaaataaccgatgtcatttttactagtactattagataatttattgtatttcacagtacggtacaaattgagggcaatagaaacaaaaaagacaactacgattctttctctgcacaaaccaaaaatgaactcctgctacgacctcacaatcgatcggctcatcaatagatcgagatagctaggttggccatgaacccgttctgtccccagacgatttcccagtcgacacagatcgaatcatcttcaaacaagatttagatttgaacaaatcattatccccaatgcaaaccccattcattcattcatgcattgccgacgaccaatcaaaaatgccaagttgagcctcaactttggcccggtctaactacttgttggcctcatatcacgcatgcatatgagactggctaccacatcgatcggtaaccaccaaaccagatattttgttgctacacatctgcactgcatgctctgctctgcaccctacgtacacatccccttcctgatcgatcactcattagcacaaccagctgcttcatcaacttgcaggtaatcaatagtgacatgcaactgcaaaatggtcctgcagagtacgcttgtatctgcaccatgacaattatattgtaacacacacttgacactttcattgatccattcgttttaagttgtttgtcgtttcggctttgttctaaatcaaatatactacttcctccgtttcacaatgtaagtcattctaacatttttcacattcatattgatgttaatgaatctaaacttatatatatgtctagatggaaaatactagaatgacttacattgtgaaatagagagagtacatatgtctattcgtgacaatcaacttctaaaagaaattgtagtttaacaataggtaaattatatattatgaaagtatttctcaagataaatataaaaatataaatcttacaatgttagaaattgatatcgaagatacaaatgtttgtcttaggacgaagttagaacaagtaatttaaaacagttagggtattaagtatgttgacatatactccctcaatttcaaaatgtttgacaccgttgactttttagcacatgtttgaccgttcgtcttattcaaaaaattttatgaaatatgtaaaactatatgtgtacgtgaaagtatatttaataatgaatcaaatgatatgaaaagaataaataattacttaaaatttttgaataagacgaatggtcaaacacgtacttaaaaagtcaactgtgtcaaacattttgaaacggagggagtatatgttttgtacttttgtaagtaagagtacttttgatttgttaatgcaactagcattagaggggtgatgcatccagatcaacaaagtgacaccaaactattgttgtataggagtaagagtttgactaggtacacttgaatttgacagaaccctggccggcaaaaactatggaagcatatgcgaattgcgcaattggataactccagataagaaagcgaccataataagtttaacaacgccactgttgaattagtttttgtcaaaaagcacatcactgctcacttgtcaagtcgacaagtcatcacttcatttctaatttttcctttttctttttgtttcttttctagtattttgaaatgaattgtggatggtgacgtggaacagaaaagtcacgcgctgaaaccgacgtgtaccaacgggaggagctcgacgtgtaggccatctggaatgatggaagaagaagaagtgacttctggttgggtaggcaaaggagttgctgctaagtaatggaaggggtgtttttgtaattttacaaggcggttaggacaagcaagatttggacacctgtcgtgtcctatgctcatatggtattaaaatatgttagttgaaaatcataatctaatgaagaaaggattagtttatggagtactagggctcttggttgccatgtggagtatttcagtgagtagcaagtgtccagtttccagtgagatggcacccatggatttctgtctcataaaaatgcaattaaaatttttgtactgcctcattcaatacttttatcctttttagctaatctaaacacaaactaaagcgtgacaaaagtagaattctctcttattgaaaaatgtgagtaaactttgtgattggaaagaagtcgtacaaaattggactgaattcatatgccatctgtatcaatacataaaccggttatcaagacacatttgtaacgataaaaacaatgtacagtacgtactagaaacatttcttggatcccatttcaataatcattctgacaaggaaaacaaccaaatgggcacaaacagtttcgctttcttgatagccatgtcgcagccacagctttgtttgctagaatgagacacccctgattcctcagccacatacttagattaagaaactaatcaccttcctcaatcttggttcctaatccgctataaaaagcagaggaaagcagaggagacaggcagagcagaggagagaaccccaccttggcaaaaagaaaagaaaaataatatcatcgcactttttgctgcccttttcatcccctcggatattcacgaagcaaatctctctgcaattcttttcttttttttttttgatcttgcggatcttctccattgaggaaaggcgagagctttgggatcgattccgggccatggcgaaggaggtggatccgtgcgaccacggcgaggtcgtcgacgccgggtgcgtccgcgccgtgctggccgagctcgtcctcaccttcgtcttcgtcttcaccggcgtcgccgccaccatggccgcaggtaagccccgccgctcgccgccgctcccttctccggtcgattaaatattttcgttttttttttggttaaaaaatggagtttaattttgggttggggttaggggtgccggaggtggcgggggcggcgatgccgatggcggcgctggcgggggtggcgatcgcgacggcgctggcggcgggggtgctggtgacggcggggttccacgtgtccggcgggcacctgaacccggcggtgacggtggcgctgctggcgcgggggcacatcacggcgttcaggtcggcgctctacgtcgccgcccagctgctggcttcctccctcgcctgcatcctcctccgctacctcaccggcggcatggtaagcacccaacccgtcaccgccgttaattctttctttctttctttgcctgtcaaaattaggatccgtgaaaagaggaggaaattttttttatttgggggtggaatcatgtcgttctctcgatttgtccgtggccatcaacttctaaatttgtttttgttagctttttttgggaccagatgagatgctgggttaatttactaataattcacctgataaacttctgtgggtttaaggttttatagtagtaattgttgaggaacttcaaagattgtcaggtttttaatcctgtgattcagttggttcagtttaccaaaaaaaaaaagactttgctgaaaaccattagttacaagcctttttaaatcagttttgtgattcagaactgtgagaattctagttcaatctatagttttgttttcttatttggataacaactgccgattgcttcaaccaaagtcaaccaaagtcgtataagatatgaatcattatgctgttagtgactctgatgaacttccaggtttgtattctgctttagtgcctgaagtctcaaaaaccctctagagtcttggtttgtaaagcatatgtatcacaaagttagtacaagttagccaagttaaacacgctgttagcaacactgacccttgggaattggaatagctggtttaaaaatacaagttgaagactaacataggcgagaccaagtcacttgatcgtactttccggttagtccacatagatacataagcaaattcatcactcctaagtataacaagttcacacctgtgctaaataagtataaattaaaggccacatcaccatctggttttctgttcttttcaagcatcttgtattcatgtgtaagctgaacacgataggtatcttcctcacaatctaaccaaactgtcgtaatgtgcaatgcaggcgaccccggtgcacactctgggctcagggatagggcccatgcagggcctggtcatggagatcatcctaaccttctccctcctcttcgtcgtctacgcgaccatccttgacccgcggagctcggtcccgggcttcggcccgctgctcacgggcctcatcgtcggtgccaacaccatcgctggtggcaacttctccggcgcgtcaatgaacccggcccggtcatttgggccggcgctggccactggagtgtggacccaccactggatctactggctcgggccgctgattggcgggcctctcgctgggctggtctatgagtcattgttcttggtcaagaggacccatgagcctctgctagataattccttttagtagtctggtctctttagatggtttcatttgcagaatgcatatattgccaggtagtaataagatgcttgtgcagcttgtaggcctgtaagggctgtataattattattttctttttgccctcgaggattttatcaacgttgataatcagccatgtaaaaagattgtttgggatatgatttttttgttagtataaaatgtagtccggtagttggtctgttgtaaatcggcgaatgccatgtggttttgaaattagaatctatgtaaacattttcaaatgaattcagtaaaattcatttcaaatgggtatcaacttgacctcaagctcttcatatatcatctaaacaaaatgctaactgttatggctatgtacacctagcagcatagaaacacaaggagatccaagaactgaaaaaatcaatggctcattgcagctattatctgtgctgccagtgcaatatgcatacctgcttgcttggcccatcaatttggcccaaaactgttatgatcataatgaactcaccacattcatggagttgactgtctatgcgccagtttcaactgctatcttacttcaattttaattttggtatcgggtatcgccaaaaattcgtaaggtataaaatgctatttttccaaacaagtttgtaatggagctgaagaagtggaacgactacgtgccgaacgtagaacaatgtcggctgacttatggaagaaccgtgtcaaaacagcagatcgagcgcaaattcaaggctggataacaaaactgaactagatgatcacagcgctgctcacccagaatattcagacatttctattcatacgctctactctttctttcttcttctttctttactttttacctctgtattattttatctcctccttcccttttttaaatggccacttggccttgtaaaccaccgatcaccattaatacaatggttataaggtagagcctctctaccttttacctaaaaaaaaatatggtgtgcagcaaatcctcgctagctcaacgctcccaccatcctcaccttcattggcaagctcagggctatctctgtcaacggtgcctcaagctccaccccccacatgccactggcttgtggtcccactgccgccgccgagctcaggaccccaaatggcgttggccacatgttctcgcgggtgtcgccgccaccggcgggaagctcgaagtcttctctgacgactagcggttgcttcgacgacggcgtcatttgctcccctagcgacaacgtcttccttccacctaagttcatccgtgacacgtgatggagagttcttccaacgtaggtataaaatggataaagagatcaccacatacgcgtcttggaaagcgtaagaagtatcgacgcacgtcacagtgtccgcctaatagacggggcatgttggcatccctaagagcaagtttaatagtataggcaactactagctacaagttatctatagccaatttattagggttatggataccacatacctaatagtagttgactaaatcttggcaggacccaccacttaccatgtcctatacggaaacaacctgcggatataggaggagttccggataagagaagacaaccagagttctatatggaaatgacaagtactactcggattgtatccatattggtttccctagttctacttagacaaggggacacctatgggtataaatacaagaccccctatgaggagaggggacaatcaacacccaccactatcaactaacaatagatcaatatacaagccaacatacgccaagataagacgccgaatatcgacttcagagataggcacggctagtcccctacggtgtctccggatactgataggagagacattgcgctgtctctgatctcgccgggcacggattcgaggaggaagactaccctgttgtcgactacgagtcagacctacagaccgccaagtcgacaacagttagataggctaccccaaatattgtattggtgtgattatggtgaataaaagcaataccggcttcgcccaacaggatgtagggttattacctgacaattcaggggcccgaacctgtataaaaatccctatctctgtctcttttacctcagtctcgcgtatatcctaataccgacgatccccataccatgcaaataccggaatcgtgacatcaaacgtcgacacaatttaatagccaattcatacaacagttgcttataatactattaatatttggtcccatgtttcatccacacattacgtcttagagtccgtgctgcaactggttacagatctatataccgctgctcttctatctgctcttttatctctttaaaatatgtttatagttggtttatagtcagctattgtacctgctcaaagccgttcgacacgagttgcaggatcggacattcagaacaaagcattttcatgaagaagtgggtttgtgttgacaaatttatttatcatatttttatcttgatctgacgacaaataaattccattattaaaaaagaagagagaatcccttatatgccactgaaaattagtctgatcccttatatgccattgaaaattggctcttcccttatatgccattgatccaaatttgcacaccctctcatgccactcccattagttgaccgtgtgttgaccaataaaaatcaaggaaaaaagatgtatttacccttataagtatagggcatgcccaacaactcagggagagcatatatgtcttttttactttagagttaacggtcaacaacggacaactgactattgtggcatgaaagggtgtacaaatttgcaccaatggcatataagggaagagccaattttcagtgtcatataaaggatcagaccaattttcagtgtcatataagggattatctcaacaaagaaatacgtagtacattactattccgtttcattttatttctgcagactctagtcaacaaacttatggtcgtaatttgcttttagagcgattttaccggtaggtagtattacattttgtaacgtaaaatttggtactagtacgatacatcgaggtatcacctcaattacagtaaaatttctcacatttttaagatcacaatcttcaatttcaatttcaagtcagctcggagcaatccgatcaatggttgacgacgtcgcagcgcctcctgatctccccttcgtctccggtgagcaccccgctcatggcgagcttcacgaacgccgacgagaaggcccggaagaagcggcgcccgtccgccgcgaaccgccgcacgtgccccgccgtgcgcgcgtcggcggcctcctcggcgtcgacggcgaagatgccgcgcccggacgccgcattccagtagtagaggttgtcgaaccagctcggcgtcgcgtcgctgaggacgggcacggccgccgccaccgcccgcggcgcggcggcggggcacgccagccggagcgccgcctcgaacgcggcgtcggagcgcccgcgcccgcgccgcgccgtgtcgacggttgcgcagtggccgccgccgagcgtgtggccgccgaggatggcgacggtctcctcgacggtcatgcccttgctctggaacatggcgagcgcgccgtcgatgccgaggaagctgtccgggagcatggcgtcggcgcgctccgcgctcgccgccgtggcgtccctccggccgaggggcacgccgcggatgcgcggcccgccggcgtgcgccacgggcgaccacgccgcgaggacgacgatgtcggcgcacgacacctggccggggcacgcgcgctcgac

SEQ ID NO: 59149 - DNA, 14700 bp, Oryza sativa
tcaaaatcaatttattttcctgaaatttcctcaaaatgtttatgcattttgagatagtaaaccatgcctcgaacatatgatcgactttataattatgattttacgtaggtagattttgatgatcactaatagaattcaataatttttatgatctttttatgctgtgtgagtttttattagttcatatgtgcttttgtttattcaggtgtgagtttttgttgagttagtgtaattattggctgtagcctctttgagtaaaggccaggattatattccattatcttaaaaaaaaatcaacagtgtgtattggagacaaatatattgtcagtacgtacctgaacttggcagtcgtggaagaagaggcggaggagcgccgccggcgaggtctggtcgacagcaaacaccggcgcgagggccatgtcgacgacgagctccagctgggggcacgaccgccggtagtagtcgccggagaggccgccggcgccggcgccggccgccatgcctgcgccacctggtcctggtgctatcagtacaagtagcgttgcaagcgcaagaaccgagccagttgcaacgctaaccattgcactaatactagtacccaatgtcttagcttcttaagccttcactaattaattaacttcgatatcaagtagaggagttgtgtagtttcgttcgtgtgatctacttttcttatttatatatttgtctctggagtgataggagtaatttataggtcaaataggatggtgatgggcatggaaaaataattcaggtcatgtcttgcatatgatttaattgagtcagatcagtggatgaattttgatcgaagtgatgctaggggacttgtgtcgcaatgggagatttttctattatcaagaggttgctgcctgttttgcacaagaaatgtgactgtgttttgcggatagtgctaaatcaagatcgttaaacattttggtttaatttgttagctagtattaattgaaacgccgagcaagaagctacccactttaattgctccagaaatgggggatttagacccagaaaattcaaaacccggtggtgcgaggaattggatttttacaactccactgccctatactcgtttacttcgtcactactcagttatcaacaacaaaagctattaaaaaaatcctgagaagaattaacgtacaacattatatagtgtaacgtcccgcctcccctaggccggaccaacatatatcttttctgcacactttgtcctcactcatgtgcacccgggttcccggtcggtcacccatcccaaattgctccaggccaagcacgcttaaccctggagttctttggagattggcttccggaaaagaagttgcaacttattgatatgagtattctattaatcctattaagccctaggccgggatgttacaccctcacccccttaagagagatcgacgcccgtcgatctaccctaggctaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgcctcccccaggccgggcccacatacatctgatagctttcataggtcatagactgccctccaccctcacccccttaagagagatcgacgcccgtcgatctaccctaggctaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgcctcccccaggccgggcccacatacatctgatagctttcataggtcatagactgccctcatatcttttctgcacactttgacctcactcatgtgcacccgggttcccggtcggtcacccatcccaaattgctccaggccaagcacgcttaaccctggagttctttggagattggcttccggaaaagaagttgcaacttgttgatatgagtattctattaatcctattaagccctaggccgggatgttacatatagcaggtgtctaccatgatgcaaaatttgaagttaaaaagtcgatctacacaaggagaagcaaaataaatatatattttttcaaaatacattacagacagaggcattcatataaattaacatatatatatatatgcacagattatccctttaagtacctcacaataccgagccggtatatgttgagattcacgaatttatcatagcatctatgagcacttctgaagactaatccggtatctcagattcatgagtcaccatagtatcgacatctatcgctgaaaaaattccttttctcctatgtacccttctttttctttatgtaaattcttctgtaaatgtttttctcaataaaatcaccgtaggaggctaggagcctctcctgctgtttttccctaaaaaatcgctgaaaaaaataattaaacgtaaatacaattacatgtgccaagtcttgctaggacttgaacctggataggtaagttccaccaccatgtgaaaaataaccaattgaactacgcaaacttcatcaaaataaataatttgagttatgttttttttatgttgaggtgtgaaaattgaatttagtgttgcatacataacaatgtaatctatgctatgaaattttttatgaccattcagatgacatataagagataagttatttgtgttgcataaacaacaaatgcacttaagtactggctggttttaatgtttgacattattgacttttgattgaatatatgttttaccattcatcttatataaaatatatgtaattgttgtttattttgttgtgatttttttataattaaaggtattttaatcatgtttttttatatttgcatatttttaataagacgattagtcaaacgtatatctcaaagtcaacgacgtcaaacattaaaaatggaagggagtatatttttagaatttaagccactgctatttaataggagcatttttactgtttttattgcttttaataatgtttgcactgcattgttgttatttttgcaaatttgcatacaacattggtactacccccatgtatttaaacagacaaaaggctacccttggacccttggtccaaattcaccgaaacaattttaaagaaggaaaatccttttttgcggagaaaagaagtgatatctgaatgttcagtattaaaatatggttaaattcgctagaaagaaaacgaacaacccgctctgttgtaattccaacagcatctctacaaatagcattcaagatatatacacgcaaagtagttctgcaatgtgtgctggggcccaattgctatatgttgttatcctctgataattagctgagttcggatgggggagatgggagcctaactcctgtgcacggaaaacggagtggtccattaacacgtgattaattaagtattagctaatttttttttcaaaaatggattaatttgatttttttaagcaactttcgtatagaaactttttgcaaaaaacacaccgtttagtagtttgaaaagcgtgcgcgcggaaaacgaaggagaggggatgggaaaaggtgcatgcgaacacagccagaatgttgttgcaaactgcaaccagtcatatgatgatttataccaacacttgatgaaaccaatttgtgtagcgtattgcgtatgctagagtttatataactgaacctaacactattgtcagtttgccttttcagctcttcagtaaagtcagtttgcctcacatcatacatgcagaatggattggttttgtataggttattaatttctcattccagttatgaatgcagcatgttctatgggcatgttatacaaagctctaacttcaaagtttaactccaggagtttagaacttgagtggagttttgaagcttctaactcttttattttatgagagcactttagtatattccactttattttttgggtggagctgaaaggtttggctcagtttcaacttcgggtttcaacctcagaagagatggagttggagccgaagttctgtcaaacacatcctatatacatattgcacatatatatactactgtcaagtagttcctccaaccatatctacggcaccaatttttgcggtggttgccatatcgatcatgtacatggaatgaccaaaacaaattctttagacgacgctgcatgttagctagctcgttcagtcgttctagacttgaagtttccagttcaaacagactaccaactagtgttgcatggctttcacttagctagaaaaagatcgatccggccgtcccaatccaatcctggctgctgataattaaattaagtaggcgataggcagatggattatggataccacatgcaaaattgtgatacttgtgagtgtcgatatgtgactactagcctgcgagcaactattcagctgaactataatatcttcttcttacacccgactggataacctgaagtgtgtcactagtacaataacgattttttcgtgtggtcgaaagcagttttcgcatatggatcttccacccgtcttgaactaagtgtctgtgaaaatccgattttttttttcgggtgacgcacccgcacgcgaaaatcgcaatttttatatgcgggcgctttagcagccctggaaccccaatctagccgccgccggcctgcctgaggcccgccgccgtcgtctcagcggttgtcggtgacgaatccagacgcctgaggctgggataccactgccgccactgccgtcgtcgtcgccacggtggctgacgacggatccgctctgtcgccaccaccctagctgatgccaccgatgccgctgctgccatcgatgccgccgtcactctcaccaatgccactgccaccgtcgccgggagtgggtagagggggagggggaggggggagagggagagggagaggaaacgggagtggccgagcgggaggatgggaggagatcgagtggcgccgggagctaaaagggtgggtgggctattttcgcgtgcggatctattaagaggcccgcttgcaaaaattgattttttccgtgtggtcattttaaagagccgcacgtgaaaatggagcacgatttttacggacgcgaccacttatggtccgtctgtgatctaaagtgagtcttgtacaggaaaatcatttctgtactagtgtgtgctccccgcgtctctccactcaaggggcgacatgtgttaaatatgtgatctgaattttaggcctgcaatatattcggataagtttcctaatattttaggcttgcaatatattcagattagtttcctagtatgactcttgagttttttcccattaggacttctagatttctcctatatataggaaacggatcctctattgtagagctaatactgcattggtgcttgtagcgatcaaatcaagccatccgattagattaagcagctctgattccgtccctatatatatcccttggaagctgtatagggagggtgcgacagcccgatgtatcacctgtgtttgtattcaactcctctatagtgatcattgtcggtcggcacccatggttttttccggcaagggttttccacgtaaaattcatgtctccattgtgcatctattttcctaacaacatgggcgccacccaagcagacaccggcccagctaggtggatgcaaggacggtggtggcaaggctctctcccctcgctcgtagagtcgtggtcaatgaggctgagtcgctgacgagactggactctggagcctgagggcaagatgccagtgtccagatccggtgtcgtggagtccggacacgatccccccatggccgaatctagtgctcccacggcggatcgagctagatcaacggcgcaacggcaacaacaacttggagttgaggcggagctaggacatgcagggacggcggtggcaaacatggatctggtgagggggatggctacatctgtcgtcctagcgactggcagtgatggcgacaatgatgaggtggcggcgtgcggccatggagaagacgatgcatggaacggggtggaggagggacatggctgccaaggcgagccgaggtggtggagtgcggccatggaaaaggtggtgcattccctagccggcggccatgggaagccggcatgggtggcgccgggaggttggtgcgggcggcggcaaagaggtcggcccggccgatggcgcaaaaaaattgaacatgatgtagaaaaatcgtcgaaaaaagtatatcagttcatccatagagcatttaaaatcactcaacaaaaaatggtgcaactaaaaccgagatattttttctaaagcaacataaatataatttcctgccaaaagataatacataaatctaaataagatcatattttaagagaaaattaaactttgtttcacaatttagtatgcaagttctgtttgtacaatttgtcactagtacttatttaagatttttaattccgttatcatttttttaaaattcaagtacataacccatgcatgaaattgcatttcatttttcaaaatgtcatttaacataaaaaaaatatagagaaactttcagttgcacattcgtgtatgttaaacctaaatagattgggcctgttaaaaaagtcaaggctagtctggcacaaaattttattttatacatattataaaactgtttttttttctgtggaccatttaagctgcgttcgaacttattagcatatgattaattaagcattagtttttttttgaaaattagattaatatgattttttaaagtaactttcatatagaaaatttttgtaagaaaacataccgtttagtagtttgaaaaacgtgcgtgtggaaaaagagggaagtgagttgggaaactatactgccgaacacagccttattctgcttatatcccacaaaagtaatctagattgtatatactatatagaataagtggtaaatttgaagcattttttattcatttaggattttttttaaaaaaaagatcaacagaattttcatccttaaaacacaatgatatgtcatcaaaaactaatttgaatctggtgaaaggataaaaagtaaatggtatggaaagttcagggctgagcaatatccaattttaaagtttatggatgaaatttagacctttgtgaaagctcagaaatgtaaaatagacctttttttttaaaaaaaagctacagagtatatgacttgtgcatgttataacaaacctataattttcttctcacaaaaaaagatctatagatttgctatgatctgggcatgccataacaaaaatgctatgaataaggcatgttataacaaaattcatgagaaatactggccacaatacagtctcagtggtgatggggaatgctatgaggactaggtgacaaacatagactcttccaatggccccagcctcccatcagaacctgtggttacagatagccagaaataatatccaccagctgctgctcttctctatgctctgaaagattagaactgggaggcttctaagcagcaccaagcaggaactatgcctggcagcatccatgtctcaggttttttttttctctgatgatttttccattcacatgagtatctgaagaaagcacagaatgactttgttcagtatcttacttctcagctgctcaatcatcagctgccacagctccactgttcttgcaaggttaggtctcctcaaatcaccatttttttctcacttacattactacgattttgtatataaacaacacgatggatgcagttgtattgggcaagagagagtacaacggaagcataggacaaggggaattctcattgtgagttctgcatttctgcttattttcatcaagttgcattcaaatcccccttgttttatgcaaagaaaattttcagcatgtctcacactaattaacggagtatatctgtatatgtaatatgtgcgtagcccagttacgtcacttcgtgagagcatggtgatgctgctgtacaatgcagatagatcattaatatcacaagcaggtgtttttcagttagttcattgttcattttttctacttagccagcacaaatatgaactgctgcctgttttaactaataacccacaaatcaccacagaactgaagatgaaagcagttgttgagtcaggaactatggatgttgattttagtcttgacaatggaggaagcattattctaaggctgcagttcctactcagtgatgaagatcgcagacgggtccaagaaatggtaatgtggttctttttagggtattttcatgttagttcaaaccacaagtcctttttaattcattattataattccatcttaatttgaattatctagcttgtgtttatactgttttccctttattcagaggaactctgcagtgaaaagaaagcagcaagagctgctttctgatggttatgtactttctcaaggtaacctgtcaaactgtgttcaaattatgtctcatttttttgttgcaaacacgattttagggatctactgaacagactatatgcttcagatgtgccaatgttaagcagttaatgtcttagctaataagaacataatatttaatccacatatattagtatttaaatatatgtgagatgttgtataagttcccaaatatctgacctttgctgtgtgtagtgtacaattcatcaaactcgtatttaggctgtgtaactggaatgctaatgtctgaaatttaatcactgataaaatgtacaatttgtatggataactttcttttcttataggtgattttgaaaattttcagacagcttgttgtctaaacaagtcgaaaatatctccaacatttcgagagaaggagatgaatcttcagttaggaagagcatgtcactggatgatttgcaggagaaggctgttttctctgcaattattgtagatccccagatgaaagacacaaaagaatcaccggagcaaagtggatcaaatagtgcagtgcagaaaatgataagtgcctttcaaagcagctctccacaggtataatacttgtatcaatagatcaataatgcagggcaaaaccactcctaatatactccgtccgttcataaatatttgacgtttaggatattttgttaaatttttgaagctttgatcaacaatagtttctcaaatgcttggtttattttattgttctaaaaaaaatgatatgcacatttttgacttgagtactatcatagtatcacaaattcattagattttatgaacttattttaatacaaaatggattgacaaagtttcaaaagtttgaccaaatcttatcctgaacatcaaataattatgaatagaggaagtactagtacaatttatctacatagtcttccatggtcttgcaggatctgacgcggatcaaatcagaaagctcactaaaagggctgtctgcttcttcagagaatttcacccagtcttcttcagacaagtcatctagttcactagcaacccaggatgtttcaggccacacagaggcaggtcttgtggctgggacatcaggcaaaatgcagcttcctcctggtgacaaaagcttcagtaacaaaagatcaaatgcaaccgagcaacaggccgttctgtcaaccacatctgaaggcagaatccgtaggctattcagagagaaggacctcgataattcagagatggtgatcacagtccaaaaccggagcaagaagcggtcgatgccgaagcgtcgtcgcgccgccattggcccttactctcttgaacacatgcatccccatgtctgcatcaccactgcaagcaggcagctgagagagcttgttgagcttgagccacccttggattcgtttgtgtttgtaggacaagttgatatcaagagaccaaatgtgaggggaggagctagcatgcaagatcaggtatgattatgagagaaattttatgaatctagagaaagtatctgttggtactaaaattttaatgttatgagtctacagaaagtatctgtcggtactaaaattttaactaaaaaatttgatgcctcgagacactagtatctggagatatcaagttttacattagaaaatatagtacctctcgatgtcttctccaaaatgataaaattatccttaaactgatagtttcagcttagcctgctgatccctgaacttatgcactcccatgccaaacttgtgaaatgtgaagcagggcacaagcgacagtaaaacgaaaaatgagatggtttctgctcgaggtgatgatcatggttttccaatattggatgggcggttgattaatcaggcaagtcagttgtcgatgtgtgctgacattttctcctctttttctttcccctctctgactatctgaatttatgttgtgcagggagtgcgtgttgtcattgtgatcatagcttgcggagcaatatttctgaacaacagataagggtagcaggacatgtacatttagattgtgtgtgtgtgtttttctttttcaagtttcagtaagtaatgcaactgctatacacctccatccctaaaaaaattaacttccgagaatgaatctaaacaacaaagtgaacaaacgtgtgtccgagtttatcttagaagttgcctttttttttttaaggacagatgagtaattcttgtgcttgcggtggtgtgccgtatgcattgcagcagttgcgttttatcaggtttggtgttttttttttttatctcaaaccgtgctctttattgatatgttggttcagtgtaatcacgaaccaccaaagaccttacaaaacacgggagggggtcagtccaaatggacatctgacccgggtcccaattagcccctcgacgagccagttcatgagcacaactattacaagatcgataggcgaaagacacatcaacctttacaaagtacaccaaagacatcaatctgatttgcttgaagatgacaccagccgtagcttgatcataatcagctgatttgagagcttgcactaggacagagcaatcagtttctactgagacatgagaaattccgttgtttgctgcggcgcgcagagcataaagacatgccgtagcctctgcacacaaagcatcatgcaccagctcaattctcccagctccagctagtggtcccgtactacaaatccccatccaccggtcttgccttcatcaaagaaagccccatcaaaattcagcttcagttcgcccaggatagggggatgccatttcctctgcgcttgaacgtttggtcgagatttggccgggctcaacagggaagtttcagaaaccatcctcatgactctgtcatacacttgctcagctgatctgcgatcttccccagcgtttactttattccttgcatcccaccagttccaaagaaacagcacagtggtcagcattttatcctccttcatattcagaatatgtttgcacacatccaaagcagaactgtactgcatcagctctaacctgatatgcttcaaattcatcactctccagccagctttaacatatttgcatttgaagaagcagtggccaccatcctcattcagacgatggcagacagggcatcgtgtgtcaatctccatgcctcttctgtcaatgttcatgcgcagtggcagggtattgtgggcaaaacgccagaggaagtgcttcaccttcgggaaataatgtagacgccatagcttcccccaatccaggctcgccgtgcgagcaacacccgacgaggattctcccgtttgtcgagacgctagatgctctcgctgatcctctagagtatgatatgccgatttaaccgtgaagatacctgccatgctgcaaaatcttctgaccccatattcagcggtatagctaggatattcctcacatcctcctcccagaaaatatcctggatcaattctttgtcccattctccaagtctgctacccggttcagtattgtgcctcctcttggagtaattggccgtcgggttatacctgatggaatccaaggatccttccatatatcaatttcagaaccatcgccaacccgccatatcagaccagacttcagcgcctgtacaccacgcacgatactcctccatgaataggaaatacctgggccttccttcacctccaaatctggaaaatacttagcttttaaaactcttgcacatagagagtctgggttggacagaagccgccaagcctggcgagattaaacggatgcaggtctctgtaacccagcccccccttctccttccgactgcacaacctatcccaggctatccagtgcatcttattttcccgatcgtgttgcgcccaaaagaagcggcaaatgagactgctaatttcatcacacaaagtttttgtcagatcgaaacaagacatcgcgaaggagggaatcgcctgtgcaaccgccttgattaaaatgtccttcccagcccgtgacaaaagtttttccttccaaccttgaattttcctccacaccctctccttcagataactgaaggtttttgattttgatctccccatatacaccggcaaacctagatacttttcattccatgcttcaactccaatatccagtgcccctctgaacttctccctgtcattttccttggtgttcatgctgaacattactgaagatttctctttattaatggtttgccccgagcatcgttcatacaaggaaagaacattctgcagacactcagcactccgttcatctgcctttaggagtaacaacgagtcatccgcaaacagtaaatgcttgttgacaaaccttcaccccggatagatcacccctttcttctgccgcattcagcagggacgagaacacctctgcacatagcaggaataaatatggcgagatgggatccccttgacgcaggcctcttataggaatgatctgctcagtataggtttggtgttttttttgtcaggaataaaggacagggacttagattgcctgcatcgttgatgttttgtagtttctcatgtctgtcatactactactactagtacactctttttgttatatagagaggtcaatcgcacaaatatatatgtacatgtctgattgtttaggtgatgtttggatccatggacttaactttaatctctgtatttagacactaatttagagtattaaatatagactatttacaaaactaattacataaatgaaagctaatttgcgagacaaattttttaagcctaactaatttataattagagaatgtttactgtagcaccacatagactaattatggattaattaggctcaatagattcgtctcgcgaattagtccaagattacggatgggttttattaatagtctacgtttaatatttataattagtgtccaaacatccgatgtgatagggacttaaaagttttaatcctatctaaacagggtcttaaacaactgaacctgaacacatctgaacctgaacacatggcaactacgacaaatatcccgctttgcaacaaaagcatacgaatagcgcaacaattaaagaacggaatttactagatttcacgcgtctcaaaatttctaagttttcatctacataaaattgcacatagcttaaattaaaatcgcagtgatatgtaatgtacaactttagatcattactcgttgtatgtagtttgaatactttttcatttatttcatagatactagcagagggcccatgcgttgcaacgggatttgagaaaaaaaatatagtaacggtttcacctcgtgatcaagtatatttgataggtacaatggtatcatcttaaggatgtccgaccgtgttacagcgtgggcacagctaacagctaacaggcgcacactaaaattcatcatatagcctgaatcatctatcgtgtgtgaggctttcatcgttgcttcggtagtacactggagccagacaatagcgtcgtacgtatattatttttgattggaaactcatcttctaaagtaacaactcgtatgtatgtatattgtgctggtactcatggtgatggtggtcagtcctagatgaaaccaaaaattagatgattagcagaaacactaccagaaaaaccattttcccaccagaaaaaccattttcccagatgatgacatttttttctaagtaggtaggcctctcggagctaaatggccacctgcaaaaataacaaccgtgggcgatatcgttgtccgcatgcaaaaatacctcttaagagatccacctgcaaaatagcttaggcatcataaaaatcgtcgcaacagtcaaaaaaaaaaaaaactaagtcctctccctcacctcccacctctccctcaactcctccctctctcccctgcgtcccgtacctcccacgtccctctctccccccacctctctctctctatcggcggtagcggctaccacaagtggcggtggcggctccacccggacgcgactctcgtcccctccctcccagatctggccgaagcggggaggcgggagggcagcggcggcagcagatccggccggagggagggggagggcggtggcgacggcggctccaagcgactacccgtgcagctcccctcccctcctcctagatctggcggagggaggtggcgactgctgctcctagcggcggcggcagcggctttccct

SEQ ID NO: 59150 - DNA, 11799 bp, Oryza sativa
gaaattgctgaggatattccctcggtcgacgcgcattacgtttcgaattataatcctttgatgggttggaggtatggagttcagatggttgcagcaaacatgcaggtaactagtgcaatttatgttatttctgtcacactattaataatggtcttattctgcatgataagcacatgagtcatcatgtttactttttcagttcagcattgcaattgtgttacatatagtggagtggtattctatttaacaaatcacaacttagtttgaactagtgaactgggatatcctcttgcagagttgcagtataaaaggattgtagcaaggaaacattttttgtgtctttttctaaaatcaggtctagcacaaggaaagtactgaatagtttttaaaaaaaaggctttgtgaagatacataatagttcacccactttgatctgagctatctgctaccattcatgttcagggccatggaagaaagctgtggctgactcaggggatgttccgagcaaacggcggttgcggttacgtcaaaaagcctgatattctgatgaacaacgatccagataaactgtttgatcctacatccaaactaccagtaaagacaagactaaaggtaaactggacaaaagctaaatttccttttattaccggaagatcccaaatgtgctactactatttttcatatctgctacagtaactgaaagtctgtaaccattgtgtcaatgctacaaaatctgaaggtgacggtgtacatgggagacggatggcgattcgacttccgcaagacacatttcgacaaatgctcacccccagacttctatgcaagggttagcattctgatcaatctcatgtactacttccgttttttaatagatgatgtcattaacttttagacacatgcttaaccattcatcttattcaaaaagtttcgtaattatagtttattttgttgtgagttgtttttatcactagaactactttaaagcatgatttatatcttatgtatttgcaaaaaaaattaaataagacgaagatcaaacgtgagcccagaagttaacgacgtctcatcttttaaaaaacaaagagagtactacatatctaacaaattaatcgattacctaagatgtactgaaactctgaatgagctgtacacagagaagcaaactctgaatgttcagttcagacttcagacatggcaaatggctgacaagaaaagaaaaactgaaaactactgcaggtgggtatagccggagtagaagcagacacgaggatggagcagacgaaggtgaagatggacacgtggattccggcatgggatcacgagttcgagttcccgttgagcgtgccggagctggcgctgctccgggtggaggtgcacgagtccgacaaccaccagaaggacgacttcggcgggcagacctgcctgccggtgtgggagctccggcgaggcatccgctccgtcaggctctgcgaccaccgcggcgagcccctccgctccgtcaagctcctcatgcgcttcgacttcacctgactactccatcttcttcttcatcatcgtcatcgtcttagtagtagtagttccatgtatgatatcatgagggatgaagcattgatcgtactttctccgtcccgaaatatagcaatgtaggattagatggaaacatcttaatactacgaatctggatatgtcctatctggttctggtttgctatgttttaggacgaatatagtacataaaattttagaagttttgttttaaaaaagaataaattttgtgcgaaacggaaggtgtgattgtacattttgtacgtacattgtttgttgttgattaataaacgtgttaataaaagagggaaggattcttttaatttcaaggtgttgccattgattacatgttggtgttgagccacaaatcattgttaggaatcactcacaaaggccaactaggtaggtgtttaattattttcatgtttatgtacaagacctctagctttcaatatgctgtgcaattgtctttgatctacaagtagccaagtccaagataatttggaattcaattcaatgttgaagctacatccatgcctgggtaatggtttttttttctcccatgtagatgaggttgaccacgcgtcgataagactaagtccaagtttaatagtattaatcttgaggtttcaaaacgtaagtcaaagggaagatagttgctgcataaaatttatgaggacaggaaaagatgaatgtttttaaggcgattctagcgtgtggtaaaggtcatttaggacatggttttggattttttttaaacaaagcagaaatgtcaattgtaagttgtctaaattctggaattcagcagtaagcacatcgggctatctgagggaagctggattaattatctgacatgaatattgaggcctcaagatagctggtaaaaaatgatgtttctatgaagtgacagatcatttattaagagcagaggatgttgtgatgtactcctactcctattatctgaaacgaaaagttggtttaatttagagtagaagctgatctgatgaaaagtgacagatcatggaaaagaaagaactcatatttgcagttgcagtaccattcaattttacggtttcaatgtcaaatttcagccggctcttgactttctgcatgcattgagccggtcagacatggcatgctgaaactgaatagaagaagaagaagaagacaacattgccagccagagataatgctaatctgctactgctacttcatcttctcatgaaaagtggtattaatataaattcatcttctgcggagacttggaagatgtattaattgtcggtaccaaccgttctcaactctgaagttgatgtgttccgctgcatccccaccactaattcatatgaactccattttcatcggccaatcttgaatcttccatccatgttgaaactgtgcttcctgtgaggtaacacagcggattagtcatgcgagataagcagttcatcagaggattagtcatttcttcagtacagaaggtttttctgagtcaggtttctgaattttccagtgaagaagaggatgtccacccaatttctagaacctgaaaccatattctgacggctgtgtgcactctttgggtgcagaagccggaggtgctcccagaataattgtatcacttgatagaattttactgagattaataaagcttccattatctaaaaaaaaatattctgacggcaaagttccaacgatcctgacgcggctggcacaccaattaatggcccaaaatatcaagattcattcatagcctattagccttgagaaaaaggattccatttgccattgttaagatgacaagtagagacagcaagtggcactcataacgtgtagaaaggattcctgcctggatcatgagagattccaaccaagactggttgtagtgcctgtaattgcacgcaattcaggaccagtattactctgacctgctcttcattcttcagactccagaattctcatgcacgttaattcttgggttaatcctgctagctgcctagctttgtatagtactcatgtattaatatgctgtgctggggttcatcaatactacttagtattgagtgagatgcttggacaaaataatacttaaccaactactccataactaactgtcttgacataaatggaggatcattcagtgtgagtggtgagtgaggtgtgaacgaacagtgggaaacgatcagagaaacgaaagcaacatccaccatccataatctgaatctgtcaccattcatgtgtgaatcgaagagcaacaacaacaacccggaattgaaagacacccaaggagcagattagccatcctgcccccatcgatcgatcctgtatttatatacgcatatgtacagtacaacatgcaagatacctgcatatctgtattctactggacttctgaattctgatcaaatattcagaactaatcatatggtgacaactcataacgagtattccatatctcttttaagataaataaggttttatagatcttagacaattatatcgtaattactctaaaatcactttcagcctcagcataattaggatacacaccctatgattattgttttttaaaaaagaaagatgacatgacaacaaatgccatatcgtgtcatgacaaactacaaccataagtaatattcattctcaaactccaattaagtattctatgtctaatctttgaaattacattttaccatattagtattatcatgacgtggatatatatacatgtacaaaataagcatttttccagaaacatgctaatcctcgtagtactactaatctagtcctgacttggactctgaacgagctaaccttgttgcctttgactgctttgaccgttgacccagcttgggtcatgcatgactggagaacgtggcactccctgcaccgtcggatcatgaccgtacacaaaacaagctggagtagcgtgtgcccttgatttcttccatggctaaacaaaaagtccaaagcatggtaaagctagtctattactgtatcctcataaatcagcaactaatcaagcatgcaaaaggcatgtcagtaatattagctaatcaactgatcatgtggaagtcaatgctagttttgatggttcgtagtagcagccacagctgcaaaaaagtcaatcgatcaggtgaagaactggctcattaatcgcacatgcacgtgttaggagagaactaattactactagtataattaagttgccatatacaagaataaagtatgagaatagtgacctggtcaatgatctttcagaacgaaatcagcgatgacaaccgtcaagtttatacctgaccagacgatgtattgtaattaaatatactccactagatcagcattagaagtttagtattgtaatccacaaaggttacttattagattggtgagtagattatgaacccaattagggctcctttgaaatcgaaagattctttttgaaggaatgggtaagatatgaatctttgtatgatcttcctacatacttattaatacttctttagaacaaaggattttgaaattcctgtaaaatggacaaatatataattgtttggagtaggaattttagaggaaatctaccgtaaggtccaagcttatagaaaattttccaaacaacacaattcagcaatcctcccaaggactatactatcaccctaatttctatattttttctctgttactactcttttcaattcttacatttcaaaatgagcccttaggttgttcttcaggctgtttaaaaaaacaaaaaatggaaacagaagtggcggctgcattaggtgaaattcagagttggcacagtagcacagaagcagtacaacaactgcaggggatgcgaagctgccgacctgacggccagattcgggcaccagaatctgattctgaccgcgaaacgcacacggaagattaggctaatcctactggtaattttgcaacgcgatgatggtgattgcttctcgttcttgacaccggccagccattccaattttgctttgtgcaaatttatttctttttcccccactttcttttcctttttcttttcagtcagagcttgaaaggaaaagagcaatggtaggacacacaagctgctgcctgcagtagtatatggttctttaatttcttggcaataatgatctttatttaatttaggagaggtgatgcagggttaactatgaactatgctgcatttggagagaacaatgatagccttggctgcaattgtacacaattgatttcggtgctttgcccagggaacagtatatagttagtagaatagtagtatttattttagattgtcatagattacgtgtttcgaacatgcctttttgacgtttacctggagtttgtttacttgagaccatcataacatttgaaccatgaatagtagtagtccagtcaaaagccaaaactatggccatacaatacaacaccacagaagccccaactttagcaggtattactactttgcaaaaaataggtgttagataaagcccttttccttttaccactaattcaactgattaggtacaatagattcatattttaggataacttattatatattttttcgataacaagtttttttcgataacaaggaagaggcgaagagcacatatgagcacaccagtatctattgtcctacgcacactataatcaaacacttgcgaatgcgcctcataaaacatgctaagatgtaatgtaaatcaacggtagttccctaccacgaaaaaagtttctataaagaacatatccgtatctattatagctctggtttgcaaataaaaagaagagtaaattgcatttagggccaccttttatcaccaaagttccactttggactaccctttaaactattttttcactttggactagattagtttgcctctgtttcactttgaaccaccccaaaaacttttctcgagcacataaatgactttaaccacatcggcacccataaaccgataatctttccgacttatatagactattcttcgtaagattagagggtagatgtagttagaaaagtgacttggggtggtccaaactgcaacaaaggtaatcttacctagtctaaagtgaaaatattagctagagggtggtccaaagtgaaactttggtaataaaaggtggaccaaagtgcaattaactctaaaaataattgaggcttaagctagtagcctaacacagggcctgttcactttgatgccattttcaactttactaaattttggtaaaattgccaaaaaaatggctacatttagtttgctaccaaattttgataactatataagaaattctgccacaaaattttggcaactataccaaaatttagtaaggtttttttggcaacaaagtgaacaagcccacaatattttactatgtgtttcctccagctaaataacaatttctcatttatagtatgttctaactcaagcatgaaaaggctaaagcaaaaattcctttttattttctctagattaaaaataattatcgttttagataaagacattgccactttgagtactacagtatatgtacaactatcaataaatacataatttttattaaagtattttttaagattaatctatagaagttgtccatatgtatgagaaaacgagagagtacacgcagggaaagtatttggaagatcctaccagtagtagtacaaaatgacaaataaaatttgaccggagtgatagtggtgtggcgctacgactggactgacatactcctcggaaccggtggtgcctcgaaacgttcatcaaacgcaacgtgactccacactcttttgttcgttacccattccagcctggcacccgatccgacgcgtccgtccggcgacccggtttgacccaccccagtagcgtgtcgtgtcgtgtccgcgtggcggaccgcaataaaaccagtctcagccagcgtggctagaaaaaaaaccaaaccaaaccggggaagcgcgacgcggccacgacccgaccgacccaacgcggccacgcgtctcgtcgtgtttctccttttccacctccccttttttttccacgcactttaatttgagcaatttaatccgcgccttcctctcacaagtctcctcttcttctacgtactcctctccttcccccgcgcagccgtacacgactcccgatgagatgacggccaccgccgccgtcgtcgccgcccgcctcatccaatgaccccgctcctcctcctcctcctcctcccccttctcctcctcgccccggcctccgcctccaccgtcgccatcgccgccggccccaccgcctgcgccgtcgcggagggaaactccaccgtctactgcgcctccgccaccaactcgtcctcctccgccgccgtcgcgccgttcgtcagcttctcccaggtgtccggcggcgggggggcgttcgtctgcgggctgcaggtcggggggcgcgcgctcttctgctggcccgccgcggcgccgggtcagctcaggcgggtgtacaacggcccgggccagctgtcacagctcgccgtcgggggcggccatgtcgcggcgtacgacgccgcggcgcgggtgatacggtggtggcgtggcggggaccggttccctctctggttcggcggtgggttcgcctccctcgtctccggcgacgacttcacctgcgccgtggagacgagcacctccgccgtccggtgctggggcccgcgcggcggcgccgtggaggcgggttttctcaacgcctccgtctccgccctcgccgcgggaggttcccgcgcgtgcggggtgaggaggaacgacggcggcgtgctctgctccggcggtggcgtgctcgcgccgcgcgaggacctgtacgtggacggcctggccgtcggcgactcccacgcgtgcggcctcctccggccgaaccacaccgccgcgtgctggagcctcgggggcgccaccaccacgctctactacccggcggtcggcacggcgttcgagctcctcgtcgccggcggtaacctcacgtgcggcctcgtgtcggccaacttcagcctgctctgctggtcgagggatgggttggtggcggcggaagtgaacctgccgccgatcctccccggcgtctgcgtctccgacaacagctagggcaaatgcggcccgctcccggactccgggaggttcttgcaggtctccggcgacgtcatctgcagaaggttctgtgacacgttgccgccggcgccgccgccgtttccttgtacgccggtcgccgcggggaccccgagctcgagacgcggcgtgtccaaaggctggatcgcgttcgccgtcgtcggcgcggtgggctgcttcgcggggctctgctccatcgtctactgcctcctcttcggcttctgcagccacaagaaggtgcacaactctgtccagcccaacatcgccagcaacaacaacggcggcggcggcggcggcgccgccgcatctgtcggcagtggcgcgccgagcccgtacgggtcgccgaacgggtcgctcggccgcctgcggcggcagctgtcgcgcgtgatgacgcggcagcggagcgggccgtcgtcgttcaaggaccccgccgaggagttcaccttcgcgcagctcgcggcggcgaccaaggacttcgcggcggaggccaagatcggggaggggagcttcgggacggtgtaccgcggcaagctccccgacgggcgggaggtggccatcaagcgcggcgagtcggggccgcgcgcgcgcaagttccaggagaaggagacggcgttccggtcggagctggccttcctctcgcggctccaccacaagcacctcgtcggcttcgtcggctactgcgaggagagcgacgagcggctgctggtctacgagtacatgaagaacggcgcgctctacgaccacctccaccccaagcccaacggctcgtcctcgccgtccccgtcgccggtggccacgtcgtggaagctgcgcatcaagatcctgctcgacgcgtcgcgcggcatcgactacctccactcgtacgccgtgccgccgatcatccaccgcgacatcaagtcgtcgaacatcctgctcgacggcagctgggtggcgcgcgtgtcggacttcgggctgtcgctgatggggccggagacggaggaggtgaagcacctgtcgatgaaggccgccgggacggtggggtacatggacccggagtactacggcctccaccacctcaccgtcaagagcgacgtctacggcttcggcgtcgtcatgctcgaggcgctcaccgggaagcgcgccatcttcaaggaggccgagggcgggagccccgtcagcgtggtggactacgccgtccccagcatcgtcgccggcgagctcagcaaggtgctcgacgcccgcgcgccggagccgagcgcgcacgaggccgaggccgtcgagctggtcgcctacacggcggtgcactgcgtccggctggaggggaaggaccggccggcgatggcggacatcgtggccaacctcgagacggcggtggcgctctgcgaggacagcgccaccggcggcggcgccgccggccatggcaacagctcgtccagcgccagcctctccatcacgtccatggagttgagtaggatggattgattgagattagtagcttccctaattcaaatccagagtttcaaattgtgattagccccggaaggagattttaaaatttgttgcttcacttcattttttttagaggagaacatcatttgtgtgattctctcacacattttgttcatggtggctgtacatgattttgtattgaactgatttctcttttcatagatgagaaaatttctctctttttttttctactacaaacattcaacaagaaaccaaccacattgatttcattcaattctttcgataatggaagcataagtgcataactaattctttcgataatggaagcataacttcttgcctctgcaaattgcaattgaatggtccatgccatatcattttatcgtgtttgaattttcacaagtgaaatttcaacaaattgcgtgtgaattgaagagagcagttggttgtttggttggtctacatggttatacacaatgcaagcacaacaaaaggaggccgtttacttttctcccttctctctgcattcacatcggtttggtcgtggatcctgtactcttccatgatcaatatgtactcttcttccttgatccttatgcaacccacactaatcatgatgggaagaccataattcagcaagagagcaaatgccattaatcaattgtgagctgaatttgttaggacactctaactcaagaagatgctgtacatttagagtgacaaagctcctactaatcttcagagaatagttctattagggattacattagcgccattaggccctagtaaacagtagtgccgacaaatgctatctccacatttcatagagaggtagtagtatattatattagtacaaatgcatagggatttaattactgtgatctttgtccctgacatagtacattatggtcctactcctaccttacacaacattgcatttaaattgcattttgtccatacaggaacattagaggagaagaaaatggccgcatccatatggttggtgaaacaaatccttcgtcttgttgctttaaattgcatttcagcttcagttatactatctatctactctatctaatgtaggtatccccacatttcatgcccatcatgcttgaaaagaaaaggaaaaagaacatcttttgtttttcttaaagactcaatatatcttgaaatggatagtggagcaggtcaaagaagatgcacagtgttgaaattttcagaaagctaaagctggtagtatgtttgtcagtgaaatgtagtaaaggttagtatctaatgattgaggaagaacaatcattcgatttgagtacgcaaaagcttgtgccttaatagcactccctcctgtaatcctgttccacaaaaaagcagagatatactgcagaaaaacagtctcttcagattatggctcactgaacctgcaaaaatcacaaacaacaaaatgcttaatctctgatgaacggcatgaaccgcagctgataatatcactgtcaggacatatgatcaatcagcttggtctggagaaaaacagtctcatcagattatggatcactgaacctgcaaaacccacaaacaacaaaatgctaatctctgatgaatcactactgacaatatcactgtcaggacatatgatcaatcagcttggttttgccatcaccaaccatgtcactttccatttggcac

SEQ ID NO: 59151 - DNA, 8003 bp, Oryza sativa
ggccggagatgatgatgatgatgatattattgagtggtggtagtagaattaggtattgtggcggcggcggcggcgaggcgatcgacctgggacttgccgcgggggccgttgcggcggatgtagaggcggtagtcgtcgaaggtcatggggctgtacagcggcggccgctccggcgacacgagctccggcagcggcgccaccggcaggtcgctccgagggttgtagaaggtcgcgatcgacagccgctcctccgccgcgttcaccaccacccggtgctccacgctccggtacaatgcgttcgtcaccacctgtgtttaaatttaattaattaattcacaaatttcttctttattagataataatgcaccaactagctaaaggtatagtaaaatttatatgaccaccacacactagagtactagacctctttaattactttggaacgcataaattttacaagatgtttaaaaggacagtttattaatttcctttaaattttcataaaattcctctattccaaaaatgagttcttagtatttttcaagaacgggtgcaactctaggctagataaaactcatatgcacgataaatagccaaatcgaaaccttaattatttttccgagttaccgaaatagagttacttatttagaatttttgcactatcttgccgtcataaattaagcatctttggtgtgataaggtggcaacgaaaattacacacacaagtatatttttaataggattttgaaaaacaaataactattacctccgttttttaatagatgacgccgtagacaattttacatgtttgaccattcgtcttattcaaaaaatttacgtaattataatttattttgttatgacttgttttatcactcatagtactttaagtgtgatttatatcttatacatttgcataaaatttttgaataagacaaatggtcaaacatgtgagaaaaagtcaacggcgacatctattaaaaaacggaggtagtataagactaattgcttgttcccccaactctgcatctctacattcagatggcctcattcggtcttcccggccaaaaaaaaaaaaaaaaaaaactcctcatctcttgaggacgcattaaaccgatcgaggcatactcacgggtgtgtgagtgtgatgcaagtagatagtgatatgtctggtgtgcaaagaaagcatcctactacttcaaaggagcagtgcagtactggtcctatatactactccatgaaggaagagcagcaatcagagagatgtgtaggggaccttgcaaggttgggatgtgaaataaaggcattcctttgctctgaattgcatttgcatttgcatggccctgtggaaaacgtgctcacaggagctagcagcacaaatgcactacactaccaacagccttatgtctgcaactgctactactgctctacctatttaatttaccctgaactttattcgaccatgcaaatattacacatgcttcagttaagaaaaacaagacaaaatcacaaagttttttaaagaaggtacgattaaattataggctagttcacgtcaaaattaaaagtttggttgaaattggaacgatgtgatggaaaagttagaaatttatatgtgtaggaaagttttgatgtgatggaaaagttgaaagtttgaagaaatatttcagaactaaacacagcgatagttagagttgaaaaacagggataagaacataatcgcccccatatacaaatctgtccaactactacaaggttttggtagctagctagctaggcaactaagattatcagcaatatattcttctctctaaaatttggtagcaataggttagcatcaacaaaagggtatatatagtagcagaaaagggcattgtagcatactgttcctattttgcagacatattcagatgatgtggccactgaaaaccctgccagcatacttttttctttttatttttttgcagaatgaaacaagatggaaaaaaattgcaacacatgtctagagatcagggagtttgttggggagtgattttcctacctctgattcgtgtggttgggctaacaagtgacagacatgcattcatgattgcacattgttgtatgcccaatccggaatacagccacagaaaagatgatcaatggtttacggtagtgttaatcatcatcatgttatgtttaattatattttttaagatgagaaaattaaccttctcatactaaacaaacacaaattaagcacatgatcattgcttggtttagttgataggtgcagtacatatttatttatatagtgtttgcacaaacattcaagctagctgatgacgttggaagaaaggtcaaacttgtgtgtacacgtacgcatactgtacatacggagtacgtataaataccaccacgtcagcaactagctagcctaattgattaattggttgattagtaggcatgcattcacacacagatagctgctagcaaacggctccgattcttctcgcctggtgacggacgcatacaatacaaacgcacgagataatcagttttattttttatctatcgacttgcataaattaaatgcattataagtctctgactttggtcaaagttaaaacaacttataatttaaaaaaaacagaaggagtaagaaacataaattagtcatgttatttcatttagtccagtactatgtgataactcctaaatttgtcctctagttaatttagaatagtcgtcatagctaggaccacagaaaatgcatatatatacagaggactaaacgactcagccaatgatcgactagccataatatcaaatttcaacaaaaaaaaaactggtagtatgtcatgcgtgcatccataaaaaggaaaaaaacatgcgtcgaagatatttatttcatatgaactcatttcttataaccataaaacaatagcatctctacgtgaatctcgcgcagccacatagctctactcgaatgcgtgcacctaaggccatatttagtatagaaatgtttatattttggactgatgaactctaagattatgtatatttcttttttcttttatgtttatgtggttgttcagtggcggagttagcatcgtcgtcaagcccggacgattaatagcgtttcacgacgaccgatcaattatatatatattgattgcattcggtaataataacggtagtggcggagtccagacgatcacctgacataccagaagctgtttccgccactatggctgcccttacaaattattccatatattttaccatgaagacggttcattattttttcccacgtgcctattatttttaccaacatgcatatgcactagctagcctattatatatatagtactcgatccctttgtctcgtaatacatgacaattttgactttatacatagtttgtttcattagtttgaccactcatattttatagataaacttaattacaagtatcaaaagaacactaattactgaacatataaatccctttcatcacaatcaaactatttatatattagatactagtagcgatcaaatcaaactgaagcatgtgaccgtcaaaactgccgaattacgtgtgtcgccacgtgaaaaacaaccaaaaatatgctgggacaaaaacattttttatgtccacctcttctactaatcatgtaaaaaaatctggagctttgctataactatcttgcaagtagaagctaaggttggatatataccggccacgtaaacatcctacctttctaattgttttattttaccctcttcgatccacgtcaggtaacagtagtaggttggctgtactttactagtttatggattgtgttaatcccttcttgttgtcctaatatagcccactaattattaatatcgttatgtggatcgatcgatgagataataactaggttatattgatggatgtgatcgatagatatgtgtgtttgacaaaactaacacacacatgcatcaccatctttacatacttttggaagaggagtaaaaaaatcgagaaaattaactactagaaaggggaaaaaaaactagctagaacacggtgcacccgtgaggccgtgaagacgaccattttaaaccggagaaattgtgtatatttataagaaaaaaaggaggaaaatgcaggtgaaaattaaaataaaactatatatatggaggtagaaaaagaaatccagtgcatttttggagtggtagataacacacgtgtaatagttacttgttgaaatgtatgtaatgcaaatacctgaatttggtcgccgacgttgatgatgaaggcgtcaggcacggggtcaacggtgacccatgcaccggcgtggcgaacctggagtcccttgacacggtcgtcgacaaggaggaccgtcatcccgccggggtcggagtgcgaggacaaccctagtgttagatccggctgtgggcaccgcgggtagtagttcacccgcacgcacactccagcaccctctctaccaccaaacgcctcctgtagcctcccttcttctacccctagccccaccgccatcaccgccatcaacctctcgcataacctcctcacctcctcgctgtactctgtcgtcgtctccctatacatatatattagttagtatttttgcacatgtaattaggacatatccttttctcccttttaaacttgtattccctcgctcgtgcttttcgaattgctaaaggttgtgtttttggaagaaaaaaagttctatacttgagtttctttaaatagtcatatcgatatgtttcttaagttcttgtaagctaaaacttaattaatcacgcgctagtctattattctgttttgcatgttgagagggaaatgttctgaactcctcaaaagagcacggccttatactaacatttaagaaaaatgctaaaacaactacttcctccgtcccataatataagggattttggatggatgtgacacatcctagaacaacaaatttgaacataccgtatgtccagatttattatactaggactgtgtttagttcacacaaaaattggaagtttggttgaaattggaacgatgtgatggaaaagttggaagtttgtgtgtaggaaagttttgatgtaatggaaaagttggaagtttgaagaaaaactttggaactaaacacggtgtaggatgtgtcatattcatccgaaattcattatattatgggacagagggagtaaggaggaattttgtgttgaatagtaataattataggtggaaattagtggatgagtgatgtgtacctgaggtcaggggggaggtggggccacttgtgaggggagaggaggtggggtggtctgacgtggaggaagtagtagtcaccccagtcgaggatggcgcccttgtcgacgccgagccggctgccgtacccttcgtacgtcgccggcgagttgccgtaccgctgcttcacctccatcggctgctggaagaacccgcgccacacgccgcgggcacgccggagcagcgccgccggcaccccgtggttcaccgcctggaagaacccccactccctgcacgcctccgccaccgccgccgccgccgtccccggagacgacgacatgtccaccaccgggatgttgatgttggcgacggcgttcgcctccgacgacgacgacggccgctccgtctccggcctcacgtaccggtcggggatcgtcgccgccccgctctccgacagcgcctgcaccctcaccaccggctccggccaacccccatcacccgccgcctccgccatgatcgatcgatcactcagctagccactgctgatgctgctgtttcacttggaatttgtaggagatatctatgaatcgattaatcctagctaattaagcacgcagtgatgtgattagtggatcagctagcgctagctgaaactgaagctggaactgtgcagctggcaacgagataactaagctaggtagcacaagtgttgttctacacttgtacgactcactgcaagcctccagcttcagggtggtgtgtgtatatatactcattccatcctaaaatataaggctcaaccacttctaacatagagatcaaataaagaatataattatatccatacatgtaaacagtgtgattggaagacttaatggtacaggaaataaattaaactaaatttaaagaactaagaggtgataattaatatatacatgcacgcacgccttatatgtgagacataaaaaatacggttgtatcttatattttgagatgaagacgaaggaagtatatatttattgattgatttgggcggcagcactacaggaatcatgttaacattaaattgttgtgcttttcagtgtaattagtaattgattaatttctgtgcaggcagctagtacctccgtcttaaaatatactccctccgtttcacaatgtaagtcattctagtatttttcatatttatattgatgctaatgaatctagatctaaattcattagcatcaatatgaatgtagaaaatgctagaatgatttacattgtgaaacggagggagtaacagcctattatcgactgtgaagcatattttcaaacagaggaataccaaaataaatgtactggtactacgttatttagatttatagttctaaatatatcatcctaaatattatgttcgtttattttgggacgaagagagtagctaggtaggaagctggcaaaaggacgaaagctactaattgtaatagggaacgtgactgaaatagggaggatcaggttgtgcttggctctatggggtttatatgcgtgcgtgtctgattgctctgcggcgtggtgccactactaccactacagtgacccaaccccatatcaaaaagaaaaataaaaaaaaatcaccatcttatttgagagagatggagatggcccaccaccatctctgtcaataaatggagggtaaaatctggacattttaattgactgcttgtattgtatggtagctggaaaacaactatttactgacccaccatgttgctgtaaaatcttggcagatcattgtcactccgtacctttgaaaccgactcgatcgaatcatgattcatcattatcataagcagcacgcaaataaacaagtttgttttgttatttgttaattttataagatttgctagacttcaggcccctgaaaatttatagcagggaattaggaaagtgcgagtgatgaaaattagtgaagtaacttgcattgaattattgaatattgtacaaaatataattttactatgactcttagtttacattttagaatgtaattttacatttctccatatgggagcctttgttgttttattctaagattaaaaaaaagttagtgttgggtgaggctaacgattgagaaactattgatagctagaaacctagtcactaggtaccatgtaaaaggtaattttattatccttgagaaattaccatatttctagtataaattttggtacctacaggtattaattatctcaatataacaaagattttaatataaatttaggtagctcaaggtatttttttaagaattacaaaatttctccatgtaaaaagcttaattggcatgttgttgggaaattaagcttcaacttgtaacaaaggagccaaaagttcaattataatgtccatttatatacattgcatcttatcccttgattcctcttctttcttcattgtaaggctcgccgtctttcacgcacacgtcatcttctatcgatttatagatagcattgttactcgatttatcattaaaaaaagaaaaagactgacagataaattgtcacgtgcattggaaactatattgatgcgaggacggaggaccaagttcgaaaacagagatagtattgcactgttcagtatagtttgctagcaatgggggccagttcataattagttcctgtaaaatttaactatattgatgaaataattaatactcctgcacactgcagcattcaatggctgcatgcacaaataaggtactccctccgtcccacaatataagggatttt

SEQ ID NO: 59152 - DNA, 11653 bp, Oryza sativa
cgtttgattcagagatcggacggctgaggtgcctcgatggggtggagggcgcggatcttgatgtcgtagcgcggcggcggcggcgaggacgacggcggcgagcgggcggcgcggtcgtcgtaggcgaagccgacgtgggcgccgcacttgcggcagaggaggcgcgtccgccgcgtgaagaggcggcgcgcgcgcacgtccacgcaccggaactcgtccacgtgcccgaacctcgcgtcgtcgatggcgccgaacctcaccaccccccgccgcctccggtatcccccgccgccgccggcgacgaccatccccgccgtgtccctcgccgacgagctcagcttcaggtcgtacccgcacgccccgcagctgacaacacatacacatttcatccattcgtaagctactccttactaattaatcctacttaattaataccgtatattaattaatctgccaagctagcttggatcaagaaagaagatgatgatcgtaatcagagactgaccagtaggagacagtggagaggctactgggaagatcaagagctggctgatctggcttcttcatcgccattgacgagctgatcgagctcagctgctgcttcttcttcttcttcttcttcttcttcttcttcttccaagtcgtagttagcacactactccttaattaactaactagattctgctggatgggttggtagttgatgatgttgtgttcaccaatcgacgagctcatcgagaaatgggggagtttatatatggttcaatgcgtgtggaattcagaggaaagctggggcggctaatgattttgcgaggaaattgggcgggagaacgtgtgggtcaggaccgaccacggcaggtacgacgagccaagattgatactcctaccatatcatatgcactatgcagagctcctaactaattgtactgattagtgatattaatgcaggttagtacagtatgattcattgatgtggccggtgctcccagcgccacggcgtcgatcgatcgatcattccatcgcacgttccaaccaacccaatcaatcatcgaccctggaatctggataagcactaataatagtattatcatcgactcttttttttttcttatcttgatgatacaaaactgagagaatcacagtgcacatgtaggagtgctacaacttttaaagtaaacaacaatgatttaattaagtatttgttttgtgtactctagccaagagaaaagaaatagtaaaggaaaagggagaagtcaacgcctaaagaagtctccatttcagtaatatgatttcagtacagtactactgattactagtactgtacgtagttcattagttctgaccttccaaaatgggcgttgaactaaactgggctggaagcttgaaagcctaacagactaaatgaggcccaatttcaatttcaaagagactgatcgatctgggctaagaggccggtgaataagtttgtgtccggcctctctttgtatatcttgataatataggaataagttcacttcgtgaccctcaaagtgatcgagatctaacccgtgaccctaaaccacaaaaccggatatctcgacccccaactcttaaaaccagtgcaatttgactccctcggcggttttggagggcggtttcgctgacgtggcgcatacgtgacaatattgactcggtcttctgtccacgtggcgttgacgtggcacttacgtgtcattagaaataaaaaatatgggtgggacccatttgtcattcaccaaaagtacaggtgggacccactgacatgtggggcctacataaatcatatcctccccctctctttctcttcgtgagcgttggacgggagctagcggcggtggccggcgcctcctccaactccatccacagcctcctcctcccctttcccgcggcgtcgttgctggcggcggcggtgcatcagcccgcaagcggcggagacccgggagtggcactggagcggcgacagcgacgtgcgcgcgagggccatagcggcggcggcggcggagatcgaggccgccgtggaaggttggctgttggaaggaagaaaacgagccatgagaacggccgcgtcctcgccaccctcggccccgccaccgcactatccaccgctgcgctcgacgccctctctgccggccacgacgcacctgcctccgcagttctcccgccgtgcccacgaacacgtaagggccgcctgcgtctcgccaccgcgactcacgtcggcatcctctcgaagatggcggcattcggcggtggcttcttctgcacctgcggcggcagcgttgaaggtgggaggagcagcgcgggtgagggaggcggcggtaccaccgatggacgtggtcagcatgccgagccggccgacaacggcactgttggaaataaaccttacacgatgtatctagtagtagctagttttacgttcctttctgttcctgcatgcatgttagtttttctgttgttgcatgcgcgactggcctggacaacgggacgtgaacgcgtctctcggatcgcggggatggacgcgaaagaaccgggacgtgggatcgaatcctaagtctgttatttgcataataaaaggagaagaaaaaaaccgaaaaggtgcagcttcatcgcaccacaaaactcagcgtgtttcctcgtgttcgcgtgtgttttccacagcttgtttgtcgataacttagggaaacctgacaaaccttacacaatgtatctagtagtagctagttttacgttcctttctgttgctgcatgcatgttagtttttctgttgttgcatgcgcgactggcctggacaacgggacgtgaacgcgtctctcggatcgcggggatggacgcgaaagaaccgggacgtgggatcgaatcctaagtctgttatttgcataataaaaggagaagaaaaaaaccgaaaaggtgcagcttcatcgcaccacaaaactcagcgtgtttcctcgtgttcgcgtgtgttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagcggcgggagcgaccgcgggctggtgatccaccgcgtggtcaaggaagcaggaggtgcagcgaactacccgctgttgacaagaaccaactacaacgattggtctttgctgatgaagatcaaactgcaagcccggtgcctgtggggcgccatcgatccaggcggcgtcgagcttcatgaggataggatggcgcttgacgccatttgcagcgcggtgccccccgagatgatctcgaccttggccaccaaggcctcggccaaggaggcatgggattgcatcaggatcctgcgagtcggcgacgaccgaattcgcaaagcaagcgcacagaaggtgcgcatggagtacgagtcgctcgtccttcgcgacggtgagaccgtggaggacttcgccatgcgcctgacctccaccgtcaatcaactcgcgacgctcggcgatcccgagccggcagacaaggtcgtcgagaagtacctgcgcgtcgcccgtcccaggttcacccaactcgtcctttccattgaaactctccttgatatctctacactgtccctggaggaggtgaccggcagactcaaggcagctgaggacgccatgccattgccatcttcgtcctcagacaacgccggcaagctctacctcaccgaggaagaatggctagagcgccacaataaaaaggagcaggaggcaaagaagaactcaggcagcccaagcaaccgtggcaagcggcgaggcggcaaaggccgcaacggcggcggcgctggagtcggcggcgcgaagaatacgaactccggagcggcccgtcgtgaagacaaatgccgcaactgtggcaaatacggccactgggccaaggattgcaggagcaagcccaagcgggatgaacaggcccacgtggcacaagacgacgagcccaccttgcttctcctcacaggaggagtaatcacacatgcatgtgaacaggagcatgcaccagcgccgtctgcgccaactccgtcatccgatcccatctacctggaggaaaagaagctgttcgcggcgctcgacgacgccgcgaagcgtgatccgggccgctggattgtggactccggcgcctccaaccacatgaccggctgccggacggccttctccgacattgacacaggcatcaccggcaacgtccgactaggagacggctccgtcgtccgaatcgaagggcgaggcaccgtgctcttctcctgtaagaatggggagcatcgaaccctctccaacacctacctcattccacgcctcgctgctaacatcattagtgtcgggcagctagacgagaccggtttcaaggtggaggccgaggatggcgttatgcggatatgggatgagcagcggcgcctgcttgcccgtattcaccgcaatcctggacgtctctacgtcctcgacgtcgagctcgcgcgcccggtctgccttacggcacgcatcggcgacgaagcatggaagtggcatgcacggttcggccacattaacttcactgcgctgcggaaaatgggcagagagcagctagtgcgcggtcttccggctgtgtcgcaagttgaccagctttgcgaggcttgcctcgccggcaagcaccgtcggacgccgttcccacagcaggctcaacagcgctccctggagccgctccaactactccacggcgacctctgcggcccgatctcgccaccaactccgagcgacaaccggtactttctccttctcgtcgatgattacagctgtttcatgtggttgtcactgctcccctccaaggatggggcggcggcagccatcaagcgcatccaagccgcggctgaacgcaagagcggcaagaagctacgtgctcttcgcacggataggggggagagttcctggtccaccacttcgcggattactgcgccgagctgggagtccgacgcgagacgacggcgccctactcgccgcaacaaaacggcgtcgtggaacgtcgcaaccaatcggtggtcgggacggcgcggagcatgctcaaagccaaagggctgccaggtatgttttggggggaggcagtcaccacagctgtttatctcctgaacaggtcgtcatccaaaagtattggtgggaagacaccatacgagctgtggaacggatcgccgccggccgtccaccacctgcggacgttcgggtgtttggcacacgtcaagaccaccacgccgaatgtcaagaagctcgacgacaggagtaaacccatgatctttgtgggttatgagccggggtcgaaggcgtatcgctgctacgaccctgcctctcggcgcgtgcacatctcacgtgacgtcgcattcgacgaagaggcgcaatggaggtgggacggcgagacggcgagtgagctggacttcaccatcgagtacaccactgtgtaccacccagctgtggtgaacgcgccacgagctgactcggagcagccagagctgccgactccgtccgcgacatcgacaagtccatgcacacctgccgccacggcgggcacaactgcgacatcggcggaattcgcgactccaccaaccatcgccgcggacgacctcgacgccgatcatgatgatgctccgcttcggttccgccgcgtcgacgagatattaggaccggcgaccccgccgggactggctgtgcgcgagttcgatgacgaactcatgatggcaagtgctgaagagccagcgtctctcgccgaggcgcaacagcaagactgttggcgtcaagctatgctggatgagatgaaatcaattgaagaaaacggaacctggctgctcgtcgatcccccacctcgccagcggcccataggactcaagtgggtcttcaagacgaagaaagacgctgccggcaacatcaccaagcacaaagcgcggctcgtcgcaaaaggatacgtgcagcggcagggaatcgactacgacgaagtgtttgccccagttgcacggctcgagtcggttcgcttgctgctggcgtacgcggcgagcgaaggttgggccgtccatcatatggacgtgaaatcagcgttcctcaacggcgagctcaaggaggaagtctacgtcgcgcagccgcccggtttcgtcgtcgacggcaaggaacagaaggtgctgcgcctggtgaaggcgttgtatggacttcgtcaagccccgcgtgcatggtacaccaagctcgacgcgtcgctgctgtcacttgggttccatcgcagtgcctcagagcacgctgtgtacatgcgcggagctaacgcacgtcgactggtggtcggggtgtacgtcgacgaccttgtcatcaccggcggcaaccactccgagcttgatcaattcaagaaggagatgcgggagacgttccagatgagcgacctcgggctacttcggtactatcttggcctggaggtgagtcagaccgacgagggcatcaccctgagccagggtgcgtacgccaagaagatacttgaggcagcaggcatggttggatgcaacccgagccagactccaatggagccacgcctcaaactcagtaagttgagcacatctccttgcgtggatgcaactgattacaggaaaattgttgggtcgctgcgctatttggtgaactcgagaccggacttggcgttctcagtgggttatgtgagtagattcatggagaaacccactaccgagcatctggcagccgtgaaacgtgtgctgcgctatgtcgccggcaccatcaatcgcggctgtagctaccggaggaagaaaggagctgttcatctagttggattcagtgacagcgatctcgccggcgacgtcgacacgcggaaaagcaccaccggtgtcttcttcttcctcggtgacaacttgattacctggcaatctcagaagcagaaggttgttgccttatcatcctgtgaagcggagtacattgcggcgacaacagctgcttgccagggtgtgtggctggcgcgtcttcttgccgagctcaagggagaagaagccgacgccgtcacactcaatgtcgacaatcagtcggcaattcaactcagcaaaaaccctgttttccacgatcgcagcaagcatatagagaccagatatcactacatcagagaatgcattgaggaggacagggtgaagatcgagttcgtcagtacaaacgatcaactggcggacattctgacgaagtcacttgggcgtgatcggttcaatgaactgtgcacaaggattggcctcgtcgaagttaaagggacgtgcaaggtttagggggagatttgttggaaataaaccttacacgatgtatctagtagtagctagttttacgttcctttctgttgctgcatgcatgttagtttttctgttgttgcatgcgcgactggcctggacaacgggacgtgaacgcgtctctcggatcgcggggatggacgcgaaagaaccgggacgtgggatcgaatcctaagtctgttatttgcataataaaaggagaagaaaaaaaccgaaaaggtgcagcttcatcgcaccacaaaactcagcatgtttcctcgtgttcgcgtgtgttttccacagcttgtttgtcgatcacttagggaaacctgacaggcacgaccacataggagttgggaggcatctgcgtcgagcattctcctgctggttgccaaggcaatcggcaaggggcgacagatgagggctatggctagcaagcggtagcaacaggcagtgcatgtgtgtactaacatcaagcgacaagccaacaagcaaagggctgaccgaccgagcaaagttgttgcagataggcaagcagagcagcagattcgcatggacgatggcgcggccatggaggagggggacgcgaggggcgggagcctcgccgagcctccagcgctccccgctgccggccctcgagcgctccccgccgccggcgctccagctcccatccctgcagacatgcgaaggggagggaagagagagaagggagagaaagggaggaggatgaagaggagagaggataatatgtggaccccacatgtcagtgggtcccacccgtacttttggtgaatgacaaataggtcccacccatattttttatttctaatgacacgtaagtgccacgtcaacgctacctggacagaagaccgagtcaatactgccacgtaggcgccacgtcagcgaaactgctctccaaaaccgccgagggagtcaaattgcaccggttttaagagttggggggttgagatatccggttttgtggtttagggtcatggattagatttcgatcacttttgagggtcacgaaataaacttattctgataatatataacgcccaattcatatgctccgcttctcaattgtcgatccatatctattttgaattttaaagtttaatttttgaatatggtttgtccgtccactttcgaagacatttagtgaattttcctcaagtttcgtagaggaatcgatttgggttcaaaagagagggaaaaaaagacaacttcatcgcatagagaaaatccgtttttcgaaggcttacagtaagatgctaaggaggaccttagcatatactatgattgatagtgaataaaatggtgagaaacctgtgtcttaaggggatcaaacttagggatgtaagtggctaacccgcaaatctacttataggtcacaataagcgggttcgcgaattatttggacctataagtaaggtttacaggttagacacttagagcgagtataatagcaggctccaaatcagttataaacatatatggatggaataagagaagagagagaagaaaaacgagctacagatttgtagctagctgctgcacggactctaaaatattatgtgtatatgagaggttggaccatgtattgatagtgtagtatatatttataggtaactattatatgaatgagctattaaattagctatagatgatttggagctagtagttgactatactatttttttagataatagttgattgtactattaaacttgcttttacacccttaggttgtgttcggaagtatatgttcccaacacgcacagcgcgcacggaaaacagaacgatccattagcgcgtgattaattaagtattagctattttttttcaaaaatagatcaatatgattttttaagcaactttcgtatagaaattttttttaaaaaaatacacaccgtttcgtaatttaaaaagcgtgcacgcggtatacgatggagaggggttgggaatccagggatccgaacacagccttaattaaaacctaccctgacaactctccacaatgcaccaactagatgagctacatttcgttctcaaaagcattacaaactcctccaaaactcccaattggattaatatctcgatctgttcttgatcgtgcccggatttgtgcgtcccaccaccaataatttataattccatcccagtggcccagaaagagaaacgtgtgtctgccattggtatccatccaatggaacgaacaaaggctagctaacacatgaatcaaatatgcaaatcacaacaggataaataaacatataataataacgcagtcagtgtctggttaacagtaatcacgcatgttcgcctgttgagaagaaacatcacacggatcgacctttagggatagatgctgatatttaaacaaccaggcataatggttcacttcgatggcagtggtttaacagtcaatgtaggatgtggcaatagctacatgcctctctctttcaacttggattagttttcataagagacatgattaatttctttgagacttaattaacaaaacatgtacatcaagctagtgcgctactatatctttttgcacgagatagctcttggcaggattggagctatctaaaaggtactaaaccaattaatatatttatactagtcatcacatatttttaccactttaattataatataattttaataattgggtttaataaacaagctgaaaagatagctaaaccctaattgttctaggcttggctccatctatatcggttggggtaatgtgcttcaatccgcaatggctatcaaacgtataattaatcttgcgaactttaagcctgttgtctgatggtccacacatgagtggtggaaagcgctagtcatatgtcttttcacgaacgcgtaaacaaatatcacattattaatatattagaaaaaatcagagttttagttaaatcagaaagccattgtccgaggacaaggaaaaataaaaagaaaggaaaaaactgctaagcctacgaaagagaaaagctagccacctctgtcaaggcttacccaaatagagatgtgttgctcatcttcttgccatcatgggagatttgggggaagagaaatcagagagtctttaatcacaaagaatgccagtgacagtcttggtggggaaaatcaaacaagaggccatcccttaaaatccatatgcatatgttttttgagtttttatatttagttttactttatccaataaaattttcaccgacttatgtcggtttgtagaaaaaacatagtattaattaaaagggaattaattcccatccacaaaaacaacctagctatcaattgtaacccacggtagcaattaatcaggtatgaacaaaatttaatctgacaagatttgtggtcgtctcccggacacaaacatcataatcatccatgatatccgcaaaacaagatgttacaccaataatcttatgatttgcgctaccaactagcatatgcatggcccgatttcattgggtgcaaatataacaatagcagcaccaaatcatttgtaaaaaaaaatgtcatccatgtaaccttagctagcaaaatcgaatcattcaggtatagctcattataaactttgaccaacttaacgatggaactgccaacacttggacacggctttaacatggcgcttgaataattttatccccgattacctagctccgattaatttacaatgttatctgctatcactcgacagggaactaaccatatttcctggcaagattcgataaatactcctacttgtgtaattaaattatccctagtaactagtttatgctgaatgattggaaaattaatcgccaaagcaacaaactaaagtaagcgactgttgttaattaatatgatctgcgaaaagcagaggtttcgatgcctggacacgtacaaccgacagtcaggactcaacaatatttttttttcgcaaacgtataaaaatattgcacgtctgtatattagaacaaaagaaagttttaattgcacaacacaacaggccagaagacctattgccggagggaaaaagggaaataaaggaagcaaaagaaatgagagaaaaatgatgtatatatttaaacaggagacaatacatatgtatatggccagctgctcgtacatgcccatttatttttattctcttcattttcgatgacgctagaatatatacatttgattttttttctcaaaatgaatggtgatatattatcgtgtttgtgttccaaaaatcaattggtacaatattatgaaagtgacgacaca

SEQ ID NO: 59153 - DNA, 10237 bp, Oryza sativa
tttttccagctcaaaagtgtttgttttattaatctttttctttcttaccgaatattgtttctagctgcaatttttctcttaatcatatgttttttcatcatacttatacttatacatgatgttcctgcagactttaaaaaattgtcttgaaaggatcttgcaaattttatagcatatatataatataatatagagtaatagattaagcgttaatttctaagtgggtttcttatggccttatgggccatgatttttggactgggctgatgatgttcaaggcctacagatgactgtgcccagtgggccatttgggtccatgttgtatagggcctgttcactttgatgccaaaaaaaccataccaaattttagcattgccgaaattttggtaactgtgtcaaaattttggcaggcaggatttcttatatagttaccaaaatttggcagcaaactaaatgtagccactttttttggcaactttaccaaaatttggtaaggttgaaaatgacatcaaagtgaacaggcccatatagatagttcctttttttttttgagatgtgttgtatagatagttcaattgcctatctctctgttccacttcctcaaatttgacttgagagtccatggcaaataataaagagcactcctatttgggttcttttgatcaaatttggtttcgttcaggttcaaacagaaatagtgaaacaagtgaagttgtttgacattgcttccaagactgaagaaaaaggatggtagaaaataaagactaagtaaattatgatgaatgctttttgttggttccaagtcaatggtccacaattgcggttagagaagagaaacaaatcaagtggtgataaaatgattcttttttttttctgaaataatccacagacaactctttacattgtttgataagagcaatttttttaagaacagataatttattttgttatttcctaatattttaaaattctaagcagatattatcatataaatatagacatttaatatgtactaatccatcattgtaacctacttcctccattaaagaaaccaaatcctagctatgtgtctggacatacactatatatatagttaggatttttttttcatagcaagagtatactacaacttttgtcctaaaataaagttattttcaacacaacactcggtcccaaaatgagatgtttttcatcaaaatgaatcccaaacattctttatttaatttattcacccactttatttttatcaacaaatcacaactttcattagattattttcacctagtttcttaatattctgtccataccaaaatacttatatttaagaagggagataattataggggtggcgtgtgcacttataggatgagtttgtaatgcgtttcttttatgttaaaaaaagagagatggaggcagtagttttgtatacagcttacaaagtcgtaacaaacttctaccatcgatgatgtcccgttacattatcttcattaattaatttatataaatacctacgttaatggctaaaaacggtggagtatcaaatcaaaacagactactacaaatttatcttttctcgaacgaaaaaaaaaagcgataaaaaccatctcatcgaggaagaaagcaacccacgataaccctcttcttcttctacccatctcgccgtcgccgccgccgccgccgccgccgccgtcgaatcgatcgaagcccagcagcgagcgatggggctggactactacaaggtgctcggcgtgggccgcggcgccaccgacgaggagctcaagagatcctaccgccgcctcgccatgaagcaccaccccgacaagaaccgctcgccgacgccgacgactccctcttcaagcaagtctccgaggcctacgacgtccgtacacctcccctttctccatcgccggcgccgccgcactccaccttttttactcacccacctcctcctcctccggcggcgtgcaggtgctcagcgacccgcagaagcgcgccatctacgaccagttcggcgaggaaggcctcaaggccggcgcggcgccgccgccgaccacctcctcctcctcctcccacggcggcggaggaggcttccgcttcagcccgaggagcgccgaggagatcttctcggagatgttcgggggcgcattcggcggcgcggggccacgcgcccccggcgccgggttcccggggttcggtgggtccccccgggcaggggagacgtcggcgacgaaagctccggcgatcgagcggcagctggcttgcagccttgaggacctctacaggggcgccaccaagaagatgaagatctctagggatgtcctcgacgccactgggtgagacagatttttctcccttttttttctattcaaatcgattcaaatcaaacagattattgcttagagttccttgtaaaaattggcattgctgttaatttgttgtgtatttgtgatcttggtgagcgagtctgcgaggttaggcagtagcagtagcacccttggtaaccagctcttcttgcctcatagcatgcacctactagttctagactgccattgtagataatctaattttagcctgccattgattcttagataatcatgttgctctagattccagcctgacattgtacataatctaattttagcctgccattgtagataatcctgtcgctctagattttattctgtcatgctccagacgagtaacctcatagcgacctttatgttctagacgttattctgtcatgcagtgaaccagcggcctcattgcaattgctgattagttaatgtatagcacaatgtaatggtagggaagacggagtaaaggggaggaaggttgagaggagaggaagattgagggtagtacacgagaggagacatgagagaaggtgaggacattgcaatagttgcttagcttgcctgatgtcctcatgggttatgccacttcacattttcctgtatgtttgctccattgagatggcataaaaatgtgcaagcattagtgtgcttcaatccatacttcattacttctgttgagtatagcctcttggtgcttaatctaattttgaacgataactgatatgactgaaccctagctctttggtgtggctccatgtagcctgatgtaaacttcgtatttagcgttaaccttgagctccatgcatcatttatgtgtagttggaaatagattatttcagtaacggaggaatgcttttatggtctgtatttattgtaaactgcataaactgttccacgtgttgagaaatccgatctacatccagctcagcatgctgctagtgtcctcttgtgttatggtttgtttgagataataataaattctacctttacaacctttccagcttcataaagaatccttctcaataaacactttctgacattgcagctacggagctactactgtataatgtataaacattaaaataaagtagcattttaatatttttgtgcaccctgtttgccttttctggtactgtttgtaaccaatatgtcaatattcgtcagctaatgtacttgctgacaaaaaaaagtattatttccactttgtcatctaatgatagctggtgtgacagttgacaattgccttctcgcagatgctgttatgtgatggaaaattattactacgttcatagcttatattttgctgcaattaggggtcctattcaaaacggatcttggagggtttaacttctagaatgttgggttcctgagcataattagcttgtgtactaagtccacagattacaaataggatggatatcagagtgctcagaggcatgcatagattttggtgattgggctttattgttgtgggatgatttaatgtccaccatcagagatagacaattgtcattaatttcagcattcagaatagatgtattgtggtgctgtgtttacttgtttacttacagtggttggggcccttagttcttaggtattttttgtatagcctgtagtaaagtcaggcatacttatgactatgagagcacctgaacaaaatgtattactccttttaaattaaagcttactgcacttagttgacataaaaatttcatcttcaagaacacttagggcattgtctgtcctctaagtatgcaaagatggcccattggaacctgtaatggtatgagatgacttacctaatatgaaagaacctactccgtatttatttaattgagtttggagcagcactacaggatatttactatttgttatgtcagttttatgtcaatttttgttattgtcattcgacacgtagcaatcatttttaatcaagtccattgtcttctgaaaaaagtagcataaaaaataatggcagaaataatggtgctttggaaaactaaagcttagacaaatgattcatacagtttgtttgtttgtttggtgatttgtaaataaagataataatataacctcatatatcgggcatcttgatgattattagtgtttgggctatagtgatgtcatggataaatatgcgtaattgtttatatgaaagttattatggtttactgtatgctgcatggataaggcttcataattgattatgccaaggtgttacgtatgacattcaatgattttctgaaacttcaaattcttctttgccgtaaaaggagctttgacttttcggggaaaaggtaggcctattatttccgtgccctttttacaaaatgtttctatgtttttgtgcaggaaaccgacaaatctggaggagatcctgacaatcgatatcaagcctggatggaagaagggtacaaaggtaacctttcccaagaaaggcaatgagaagcctaacatcataccatcagacctagtgtttataatagaagagcggtcgcacgctagattcaagcgagacaaggatgatcttatttacacgcataggatctcgctcgtggaggctttgaccggttgcacagtccaactgacaactctggatgggcggaatttaaccgttccagtgaagtccgtcatcaatcctacttctgaagaggttgtgaagggcgaagggatgccaatcacaaaggaaccgtctaagaaaggggatctgaagatcaggtttcagatcaagttccccaccaatctaacgtctgaccaaaagtcagggatccagcaacttttgcctaagccttaactggtagtacaatattgtgaacctgtatttagtcgtttgtttagcagttgggaatacattgagagggtttgatcacagttgctgaatgtacaatcactgcttcggtgcaagtattgaagaacatgtttgcattggtatttccaacattactccaattgattgccaactgctaacagagtagcagcagttcattctgtcaatgtgttcagcttcattgtggaaaagcagattttccttccttgagatatatcctaaaacgttcctttgtttctttctcctagcttaacacttgtaaatatgttccaggtgcatacttgcaactggacactagtaatccttggaccatatctcaattcccaggtgcatatactccctccgtccaaaaaaaaaaaagacaaaccctggtttccgtgtccaacgtttgaccgtccgtcttatttgaaaaaatatgaaaaaaaataaaaagacaagtcacatataaaatattaatcatgttttatcatctaacaacaatgaaaatacgaattataaaaaaaatttatataagacggacggtcaaagttagacacggaaatcaagggtttgcctttttttggggacggagggagtgcttgttactggacacaagtaatccttgggtcatatctcaacttttcttggctatttcctgaaaactactcctgccattttgtcattttgcagtgtttctagccaggtctgatccacagatacattcagtcaggcctcatccacagaaacagtaaaagcaatgaaaactctgctcaatcaacagtgaaaactatgcacagatggggaatgctttgctgatatatgacataaatttgcacatggtgatgataagatccagtgggttccgtaagtgttttccttgctatagttgctacctgagattgacctcatctgctgcttcaaatggtgaagacgacgacatggtgataagattccagaaagttcctgtccgtcgatcgatgattgttgtcagtgaagactgcaagcgttaaaagcaggatggtgatcttcttggacgaggtatgtccgagtgcccctcatgaggctgacggcacgttttggaatcccctagatttccaattccaaatcctactgagaccttaattcgcttaacccaactctaaaagaagtttatataacatctatgaaagtgtgaaattaattttccttaattctcttcaatcctttcctcacgagtattaaccccttatgaagttgacggcacgttttgaaatcccctggaattccaattccaaaacctcccgaggcattgtctggacgttcggttaatcctaagaaagggttcagcagctaggtctcatcatcatcatcttctcctggccggaatatcgccattgccgtcttccagtgagacggctggctggccttttcggccggtgtcgctggccggagtcgctgtcggagagggagaccggaggttgaggagatgatgatgatctgccgtgtccgtaggtgctccactgctcagcaacagtgcaaaaacagtgtagcaacagtgcatatttgcctttttagttgtagaaatactatagttctagtgtggacttttggggattggaaaaatttatcggatcacaaaccaatggttgaggtgacttgaggttgatcctgggggaattcagaaaggcttcatttgatatggagttatcatataataatagaagcacaaaagtgtcatggattgctgaacaagaggctcgcgatgtgtcggcaagtaacaaccgaaaatcagcatcgaaactattggtatgtttggttatctaccctatattttagtaatggtaaattcttggtatattctagcgagaaccgataaggggcaagggaaagaatatacaattagcatgttttggtttggggacaaggtgggactcatttttttttaggatgagatgatcccatctatctgttggcattagggatgtgatgatcatacttttaaagtaatagcccatatatcgaccagagaaaaagttggttggattagtccgccaatttttaaaggatcatgccaaactggatcttagggaaatattctctatcaaggatcatcttatcccacatgtccctaaccaaacacattgaaaaataggttcaacctaacccgattcatctcaaccctttaaccaaacgtatgcttaatgttgctgttgtattcttatgatatactatgatgttttttctttaaagaatggtcaagggagggggggagtttttccacctgaattttttcatataacagttcgaaaagagggattacacagttttggctcagattacagggtatctcaaagaggaggaaagggtttcctttcacgaggaaacaaccactctatcattaacgttaagacattcctcccagaggatggcgtcctctaagcatttcatcactaatctcctcatcaaagattgcatcccgtggaacacaacatcatgacggtgaatatgatgttttcatttctccaagaggttcactttgtcaatgtttatgtaatgacaagcagatgacattacgaataatgcaaattaatggccagctataatgcccctttaagatggttgctgtcaagagtggtccatcaagatcttaggaaaaaggggcgaaatagccatcagaaaatatttgcctagctagggagtatatcttgcttttccattgtggttgtcagacaacgctatgccttttcctttttattggttgctacctttataatcagataacgatcgattttgcaggtgcggcagtatgtaccgacaactgatcaagtcctcccatgttcaaaaaaacacattatttgttattagaaaaaacatattaaaaaacacattattttgggtgtcgccaagagctccaagcaaaactcttggtagctattttattttctaccaaggcattttatagaacctgctaaaattatgatattatgaaaccaattttttgtgtaaatccacgtgtacagattcgatacatccaattctatacctggggtgtaaaagactgaagattttaaaatatcatgaccacaattcatcccataggagttgagaaaaaatccctatgttccaaacaacgcgtcacagggtacatccaacttgtcatgactatcttgccttaaaaaagaacttttcatgactatcttatagaggaatcctttattaatctaaaaaatgtaaaatcctaagggaaatcactggatgtgtagtattaaaggcgtgtgtgcatggttccaccctaccaggaattcaaaaatcaattataggagcaggtgagcactttcaataaaaatttagtgagactaatgatttgtctttaacaatatagcccagtcccgcgcggtcacgcaggcctgccctgcggcatcgacccgtgtgtgtgcatacatgcgtatatgcatgcatgtgcagcgggctgatcggtcacgcgtggccggcctgagtaaccgcgcagtgccgtgctgctggtccgcgagaccgacgcggtggttgcgtccccccgtgtgccaccacgataccgctctcccgggttgcgggagcgaggcggtcccgcatggctgggctatgggatcgccggtcccgtggaatggtaatgcgggaccgtctcggtcccgcgtaaccatactgcgggagaggtatatttgtgtaaattttcggcacatagatatataaacgcaagataatgaaaaaagagatatatttttaaatttaattcgctgtttgagccggtgttaattaagagagcacactcagtgagttgagtgtgcatgtttagtgtacatgcgtagtggtgtgtatatattctctccgttctaaaatgtttgacgttgttgattttttcataacatttgattattttcagtgttgattttttcgcactgtttagtgttagccgttaaaaaaatatttatcttatttaaaagtttcatataaatatgtaaaagtataacataatattatagtttcttacatgataaaacaaatcacaacaaataaataatatttatttttaaataagaagaatggtcaaatgctatcagacaagttaacaacgccatatattttgactcagagaagaaaaaaaattaggaaaaacctcactcgctcattgatcgacacgttagtgacctgcgtgcacaagtccccccttatctttcttgacacccgttatttcgaattaacacacaaatgggaaaaaaaacatgtaatataagctagtctgcacacacatgtcgctgacaaagacgagaaatcgttttcgttcacgtgccaggtgaagggaataatatattttgggataccatttggttgtggatgcatttgagcaaattagtccatatatgctttccaatgtcattttcaagcaacaataatggagtttcgatttctttttttaacccttttttcttttgtcttcacctttgccttccattgtggctatggttaaggtgatgatcatgaccaggagtttccttggtagatagcaagtaatgtcattatcttagtatcttcctcgagctaactagccagttattaattaattagataattaattattccaaagagatcatatcgatccatatatgtttattcatactttcctgatctccaaataaacaaaccgagatacgttctggtattacgaatttgtacatactgatcagtctctagtattagatttatttattttgagatgaagagagtttaggatataactaaccatgtgatgatcaattagtgacgtgggaggatgtgcgtatatgctagtagctaatcatgctattagctatagctagttaataattatagctagctaggagggataacctcttgttaaatcacatggattagttaatcaaatcagatagaacaacaagagaatactagtatataaactgatcattaatttgatcgagaaccgacgatgacaagacaatcaattgcagatcgcaacaaactttaaataattccgtttcatcacatgaatcgacaaaaagctagtagctagctagcatgtccatattaattaatttattactaatca

SEQ ID NO: 59154 - DNA, 28708 bp, Oryza sativa
ttttcgcaaacttatgcgtacatgtggaccttcccccgccagggaaaatgctttttggccccatggaaaaacacattttctagtagtgaaacgtaatttaatcgaactcttcgatagtattgccaatgtatataattattgcatggacaacgatgctcgacggagacacatacgtggataaagcggagccacggatggactcgcgacataccaatcggactaaacggaaacaacttcaatcgtgctgttgctagtcaaaatttggaaaatccaattatataccaatgtataccaacgcaaaaaccaattcaaacacggacaatgtaccaaagtagtggtagaaacatcttcaatttctataatatagaaaaatgcccgtgcgttgcaatgggtgaatgttattttaatcttattattgttatacggttttagctaggataaaatttacggtgggaattcgcttagatttttttttataaaatcatgagctgcaattaggaatctgacttccatatcaagttagcatgcatgtttttttaaaaaatttcttatctgacttcttttgtattttcaaaagcaaacgaacttaaaatctgactcgtacactgatctgtattttcaaaagcggaggaacttaaaaaccaactcaaatacaaatgacgtatcaaaataccagcaaaaacatcttcaatttttataatagtagagatttcaatcgggtgtagtgtaacaattaatggcacaatgtgggatgacacgagatgatgagagtcgagtagcagacgaaaattccatcagaagtcttatgaatttttttttaattaagtatagatagatggatactgaatgcaaatttgatacatgaaatttagctccgaggaagtggaaaatatagatttgggagtaataaccgaaatatttcttctttaatttaatttgggatgtgtaactcatttgcataaactatagttccatactaatggctataactttagtgcacgctgcatgcacgcatacatgaaactctcatctgacaaatcaattcttggcagtcagcagcaatgccgcatgatcatcagtgacgccatgcttttctccattgcatgcaagacgatgcaaactgcaaacatgatcggtaatgatcgtgaaaggcacggtccggtgggccatgcgacacacgagccggagacagaacacagagcggacgaaaaaaaaaagatggtgacgctgagacgtgagatatcgggagtcaagacatgacgcaaaatctgccttccatctccatcgcgcgtctggattctgcgtgccacggacaagtcaagcccaagccgaatagaaatcaaacacaaattttcacgatgtacgaaaaaactctgataaaaacatcttaaacttttataaaaacttttataatagtaaagatagtgttatataatagtagagaaagatataaaagtagagatagggatatataatagtagagaaagataaaagttaacataaaagttcgaagaaaaaggctacgatataaacatgtccaggaatatcacgaagcatgcattgagcatgttgtcacatatgcatcagccaacaaagcatatatgaatcgtggatggcacccaacccaatggcatctctactggtactaatataatatataagtaaattaataagtacggagtatataagtagataagagacaaatcaataaaaaaatctatgttacgcaactgcgctgttattaagcttgcaaattctgagaggaagaagcttaagcaatcaagggcttatacactgtggtttgcgcctggttggtcgatggtgtccatcagtgtagatcatcgagaggtctcgacgctggtagggtagcgtaacgtgcttcgtcgatatacgtaagtagtgagggcacacgaggtgcgagcgcgattgtccgtccggcggcggcgttcatggaaggtattatgtcagcggaagggtgtccgagcatgaccgagtcgaagagaggcttggacggactacgacactgaaaggatcttgatgtcacctagaggggggtgaataggcgttctcaaattttttcacaacttaatagcatattagagtgatgagaactttcaattcaaatcggaacttccggtatggtaacactaaaagagatcttatgataggtggcgtttcatttacgtcataaacattaaatttacgtcatgttgtgtaatctttgacgctcgcgtgacgaattttcattcattacctatcatgcgtctctaatggcgtttgtcagaggggtgaccctctctagcgggaggctgtgaggccccctttgtgagttcggccgggggcagcgggtgagattcgaggattcggtgagcgaagccgtgtgatattgagggggtcgagcccacaaagacgatgagaccaaaagggtttatataggttcggccgctaacaagcgtaataccctactcctgtgctatgctccttgagtgaaggattacaagctctccttgttggagtaaaatgtggtgttgatcatcagggctagagactgctctggagcgtccaatggatcgtctcgtatccgtccctcccccttttactaggcctggacttccttttatacctcaaggggttaccacatgggcccaaaaacctagctccggtggagaagtgctttgtattaaatgcctgtcttgtctcttgacttgggaagcaagcgcacgtcatctttatgatggggcctatcaaatcttgctgcctgacacgaagggcgcccatgtcagctgctattaataggagaagacttccgggtccctatttgcaccgggaaacgggaaccccaattgaccagggcggatggaccgactctggccgggatgagaggttaagacctctcgtcatcatgactgatgggacaagacagggagctcgccccctgacccatgcaatagtacgcctgacaccccgtgtcccattagtcattcaaccggtcacaaaccaatttagcgcgtgctgcacgccccattaaatgcggcgtggcgcgcctgctcaggtcgtcattaatgcgggtaggtgagcgctcgaaggtggccacctaacccaccgcacgtggcaacccgctgaaggggtcgggggagcccgacccctagtcacatgagggagtggcgtccgccccgcctagtctagagacccccaggcccatatcaccgacagtattctatgacgaaaccttttttttttgtcattaatctagtgacgatccttctgtcgtcgtagagttatgacgcccattttcgtcactatcaagcctaaaaatcgtcataagattctatgtggcctgttaaggcccatgtagtgagcaacctgtttatgggctaggtctattgtaaatccaattagatttttaataaattcagcccaattatacaatatccatctatattaagtgagctatacatattcaaaaggcccaatagacccaagcattgcaatgaaattgaatttgggccatgcatactcaagaagcccatatatcaaacagaacgagctcagttaaaatccaatacaaaacccaattaacattcacatatctgacatcttatagcccaattaacaacattcagctcacattaatacaaattcacaaaacaggctatcacaaattcagaaaaaaaaacaaagatcgcaggttatcctcaagtcagttacatgacaagtcagttaattacatccacaaatcactatccaaaacatgttcaattacatcacaggttcattgaccataccggaagttttggtctcaaccgaaaagttcggcggataacggaataaacactaactataaacttgtagctcgaacaaacaaaatgtatattaatcaaaaggtgacaaacaaggtatctaaacaagatataaaatcaccaactatattaattaagcatgcaaatagatcgggtaaaaacaagctcaagcacaatatgagagatggtaagaacgagcaaacctaagagaggagacacattgatttgtttcccgaagttcggatccacggatcctatgtctccgttgaggggccacaaggccgggtctattttaaccctttcctcacgaggttgcacaaatgcactcctcggtttcactcttgattttttcccttgcggaggtgaaatcgaagcctttacaaactttatgtggcacaccacaaccttgggtgctcaccggcgacgcctagccgtctaggagaccttagtctcaagagtaacaaatacaatcgaagatttgcttgctatgaacttgagtgctcaaagtatggagtgaagctcactagctctcaacttctcaatctctcaatccaactctctccccttctcaaatccctctcacaaagaggcaccacaaaggatggagtgaagctcactagctctcaacttctcaatctctcaatccaactctctccccttctcaaatccctctcacaaagaggcactacaaaggtagggaaatgaggatagctatttggctttggatgtatctaatgttgtccaagaacagcagccactcaaaggaggggtggaggagtttatatacccgagcctcccaaaaattagccgttggaggccaagactgtaattttcggaatttccgaaaagcattttcagaaaaaactgaaaatttatataagcaaatctcagtttcgtagccatttttggaattttcgataatttttcggaatttccggaaagcacagagtaaaacgtccataacttttttgctcgggagtccgttttttatgatcttggattctatggaaagctcactcagaggactaaccaactcaaccaaaaacaaagtctaaaaccacttaaaggatatgttaaatcttgggtttctcttaaggtagcattatgataggtcactttgagcaccgagacatacacaaacacctcaacattgcatccctcttaatagtacggcattcctaaactcaaatgtaaataggaagagaattataccaataggaatgccttcttcccatctttctttcatgggacaatttcgtttttgcccccactttcatcttcaatattgattttgcccctactttttagggttttcgtttttgcccccacctttttgaactggaagaggcgtttacccctgctttggatggaagttagtgggaccgggtatatggcagtaaaaaaatagagaaataaatgaaataaatttttttcgaatttgtgttttacttttttacccctggcactagtctaatggagaatcgattctttcccccaacctcgctgcttctctcgattgtacaggcagcggcggcgacctggcagcggcggcggctagggcgcagctcctcccgtcagcggcagcgagcagcggccaagcggctacgagcggcggggagagggtaggtggcggcggtgggtgcacgggagaaacgaagctctcctggtagacatgttgcgtcgcgaggagacatcgtcaccatcgtcgtcgtcaccgccgaactccctgtcggcggccaccacctcgcccctcttgagtcttttgaggttgtaaaccccataccgatgcccctgacttgaccggagcagtgcgtccccaccaccgctgtcgtcgctcatgtgggcgacgaagaaccccatcatcctggccacgtcgccgaggaacccggcggcgacgcggtacacgcattcccatgcctcctcgtcgtagtcccggagcagccacagcgccaacactccgtcgccgtctgcgtcgtacgacgaagcggccatggtgccctgtactccgttgagctggctggtccagtcggcatcttgggagtagtcgcacggcctgcgcatcgtgcggaactcctctgccgccgtatcgaacaccagcacagtgcggaacacctcccccgtcaggacgttctagtggaggcagccgcacagggtcatcggcgtccggacgttctagtggacctcagccgtgcagggtcaccggtaggtgatgccacgatgtgttcgaggtaaggtacatgtcgccgtttggcggccccagcagcctcgccattttcttgcccctggcaatagtctaacagataataattttccaaagccatgtataatggaagcaaaaacaacatcaatgaatagagatggaagagggtataaatgtcctacttaacaccgttaactcctccatccaaaacaggggcaaaagcctcttccggttcaaaaaaaactgggggcaaaaatgaaaaccctaaaaagtaggggcaaaatcaatattggagatgaaagtgggggcaaaaacgaaattgtcccttctttcatcgtcttaagggacgccaatgctaaaaccgtttcaccatatctttttcaaatgattgatgcggttacttgtagcttcaaatggcctcgcacggtccatcatgacaaagccgtcacttgcccttcatcactggatttggttcttgtcacgccttgaagttcttctccctagccaaaattcaattaataaattgttgcaagaaattatttgtttaaaggcaagagagaaaccctaaatcaaaaaaatgcaaataataatcagaatcaacatgtggaatttttcttgagttctaaatgtcaaaatatgctaacaggatttttagtggaattttcagagccatggaaataattttaaccaattaaaaatgagcatgtgcattatttaatcccaagaaaatcccccttttcattttctcttctttttcctccctttttcctttttcttgggccgtaaacccactcccttgcgcgcccgattgctcgctgggccggcccactccctccctcctctctccaagtcaccgacaggtggggcccacctgtcggccccgtcttcctcttccaaccggcagcaactgccgcccacgccgccgcttcctccgcatccacgcccccactccgcgcccacacgcccccccacgtcgccgcccccacgccccgccttctcccgccacgcgcacgcgcccgcaaaggcgggattcaattcgaatccccccgctctctctccacctcccacgtcgccggcgaaatcgggagcctccccggccacgtctgcctccccggccacgtccgcctccccctccgcctataaaacgctccccgtgtccccctctctcttttttcgctttcgccgagcttccccgtgccctcctttgctcccgagccgcttcactcatcgacgccgccctccggccgtgctccggccgtcgctagccgtcactagccgccgcgtgaagcctcaccgcgtccgccatccgcccagccaaatccaccgtcagggcctgcttcaccccgcacgccggtgagtaccaccattgccgccgccttcggccatgggtttcggtcgctgtggactccctctctttccctctaacctctctcttttcctctcttagggtgtcccgtagctcggccgccgttcgtcgtcgccctccggtcgctcgccgtcgccgttagtcgtcgcctcctcccgcgccggccgaaccccggtgaggcaccccctcccctttttcccccttcctctccctcctagcgccgagccgcgccgtcgtcgtcgtccggcgcttcaccgtcgtgccgccgcgtcgccgcgtgccgccgcttgtcgccggtcatgccggctgccgccgccacttccgcgcgcaccgttgccccatggccggccggccgacttggagccgtgccgagccaggcaccacgtcccctcccttggagccgcttctagtagggcctgcctgccagccgccccctctccgcttaaaaatggttttgtttcctgtttcagtagtcttatagcatgttttgcttgtgtgctttgtttgtcgcatagatttcggccgtttcgtcgatccgcggtttcttgaagacgttgctgtggtctcatcagtgcgagagcaaggcaagtcatgcattataattgatcatattgtacccaatttacaaatgtcccgcatttctattaaaggttgcattatttcataatatcatgtgggatgggtcctactactcagccatatatattgtttaccttataccattgataacttgggtatcaaaatgattagatgttggattagggattgcttagccatgcttagttcaagtagtacacaaagggggaattacattaatgcatagacattattggtatagctttggattagtgccaccgtaatggtgttagttaattaaaatacactacgtggtgggctgtgggtgcatggtttttctagtcgtgcccatggcgattaaggaccggttcgcgggatgccctggaagaacttatcgtacttaccacaagccagcgtgggcaacggctgggcttgtagtgtagctttcctctagccgacgtacccgggcgagagtgggcgtgatggagttgggtcggccgaggtgtctggttgatcggcttccggattcaccgcggcacgagaggggggctgcccgttgcctgctggggacaggggcgaaccctgaggtgtggtgcgatcggttagagggggctatgcgaagggtcctgtcatggtctctttctggtatgtcgtggtggcatgtcggcgcacggaaacatgtcgtggggctgtgtcttgtgggtacagttgtacacctctgatcagagtaaaactattcgaatagccatgcccgcggttatgggcggtcgaccagattcaccgtgattagtctcaccctagttagctattgaattggtgtagttcaggtggttggttgggcctgttgcaacgtggtgtagcgttgagcagtgattggttaatatggattaattactacaactgttttactgctttcaactactgcttttaaatgcctgctttgtgcaaatgaacctttagcctcccttggatatatcctgcatcataccttctcttccggtatgacttgctgggtacagtgggtagtactcagtcttactctcttttcccccacaccagagttgaagttcttctcagttggagatgtctcgaagaagttggtttcgtcgctgctgtcaaggatgcctatggaatggaattgcccgctgcaggagtcaagtcttcagacttagctcgcttttatcttttccgctgcatttgtaatcttttatatttttgtaagacgtggatctgtatgtcaacaattgtcatttgtgtaccctagctggtcctggacagggggtttaatgcacattcagcttagaaattctggttcgtgaatttctgggcgtgacagttcttcggcgccaagccccttgcttgcccttcaccgccgcatggtccatcgtgactgagcttcacatggccttcaccgtcttgccatggtagccacttcgtatcccacatcttcaatatcttcactttgtcattcttggtattgttaggtgtaattatatcacttgagcatcaacatatttgcaatccttgggacctatttctttcattcaactaaataaaattattagtcccaatgatccggttggcaacctccacatgttgaccaacccatcacatgtataaaaaaatatgaataaatgatgagtattaatcaataccacaagtgtcatatactcaaatatatgctcaaatgtaaagatcccaattaaatgaaagtgaataacttggatcgattacatgcataactaaaatatatgatttgctcctcctaaatgtatgcatacaaaatgtttgtatgaagcaagagtatgcataaaagaatgaaacattaggagcttaccctatacaagaatagaatgcatttatcaaatataagcactaaaataaatgtataccttcatcatcttcatgttctgaatgtaaagagactaaacaagagaaaagactcaaacaaaacattagtctcacatgtatattgttattcacatggaaatattatatatgaacgtatcaatatgtacatgaagagaaagagtgatacatatagcttgatctccatgcatttcatcattgtgatttaggtccaccatcaatgaatatttctatctcaactcataagaagttcgggaatcacctctcacacactctactttcatatccacatgagactaggcaaagaaatgcttataaaaacatcagtatcacataattggatttgtcattaatcaccaaaacctaattaatggcacttgaactttcagacacatattagtattgcacggttgatgggcctcccgagagctactccattaggtctcccctaatccaatcctatctgccgacccatatatgtgatatatatgatagggctagcgtgaaagatggatggcgaatacgtatgaaagacggacaacgtaccaagcacccaacaaaaacattttttatttttataatagtagaaatagagaggtggaacggtagaaacacctctaattttttataatactccctcaatcccaaaaaaaaaaggccaatcctagcatcccaatgtaaaattagtggggagtaaaaatgcccaaaatagccctcattattggaaaaagtaataatggtgataggtaggcaatgatatttaagagataaaacttctcgttttatgtgctgagagtaggtaggatggtagaagttagttttttttggataaaatttaaactgtagaagttgagttttttttgggacgaaagggtaatagatatagaggggtgggactgtagaaatactacgaatcttttaagtaggtaaaaattatgaattgtaactttattccctatttagcttgtattaattaattgtccaatcttttatctaagaaaataatagaattttgtttataaatatgtaataggaggttgtcatagaggatgagaaaagttataaaaatgattcagttggctaaaattttgacatccccttaaagaaaacttctgaaataacaacgaaaaaaaattgtacaacaaaaccttaatggagaaaggtagagaaaacgtgcattatgcagtaaaaccatacactttaacgtttgtgaacacttgtactcctagacctgttacacctgtacatgtaggagatgccatgcttctacggctttaccccataatttctcatagatagtccttacaatctgtgcataatacctcctctaacattgactccttgcatgaaaaaaatatgatgaacatttaacctacggttacacagatgcatgatattcataagtttcctttttaacataaatgaaaatcaacacaaggaacttattggatatattaatatagcacagtagacttaatttctactgttttttttataaaaaagaacactagcaccctagagcagtctcatcggtgatgatgtagaaagatatgggtcttttcgtcggccaccacactaaaccatcaagaaaatattaggatatatataatggacaagatcgtagatagagatagatcaagatgtttcttgccatttgcatattttgtcgttgtgttggaggtatgttgtaggtcggtggaatagagtgcccgtggaccgctggattctcaaatgacaaaaaaataacaggtaagacgcgtgacataaatcattattatattaaaaagtcaaaaaaaaaggaaacaatgttgatagaccattgtttcgttagaggttggggagttgaaaaagaagggaacttatacactaagacgattggatttaaattagatggaaggttgagaattaagctgatcctaaacgattttgttatacatttgttgataaattttctttcaaaaattacagtgtaattacatcataacttacgtgtaattacaaattgtaacttttacataattttgaatcgttaaatttgtttcaaggattcgtgcgagcgaggatggaaaaaatcacaacgtgcgtacgagtgaggggatttcataaaaaaaacatccgctctgcgtaaatagcgtgttaccatgagatttatgaaactttcatataatttataagggacataatgtaatcaccctataattaaactactatatttacatccgttatattttgtagagagaatttagcaacaaacgttttgatagtctcgatgccaaccaacacggcttgaactaccgggggttgttgggcctatttcccatctggacgcagtactttgtcccaaaatcggaaacccgtactatctccgtcacacccctctccacccactgtcatgtgggtcccacgggacccgcgtcgtcggtgggccccacatggcagcggccgcgcggctccccgcggtgggacttgggagagtgtgtgtgtgggccccgccgcatataaaaatcgctacgcgcacacgcgacgaaatcctcctctcgttcgcctcgtcttctcttctccccccacttcctccgcctcctccgccgccgcgcttttcgccgccgcggcgagccatggacgccgcagggtagggttcctctcgccccttctacgtcgtggaggaaccgcgtgggccgattctgggtgggggggttttgggatgattttttgattatttttttatctctctttttttggttttcctcgcagttacccgaagatgcaaggaggaggggcgtcctcctcgtcgtcgtcctcggcttcctgccgcgccgccgacgcagccgtgtgggacgcggtgcagcagcagaagcggcagcgctgccaggtaccccccgtcgcgttcttgcgcccccgccccccgaaagttctgggcctgaaatcgcaggaagttataagtttttttctttttgcgccgttggttgggtgtaatctgagcgggtttttgtgcaatccgggatgcgatcgttgtgttttgtttgatctactaggccgtcgatccgatcgatcatggtacgaggggttttggtttttctgtgttgctatgtttgagagattcgttcttggcgagattgttaaatctaggtttttcttttctcctgggatttagtttctgttggatcaaaccggtgggattgtggtgtcgtggttttcattgaggtggaatcatcgtgttggtggtagggttttgggttttgggggtgatttgatcttgggttgggatctgtttattttttatattttcgatcacacggaagacgtacatgcaccaaatgcacatttatgattaaaggagaagattgtttcttttttaccaaacatatgcggatcaaatcacttcttacaacaagaagaaatctttctcggtatcaatccccttgcccctcattctttgagaattagaaggatccttttcgagtttctatttcttcatttggaatctgggctcttctatcttcaacttatttttttttcgctttattctttaatagaaaaatgtccgtgcgaggcaacgggtgaagactattttaatcttattattgttatatatggtttagttaaggtgaaattaaatgtgttaaattcgcttggatacatattttgttagaaaatcatgagctgcaattaagagtccaatcgtctcaagttagcatgtaagtttttttaaagagatttcttatatgattccttctgtattttcaaaagcgaacgaacttaaaaaccgagtcaaatacggatttgtatttccaaaagcgaacaaactcaaaaactgactcatacacggatgacgtaccaaagtattggcaaaaacatcttcaatttttgtaatagtagagatttatttcacacgagtgtgccaccaaacgtttatgattaaagagattgagactagagaccagcggcaaatcagttttgtttaggtttattatatggtagaatggaggttttgtttattcttttaactcctagctagcattacttgtagattgggttagtgatttggggtgtttggcactattctcatgtgctaattctgtactaattctgagcagtagtgacatttgcctttgtctgaatttatacaaaccattgaagtgccctagtgttgtgatggaaatccatattatgtaacaaatatcatccttgttagatcatatggaagctatattagtagagattcttcgtgatttgtgaggtttttatgcagtgtaggcttagtcatcagctgtaatatcatatatggttggacttgcacgatttggtagatattgcgacatgtgttgctttcaataaggaaattttatttttttcagcttgtagattcaaggatgattacatttatgatatgcaaaaactacataagatgttcttacatgctagtctattgtgtatgtgtaggatccatagacttgaagttgaagctgcatagattatttgcttcgctcctattattactaaccaaagatcaattctatattgatccaaatcaatacgtatgctcccatctttaataggattcctgctaaactcatacatgtactgtaatgtgcttcgctatgggtatttggttactacatatcacgtatgtaggcgtataatcgtcaatttgacagcataagcaacaaggaagccaaaataaaattgtatttccaacgtagcagggtatgaatcatctgtatgattgagtaattagacttgtacagaaatagggcagtgaatctgaaaacaacagttttactttggggtgtgtgtagagaccatctgatcactggaaattaaaaggaaaaagtctgtgccttgttttccacttgacttcctgaaccttttttgcgtccattttagctccctaagtcgctatgctgggttatgttacctcatgctggtttcaacatataaggggggcatattcatcattgcataagtgtttcacattatattcatcattgcaaactatgatgttgaaacccttatatgtcgaattcgccccttatgctggtttcacatattcatgattggttgaatggttggcaataatcccttattgcttcagtttttgtaatgtaaatatattgctcctccaacatcgtagtttgtgttatctacattatattctcatgtaatcaagtaatatgcttaatgtcatcggttgtcatgcaagatctgatcctagatgttaatgatgaatatcaataaaatcataatatgcgaaactaaatttacaaaagtaataacggtgactgaaatcctgtcttttttgtgcaagctgtctaagatctttttatttcttacaataaccatgacatactttgtagggttcttcatccaatgatcaagttggactcagtactgaaaataattccttccaagcacctgaacctgagctgcagaattctgactgtgtggaagatgaggaagaagattactatttgtatgatgaggatgatgtctgctatgatgatgatggagactatgaatttgatgaaactgacttcaatcagcagctagctgataagtttgatggtttggatttgcctccgggagtggaggctaccgttccatggctgcaaaaaaaggatattgctgatggacctagcactttcaagtcaatggcagaactagatgctgatattactaagaaatatgaattctttaagcagtttgatgttgttgagaatttttcggaccatcattatgctgataagcctgttgggaaggtaagagatcatatgcatatttgtatcattttatactcctttcttcagatcaaaactaactttttttaaataaaaatatcagacagggaaagactggacaaaaaggattcagtatgactggaaacttctggagaaagatttaccaggtcaacttcggaaagaacagttgtatcattgttgttataaatgttgcatctgcatatttattgaaatttcttttagttctttaatcaacattgagcattctgctttgtactcgtaaaaaactgttctgtaaaagcttgaggtatcttttgtagagatgcaaatgttgatgatgaaatgctcatattgttagtcctatcgattcataacttcactactttaaaatacttctatttacacagttttagaataccctgtggctcacagatataggagctccagaggtttacaaactacatccatgacttgcaatacatatgtacactgttgtagatgaagttagagatatgcttgctctgtcttgatatgttttattccataaatacataattcttgtaattctgattctttttcttctgtgcagcatccatatatgtccgtgtgtctgaaaatcgaatggaccttctgagggctgtaataattggacctcaaggaacaccttaccatgatggccttttcttctttgatgctcaatttactagtacttatccatctactcctccagtacgtgttcaaaaattgttcttgtcattttttatttaatttatttatgttttgattgaaatatctaagctgatatttttttcccaggtggtatattatcattctggagggcttcggctcaatccaaatttatatgcttgtggaaaagtctgtcttagcctgctaggcacctggtctggtagtggttgtgagaagtggaactcagctcactcaactatgctacaggttttagtctccattcaagctctcgtattgaatgagaacccatacttcaatgagccaggatatgagacctatgccaacagtgctactggacagaagagtgccatggactataatgataccacatttcagtactcatgcaggacgatgttatactcactccgtagatctccacaggtaatgttgtgctgcttatcaagctcttttgtactacctccgtcccaaaatgtaagcatttttagctatgaatctagacaactatgtgttcaggttcatagctaaaagttgctatattttgggacggagggagtagcatagaaataatcatccattaggcatttgaataacatttcttttacaattattattgtggcatgcttatctgtttctttgattatgagcatggcactcttttgcctgtaactgatgcgattccatagcttacacacaagaccatctaataacatcccttgtcatttattatttgtttcagcactttgatgcccttgtagctggccacttccgccaccgtggtcatgccattctggctgcatgcaaatattacatggaaggtcataaggttgggtccgtagtccctaacgaggacgaggaggatgcgaagcagcaggacgacactgatgcaggaggatccggcagcagcagcggagcaaagccgcagcctgaaaagccagacctgtgcaagggccgtgctgcatccttcaaaaccaacatggccgttctgtttgaggagctcttgatggaattcaacgtcaagggtgctgacaccaagaagttctgcgatgagaagttgaagaagaaccagcaggctgctgctgctgctcgctgaagaggccccccagctgcagctacaaaacgcacagatcttctctagttctgagggtttcataatgaagcgaaaaccgtagaaaggggttttgcttgcctaactatagaagtgctgtgtagatagtccattctcgtttttctccttttgttgtacaggttgagtgtgtggacttaaaaaatttaaatgatcatgttagatgctaactgaagtatcatcaacccacccctcgttgtggtgcgatcatgaaatagacacctgcataagtaagcaaggtggcggttccatatgatttatgttggcttgcatttaggttacaccgtgttacttgcaagagtttctccatcggctagcgtggtggctttgatcatatggttagatttgccctttttcttgtgagttcactttttttgcagctaacattgcgttagtttcaaactgctttactaatagatttaattcaaccttgagttgacatttatcttctcggaaacatatgaataattctttactgacggatgtaattcgaccttgagataaccattatcttgtatgaaacatttgaacaatttgtgcgatttatcgtggctagactttttttttatcatctgttctgatagtatcttttacttgtgacagtagtagagtagcagaatttaatctaaccattgaattgctataggtatttaaaacattttatttaaaaatttgacaagtacaactttaataattcatctatggcaacatttcataattttacccctcaaaagtatttgttattcacataaccagataagattcatatatattggtttacttaaacgccgtaggagcggtgaaaatttagagcgctacgtcagcattttttacaaaaacccccctgcgctttcggttaattatgtgccggtttccgctgctgtccactgtcagatctcaccatagggtcgatctggccgtctacgtgtcccgctgtgtcggccctttctcagccgtgggatagtcaaatcgcgaatgaatggcgtagattttgtccagccggaccaaaccctagcccctgcgcccgtctcgcccgcagcctgccgcagcaacgccgccacctcgcccttctacgcagccacgccgctgccaccgtcgcctttctcctttgcgcgagccgtcgccgacgcatcctcgccctcctccaaccatcatcgccgtgccgctcataaaccctagccgcactaccaggctcgcacacacgtgatctcgcctgccgccgccgccactgctcgcctgtcgccgccgccgccgttgctcgcctgctgtcgtgccgctcccctcgctccgcacaccagacgcggcctcttcctcgctgtctcacggtctctgcccaggcaccggcctcgcgctcctcgcctttctctcgcgtgaggcagagacggcggcggaggcgcgtcgcctcacctgctcgcccgcccgccctctcgcctacattgcctccttctctgccctcccatcctccctctcgctccctaattccgtcggcccctctctactatgaccaatcgatgcctccaatccccagcctcacctcccaaaccctaggttggcctaaagcatcatcgaagatggcattgctggagcagggggtgggggtttcgtctacgatgcgctgccatggatttgaggctcctgacccaaacctctaaggtcgtttcaatctccagcgatcaaggtatcgtggccaaccaagaacgctgctccgatgtgcatatctgcctccgttcccctctcaaattgcatgctatgtaccgtcagaggagctcttattgataatgtatagacgatatgtgttttgaagctcttagtatttcaagcatcaggtaggctttcagtcacttactgattaacattttttttctttgtgtatttgctctcactgcccacttggttcttcatgtaatttctagatgaattagacttggcgctaatagaactagattttaagttaaatagatgatttatatgcaggaagatccgatttacttcaatactctactatctacatgccattttcagtatttttgttgtatgactattatacctatcctagcaatgttacatacatatcattggaccaaatggatttgatccttctttacatttttaattctcttagctggtagatcattgaatggttaatatggtcaattatgggttgtatgctaatatggtgtatatttgtctacaggattttttcccttccctttccctatcatccttctctattgtgaggtattactttttatttttattttactcatccaggccttctgcaatagttattttgatggaattgttgtagttttcataattatattcagttatcggtcttttaaaactgaattactagctatgagctcataatagtagcagagcatttgtcgttgtaaacagagatgatttcctacagcccactaaggagtgatggcaggatagatgtggctcttatgtatcctggtgattcaccttgaactattaaaaagaatctttgtccaatcaagtaatgcctcctatttgcataaatgaatattcagtttaaatgcattgggtctactcagcccatttcagtgtattgccagctctttctgaatgctacttaattagttttctcaaatatgtagaataaatgactccatagttaaagttttccaatccaaccataagctcattcattttcttccctttaatgcaggaaacacttttactagcactagcacctcaaaatttgagcaagaaaagttattttagcatcggaactgcatggttaatggtgattagtaagttcctttcaccgtactttgataacttgatatgacaaagagataacagaattccccaaaaggtgttataattttaactggatgtacgataactgtagtatactttcctatgggattgtaaaattcattgtttattttgtcaaccttcaaaatcattgtcatcggcaagcatagactaatcttcttttcttttaccgttgcatgtcttctagagagggagttttcagtcgtaatatatgcaacacagagcatatccgatatactttccatccgtgggggaaagtagtttagatgttgggtgagtgcatttcattgctggagtgtaccagtgtaaaatgtgctgaaattatttcgtaactaataaagcaaatttacaaccttctgttttgtatacaggttaatggtgattagtaagtctctctgacgtgttgtgcctgttatgcttaattcaatattgagtttgtagttctcttggaccttagatatattaattattcagtgacatcatcgaccggcgcagcctttgcccccggcatggagttggatctcgctgccgccgcaagttgccaggattgattcattgccgttgcggcctgatagacctgcgctgcgggcctgcggctaggagcaatacgctgcttcatcgtcatcgtccagaacaccaaccgtgtccaggtaggatgcctaaattcctcctgttcaatttgttctctttggctaatcggatcctgtgcatctgggataaggaggaggataaataattggggtgatgccaataaatttttctctttaacagatgccttctagatgcttggtaaaattcctagaagaagatctaagtttactctcaaaatatatttgtttctgcagctttcttaattataatgtcttataattttgtatcagttaacttctacacaaataacttctcactaataatgataaaatattgaagatgggccatacaccatctatgtcatttatcagagatgtacaggttcaagcaaggttgtcagtatcccgatacgtagtatcttacgatattacgatcctaccaagccgaaacgataccgatcccacctagtatcctaattttcatagtatctcaatcctactattcattagtacacgatcctatgaaatcttaggtggtatcccgattctacgatccctacgatactacgaaatattatttaaaataacatggtatgaaaataatgtaaataaatatgctcaaatttatataaaaatcagttaaatatatcaaaaccaacgtggtttctcttaataaatgcctctatttgcatgacatatatcattactatattttttatatagaatggctacatataattaatataaatattaattaaactttaaaaaagaaaatctcatagtatcccgatactacgatacgatcctacgatacgatattactttgagcaaaacgatactacctagtatcccgatcctaacaaccttgggttcaagattcatacatggtccttcataatgtaatcctgatgtacgtaggtacatatacaggccaattgtttctggaatcttaaataaatttggtctaaaagaatatatgctttgaaaaaaattctgatttttattattctcagttacactgattcaagaatgtagatatgagtatatggcatggtactacatggaagttgtgattttatttgccaagatatatacttgaaaatatactaagttagtttggagggtacgagttttgatgttcttggcttagcttcccttttcctatagatgttaatgagttaattctgaagtaatgtcaatattccttcattgtataccagtctttttgcagccaccttttctgtgcttttatcaatggcatcttcctgcagcaacctttatgtgcttatgcttggaggtatatatgttttcttactgtcttatctgggtgatatatgtggccttcagatctcttataaaattatttaggtttagtgtcatgatagcataatgtttattgtacaagtaggtttttcctcaatttccttccctatgcaacaaatcatattttatttgttaatctgttgtgctctatatttgtacacagagtgaaaatacatatgcattgataatatcctttgtggacaattttatattcgtaatagtgatgcatacatcataaaaaaattatctgtcaacctgacaacttggcatatgaccccaaaatttggatcatgtagttcattttctgagacacaacggtctttagggcttagtatagaccgccacaggtcttttagcctcatatttggagactacattattttacgaatcatattataacgactaaagttggttagcgctgggtctataagtcaagacagtaattgatcacaaagtatgttgcacacctagcaaaaaagaaatctaattggctcaattgaagatttcaatattgacaagaaatttagtaaaccacaattacgataggttcaggcactttgtataagaggctaacattttttcttccgctataaccatttataagctattaatatttaatatttaatataacattgattccataggttagtgttgtttgcagggcgaactattgcttacccgaaaggattaaagccacaggtataagttctaaactatatagtaccatcctcagttgatatgtgtagtccatataggatgacagtacatatatgtgccaccccaaatgacccaggcctccatatctctggctatactgtgtggttcccgcgttgatcataaaattttatttcagttcattggtgtgtgacaaagctacatgcacttcaaacaattttagatgagacatgccatatgttccaatagggacacactgggatattatttttcttctatacaagcgttattcctgcttttgtttttcccatctcgacatagtttttgaattttctaatgacccatccttccgaatttatattatttgctttgtaaatatgcttacagagttttcattatcaaccaacttcaagatatgattttattaatttgttttctgtttaatttattattgttctgtttgccccttcttggaagacatagatgtttcaacacagtttatttgaaaagagttttgtcctacctgtcatatatactcatcacatggcaatatatgaatgatatccaaacatgcccttagacataattatgtatgggatacctcagtactcagtggcgctatgcaaaggaggtaccagttcatctactaaactgttgcaagtacataatgtgatgtggtgttgtttttattgggagctaaagcactaaattttctttgcggcgcagttctatatgtgaatatattcaattagttcatgatgaagatgtctgagaaaatgttgcaattctttgatcacttaatgattgaacactgctacttttctaatctatactcccacatcacgtaagcaccattgtcctctatggttgttgcttttctgtaaatgtgcatgattgtaaaaataattatatgagcaaatggattatattcgcctttaatcttgtgatgtatagttgtaatgtgtttgcatatgtgagtatgcttctgatataatgattttttttagataatgtttggatataatgcttaaaagttacactatatcttgtgctattttgattatgatatcccagcttcaaacattaattcccacgcacgtggcgtagctcgtgactcttgctagttagataccaaacgagatggctattagggtgaaaatcaggtgggtacagtcacatcacggtacgtatcctaacatatatttttcttcaaaattaaaaccggatacagtatattaccagataacatatcactcatcttttagctatataccatatatttttccttcaaatcgtagttgcaacgggtgaagattattttaatcttattattgttatacggtttacttaaggtgaaatttactgtagaaattcgcttggaaatatatatcttttttttagaaaatcatgtaaaaattcgcttggaaatatatatcttttttagaaaatcatgagctgcagttagaagtctgatcgtcttaagttagcatgtgagttgttttaatgagatttcttatacgacaacttgtattttcaaaagcgaacgaacttaaaaattaactcaaatacgtatatgtatttccaaaaataaacaaacttaaaaatcgactcatacacagacgacgtaccaaagtaccggcaaaaacattcaatttttataatagtagagatttgtatctcttgatcatggatattaatctagggagacacttggtgtgctaaaaagatatacatcatgaaaaaaaattatgtaataatacttgcgagctggtaaaatcttttagcactcataatagattttcatgtatatatttgataacatgggacatacagtcatgcggacatgtacaacttttcttgtatcctaacctgcatttttctatggattcagattcgaactaaaatatcaccgggtatttgttttctcttggggtgtgtttgacaaatggaatatgggaggtgagattggaaaggaaaatggatgaatggctaggattaaatgagatgtgaagaatgaatggttaggatgcaatattaccctttaaagggtggatattattttccaatccttgtgtttagttaacgtcaaaattagaagtttgattgaaattgaaatgatgtgacgaaaaagttgaaagtttgtgtgtaggaaagttttgatgtaatggaaaagttagaagtttgaaaaaaaattttggatctaaactcggcctatttgccaaacaaagtaaatgcttgggcgggtcagtgtgcgaagaaaaatcctcgacaccatttcagcccaaaactttagggcttagcaggccggcctggtgcggagtgtcaagtccacggcggcggcggcggcggcggcgcgacacgagtgcatgacgacatgctccggcgggcgaccacctcgctgagccgccgcgccgcctgcgccaccctgctccgccgcctccctccccggccggcgacgacgcttgagcgccacccgccggtccaccccggcctccgccccgcggcggcggcggcggtgcagcttcggcgcctcagcgacttcggcgtgtcggtcccccggcgcatggcgcggcggagtcctcccaccaggcccgagggttactccacctccgacagcgaggcggacgggtggtccgttagcgaggatgacgaggaggaggtggaggaggttcagttggagcccatgtccgtcgatgacgtcgcggcggggaaggagtgggaggggttcacattggagtacgaccacgagcacgacctcgacgccgatgatgaggatgccgcggagtaggagaagaagaagtagcggcgctggaggtgggattctcttcctttttctgcgttgcacgccaggtgcttgcggaaaagcctgtgaggctttacgcgtgcttcaataaactctttagctgttgatcactgatcatggatgcccatttgggtcgaacctgattaccattgtcctaaacaattttagtcaaaacctaattctactgcagcatcgtgggcatgcattgttggtttattggaatggcgtttccacattttaactgcacaaatgtttgcttgtcatgtttgctgtgcagtattgcagtgtgctcatgcttatcacaattttacagtgcttagtttttgtgtggacaactgagttggaaccttgaagggttagaactagggtatgtttggttcgtaaacaatgtttttaccccccataaaagaaacacattgtcattttgatcttgggcttaagtgcagcaaagttagttgttttgtcgcagaatacattggtctctactcattagagagatacacactaggccctgctctgaatgcgaaaaatccccccttcgctacaagaattgatcccttggttcttaaggtatatgccattgatcaaattacaaatggaaaggatagtatcttgatcatcgagcctgcataattcttttttttttggcatttgttatgcttgtggacatgtttgtgacctgtgtcactacttattgccaaatactttggtggtcttcatttgtcacctgggaaagtccctttgacagctaatccccatgaaattcatttgtttcatcagtcccttagtcgagttacacctataatgatatcacaatatactaaagcacagtatcctagctagttctcatgtttcactcacgaaaatttatactgaaatagtctgtgatacatcaatggcagattcagagatttttgttatattagttgagttcaaatataatacgagaatgttttactaattatttggatgcacaaatatgacatgctgtcttgaatatcatgtgaagaattaggagctctgcccctgaaaatcttcaatgtaatacatgcagctcccgttgatcacactctcactacctttgacattcatatttgctccagcaagcagcatgcgcttctttgttgttgcacttcccataaatgcttagtgcagcttgcattgttctctagcaaaaaaaaaaaaaaacataatactattatgctttgcgtgggcatgcacatttagtatgatattttctctcattgacaatctcttaacccaattttgcatttgatactttcttaatgatttcaagtctgaaaatgttgagggctttgtggaacttgaattttctgcaatgtatgtctgatcaaccttggagaacgcatatgtgctactatatattagtgtgttcaccactttatctgaacagcaaagcatctcctccggtgacaatggcgaaaagatgtctgggttcagtctggggagggagatgaggtaggagaccgaggttgcattggtgagataagcagaggcatcaaggttgtatcgagtgaggtgcttggttgacagctgctgtggctacgctgagaatttgagagccaaactggaagtatttgttatgcttgaacttttgtccatggtaagggggaataaaaaagaaaggggatgtgggcatacggatatggcttcttgtcgttggtaaagagggaaatttaattatttgtcactattaggtttgacagttatccaaatacacctattagatttgttcttatttttttgccgctctaagaagatggcctcataactatttgctacattacccatgcggcatgccagcgtggcaatccaagggtgaaaaacattgtgagacccactagtcagtctctccactctccttatcttccttagttgactaggcgacgacaccagacggagaggcctaggtggtggttaaagtggaggtcaatagccgcggcaaacctctctacggcggcaatggagataagtgccccttggagtgccggtacggcaacgggcacgcggcggtcccaaatcggtggcatggtgaagaggcggtaggaccacaccttcgacgacatcatggaggtagattagctagtgtgtcgcttcctcgccctccagtccctcctcctctacacagtgacccccattgcactcgccagtggtggggacggggttgtgttcgtgcctttctcccacctcggcgcactcgtgtagtgccagctccgcctcacgcccctcgacgttggccgcttcctcctacgccggtctgggattgtcgtgagcccgttgcccccacaccaatgcttcgagggcacctgtctcgacaaccgcccgggagagggccgccatagcctcctccactctggccgccgcctggtcaactgggatgaggaagagataaggggattagaaatattgactagtgggttccactccgttttttacatgtgggtaaaagtgtcaaaaagccattttcttagagagaaaaaagagcaaatctaataggggtatttagataattattaaatctaatagtgactgatagttaaatatccttgggaaagaggtaactgtcgagatttcacgaggggtaatatggactgggtctgtagggtaaatcatgtagggtttggtttgagaatgataaagaaatggaggattaaagcttagagttcctatggattcattcactgtagcagcctttgatttgtaggaattggtcataggaaaactgaaggaaatattccttcgttgctgattctatgggagaaacacaggaaacttcctatctagtctgagctcatttttcacttgctttgcgtaggatcgaggcaatcaagctcctaatctctttcttcagagcaggagaacaagcaatgaatggataaaatttgtgttggatgcagtgtatttattagaaatggaaaatgggcctaagttcttaagtaaatatttctgtgtttttcctatacccaattcaaacgcattgtttacattcctctattttacacgtgaattcctattctatttttgtgttttttctattcctgtattttttcaatccaatgtttcaaagagaccctaaattaattaacagatggattctccagactaatt

SEQ ID NO: 59155 - DNA, 3154 bp, Oryza sativa
ccgccgtcaccaccttctccatgaactccaccatctcctcgtacctctccgcctgctccgccagcttcgccatgtacaccatctcctccctcgtccctcctcccgccgccgccgccatcgtctctctctctctctcttgcggattcgggtggagttgagttgagcctgtgagtgggtgggggcgaccagaagaggggaggaaccgaggaaggagaagaagtggggaggagcggctgcggttttaaaacgaggtgtggtgtctgtggtcacttttgcctttcttttttattatcgctttctctctttctttcttttttgtccctttattagtttttttttccttctgttctgcgccgtagtagtagaggtgttggagataagaacgagaacgagggaggggtgcgagatttgtttcagttaaaaaaaatgatatccatgtgttagcttctgaatagctggattttttttcctccctttgggaggggggcgagattggacggatctttgtatatgtagcactgtagaataagtttatctcttgtcccttaacttgtcaacgaatcttatcttcgtccttcaatcgaaaaaccagagataataggtctctcaactatcaaaactggtacatatgatgtccctcggcagtttagatggtggttttggctgacgtagtggctacgtgactgatttgactcggttttcatctggtgtggtattgacgtggcgcttatatgtcaatttgatccggaaaaataataaaacctgtgggacccacatgccagtttcgtagacaaaataattaaaaaatggtgagacccatgtgagccccacatgtcattctcacacagtatcacttttccttgccaagttatagagaaagattttaagtatgtctccttgaactgctacatcatttgttccgtgtccgccttctgctcatatgacagatcttcagccttgacaaggacgatgttatctttgtcaatttctgaagttgacatggtgaatgaatgttttcatcccactggacgtgccaaaagcttgttactgggaaaacacgacgacatgggagatctgcttagctccagtgcaagtcaatggcctgcctagtgcgcttgtagggcgtgccagttagtttgatcctgcaactagcaagaaacatagaaacatagttagggtgtatttggttgtgctgtggcttttggaaaaactgatgtgggctgtggaaaagcagttgtggaaaaagcagaaggccgtttggttagagcagttgtgaaactgtaggttgtagaagaaatacctgttgtcggtgatataggtccggggtaaaaaacttaaagggaagaagccccccccccaactttcacgtggcgctccccccaccccccgagggggtcggtcccatggatgggtggcagtcgccccttccgagcctgaggggtcgggctaccggcggtcaccatgtggccaccgagcgtatgaggttaggtggacgctccccggcgtctacctaatcgcatttagtgcaagcggagcgagcgcaccacgctgcattaaatgtggcgtgctgcgtgcctgactagcatgcgaccggtatgtgaccggtcgaataacagatgggacggcggcaagccacacgcgttctacccgagtgtcaggcggcgtgcggcaggtatgccccgtcccatcatgatgatgagaggttatgggcctctcaactgatctggaatcggcttgaccgctctggacatgcccgagattgtgttcctggtgcacgcgtgtccccaaatccttctccattaaatgcgtgtgggcctacgtcacccgtgtcagccggcatgatttgatgggccccacacagcagctgacgtgcaaatagcttccgggttaaggcacgagacacacatttaatgtagagaatatttttccctcttcactaattgtcactcacagcgcgtgtgggaaccccttggagtataaaaggaggtccatgtcacggtcccccactcaaggagttcatcctccgacacctgtaatgcccctaaaggcctgtgggactatttatatgcaaattactcgtgaaaacctattccgtttaatattgcatatttaaatagctaatttggaaagagaaaatatatgtttccatgcatcaaagtaatatggccaacatgaatagaacaaaacataaatggtttatacaatgatgccatatctcaaaataactattctcctcttgcactaaccaaccaaagcatcagctatcctagtacaaatagtgttcacggtatcagcattctcaacatcttcactctcattgtatgccatgtcacttgtatcttgtactccctccatcccaaaatataagggagtttggagggatgtgacacatcttagtactacgaatcggaacaggttatttgttcagattcgtaatactagaaaatatcacatccctccaaaatcccttatattatgggacggagggagtagtaagtagtccttgtcagcatcacatctctcaaactccttatcacgtaaattgctatcacggatgaagttatgcaaagcaagacaagccatgatgatatgattctgggtagtaggtgagaaacttgggatgcccttcaaaatatgccacttttacttaaagactccaaaagacctttcaataacattttaagggaggaatgtaagaaattgaacacctcgtactttccttgaggaggtcccgaacgatgccgaaattccggtatatggtatgtggttcttttgtaaggtgcaagataccctattcaatttggataacccgagtcgactagataatattttcatataaaacgaagttagtaatgcaaataataatactagggtacaaatatcaaaattaatgaaggaaccatttatacctgcaggaggcacgggaaatgaaggaaaatttgccaatgcacgagtgaagatgcgcgagccgggccccgacgagcggggtgtcggcgaccggtcgaagggagatggggaatggtgtcgagggccgcagtcataagtgattttgaaagtcaaaagtcaaccacagaatccaaaagccataagtgattttgctttaaagctgcttttttttcgcctggacggtgcgctcctcttcacggatgcgcga

SEQ ID NO: 59156 - DNA, 3044 bp, Oryza sativa
ttatgtttgtggcgtatgcttgatcgatttacatttgatgctttacaagtttggtgctattagccataacaccgtcctgcttttgtttatactctttttgttattcatgacgcgtgggcacagaccgaaagcaattgctggtaattaaatttgttttaaaccctttctatatgcgcatctttgggtattttttgtgcacattttgttaaggctactgaaaaggtgaatatttactgtctggaaatggaagggcgtttattacgtgaaatatattaggtaactgacccgcatcctaaagcgtgcaaatagtctcgtggttggtgaattactgagttggttaatggttaatgctgatcggtctcatatttgttctctctaaaaagccaagcgtactatgctaaatatttaggcaaattttgctgcagaatatcgtgacttctcgtggttttagctgtaggacactgcacgaaatcactaatgagaaaacgctacagaacatcgtgacttcatagttttagcggtaggacaccatatgaagtcacttataagggaacacactctgtaaatgtggttatttatccgaggacactccatccattaaattaatgttttcgtgctaactagacgagagggggcctacttttttacacaacttgaccaaattgcccctcctctctcattctcatcctccttccttatctcttcatctctctctcattctcttttacaaggcggcggaggcctgctcaacagcggcggcacgcgtgacctgctcggcggcggtggcggagcccggagcacgcgttgcccgcttcttccccgcctcctttctcgcgatgatggcgtctttcgtcgacttgacatcacaattgaacagcggttcttggccgcgcccagctcggcccgaagcagctcatgctcctcgccaagcggcatggaggaggggatagagggaagagagataggagagctaacatgtggcccaagggcatttttgatattttacgtgatttctctctcatcttcaaccgaaaattattattttaatgagtaagatgtccactagtaaatatctaacttttgagagtttcttcctcaaaagtcacttcgggcggtatcctacagctaaaaccggtcacttcgcgcggatactacagctaaaaccgcgaagtcatagtgtactgtagcaacatttcccaaatcttaaacacctaaatctttctttttctcacctttaactcctagactatgccccttgtaggagtagattttttgtttttatctaagagcatgttcaaagatagaatcggtatgatctgctatactatacaagattatttagaaactacatccatacaataattaagacaataaaactctaagcattaacccaatatatatgtttttattactgttctctcattttcatcatattcctatgtaactactatgtaattgagtgtagctgtaagttggatatgtaaaagcacgaatcttgatgcaagatcttacgaataaaaaagtgaaaaataggagcataaaaatctggtgcaagttaaatagcaaaatggttaaaaaaaaaactcctatgtacccattccataagaaatttagcataagctcacatctcatgttttatttttcttcgctacgtccaatacacgttctctctctacgatttccagcaaaattcttgtgttttaaacttttaattcatgtgaatcatccaacgacattatctttaacgttcttctagttatttttttcctatttctgtattttgaaaatccacattccaaatgatcacgctttctctaggatttttcctattcctacgtttgtttcccaaattactaaacggtgttttgcttacaaatatttctattagaaaattatttgaaaaaacatattaatccattttcaagtttaaaataattaatactcaattaatcatgtactaataacacacctcgttttaataacacgcctcgttttatgtgtattctcattttttttctttttcctctcaaacacttcataagaaccaatctttttctttcccctcctctcaaacattccaagaacagactcctctcaaacactccatgagcatccctcctttccccgccttgttccttactgtaagtttgtaacggtaatattaactcaactatgagaattgttagactttataattttattaggatataaaattattgattggagtttttgtgagttacttcctccgtccaaaaatcaaggcctattttcctttttttttttggttttttcaaaaacctaagagctatttgtagtctctatagagctacgtgctaaatttgttgggtgcaacctaagaatacatgggttttatcacatagtgaatgagttaattactcactgctctgaataacaaaataaatataggtcttatatttctggatggagtagatcgtatctttgacatcttggcccaattaggaattggcatgtgtggctcatgagagctgtgtgcgcatgtttagtaccaccttgcaagtttagcaaagttgaaatcaacttagaaggcctcttccctccaaccatgtcactctcaagttaatccttttatacgaaacgaggacgaaaatgtaagtggagtggtatgtgtaagtgggctcacccgtcagttgggttaggctacatgtttttggagggagggctgtgacaaatggtatcagagccgattctcgcagttgtacgtatgggtcggtgtgcgagcatatggctcatgtggcatctatgttgaggcacatggcatggcgtatggcgccggccctagacgactctcgggttaactttttacacgaggtgaggatgaaaaagtgtaagtgcagtgttatgtgtaagtggaccgcccgtcagttaggcttgtgacggtatctaaacctaataatggagtagtggtacttcattagccacagtccacggtgcgccagagctatcaaatgatataagcatttgatgattcatcagcaacgatccatcctatagacgatacgatt

SEQ ID NO: 59157 - DNA, 1091 bp, Oryza sativa
gggtcccacgcggttgacgttgagggatttttcacatgaaagggattttttaatatatatatatatatatatatatatatatatatatatatatatatatatatatatatatatctgcggttggtaattggaattggaaactattctaaggtaattggtgatttttattcgttttagaaattagaagaagttcggatttgtcacagttgcctaaacttcatgaagcttttatttaggcaaatatatttccatcaatatcacttgttctcaatattgcctacccgaaatattcgatgccataaaataaaatactgtagtaataaactaataataatcattttagtagctcaagaccttttgcaaaatagcccaattaaatcagtttttttttttctgtcgacgtcactttttttctgtcaatggcgacgagggaagaaaaaaacagagaaatcaaacaaatgcagcagctgagacgaaccggcaaatacgtgccaaacaagcgacgcttttctccctttttcctcctcctgattcgcagcgtccgaagtaggcatggtttgcctcacctggctttcccccacgtacctttcccctgcgcacgcgacacgtcacgccacgccacggcgcgcgcgcgggcggcggcgtcggcgcgtcgcccacgtacacacacgcttgtcgcgccaccgccatcctcgcgcgccggcgccgacgcttcgcggcgccgcgggcggacgcgcggcgcgggcgatggcgacgcgccgatgtgatatgcggctggtcggcggacggcggggggtttggttcgccgaggcgacgccacgtcggcgccggagtatccctgaaggaaagcgcggccaccaaattccagacaaccgactcgccgactgcatctcgatcacaaaaacaaattaatcatgctgcatggtgacatggtgtgatctggactctaaatagcatcagatcaaagagaccaattggtggtaatcatcaagcatcagagctagatttttaatcaattaggcagcgggtgagttctgggacgaatccatcgatttccatcaacgggtaccgagctcgaattcgccctatag

SEQ ID NO: 59158 - DNA, 772 bp, Oryza sativa
gagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctactcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaatggggttcaagggatttgtggagggtggcatcgcgtccatcgtcgctgggtgctcgacgcacccgctcgatttgattaaggtgaggatgcagctgcagggggaggcgtcggcggcggcggcggcggtcgcgccggcgcaggcggcgctgcggccggcgctggcgttccacgcggggcaggccgtggcgatcccgcatgacgtgattgcgccgccgaggaagcccgggccgatagccgtcggcgcgcagatcctgcgggcggagggcgcggcggggctcttctccggcgtgtcggccaccatgctgcgccagacgctctactccaccacccggatggggctctacgacatactgaagaagaagtggacccaggagaacggcggcgtgctgccgctccaccgcaagatcgccgctgggctcatcgccggcggggtcggcgccgccgtggggaacccggccgacgtcgccatggtgcggat

SEQ ID NO: 59159 - DNA, 17438 bp, Oryza sativa
atttactcttataaatttgttactgcagtttaaaatctttattgcaaagccgccattagaatattgcaaagttaccactgaaatgtcgtttgaatgacattcttactagatataaaaaactagtggtaaatttataaatgccccttaaaattgttctgaaaaaactttcttacactatttacttacactaattacttgctactctccctacttcatattataataagtcattttgacttttttctagctaaatttttttaagtttgatcgaatttatagaaacataatagtattttcaatacaaaataaatgtattattattaaaatagattaaatgttatatttaataaaactaatttagtgtcatagatgttgctaatttttctataaatttgatcaaacttaacaaagttgcctagaaaaaagtcaaaatctcttactttaaaatattgaacttctatactcctttaaaaaggtgtagtagtaatggtgatgagtggcaaatctatcaccaccacaccaccaacaccctacaattttaaaatgagaaaggacatatacggccagagggcccacatgtcaaactgtttatgacaaaaaaaaataaacgtgtttctctatgtttagagatcgatatatgcgggcatgccagtgtaactaagtacacaaaatgaacaaaataggaaacatatgctttataatctcaagatcataaatacaaattcccaacttaatatatatatatatatatatatatgtgcgctccattgcctgtcgttgaacatatctgaacttgaagaagtggtcctctggttcctaaggtctcgaaagatgcctagttaattacctccgcaagtctaggcctgcagagcgccttcgattaaactgcttgtggttgtctcttcgtcttcgcttcacattctccattcatgatgagtgttggtgaaaatggtagatgtatatgtgggtgttggcaacgtatccatggcctcatcggtccgtgcgctggtgttggtgatgtagccttcatataggctccacccaccctcgtcgctctgcgttattagtcttgaacgatgtggtggtgtagatgagttgcttttcatcatgcatggatctcgtgtagcttagacaacttagatgtcaccgcaatggcgtcggaaggtgttgaagggaagatgagttggtgaagtcacttggtgtacacaacaaccgaataagcatggttgggcacctcttggctagctgagattaaaagaacgaaaagttgttgaagatagctggtgtagatggcagccggattaaacatggttgggcgcctcctggcttgtcaagtcctgggtacagtagggatttgtaaagcgatgttaatgaagaagtagatgcaaaaaacaactagacgaatgcggcttggcacctctttcgaatggtgggtctactattgatccgatcgatatgacgatgaacccaaaaaaggggctctacgagggcgccggtaacgacaaccttggaagaagtagatgcctcgacgtagcgcttcggcattcgtgtgaggatgcctgtgctcggtggccggcgacctcagttgcagtacctcggcatcccatgagaaggcacacgttgaggaggagatgatcgaccgggagaaacaatatgacgccactttggttcactgctatgggtaactagtctgtctcagtgcatgtacgttggaaggccagtacgcgggcgcgtcgccatcgccggaatcatcaagctggctcatctgttggcatcgctctctcttcatcccgccatagtttgcactactccatctagctagaatctccggtcgcggtgacgcatcctggcgctgctatgtcatcaagatgctaggcgtccttactttactggttgcagcctatgcctcacaatgccaccgacgtctattcaccctcgtcaacaatgccgtcttcctcacgctcatcgtcaagctgttcgaggagaacatcggggtgtcattgctaggtgcccgcatgctgtcgtcaagaccgtccataagattttctctttatcacaccagagtcatcggttgtccatccatgatgctttctcctctcgtgttggagtcgtcatgctgtccgtccgtggtaccccccttgtcacgccaagatgagatgccatctgtttgtgatgtctctcatccatgacgtctcctctccgtcacgcgcggagtcttcatgctatcacaacccaaatatttttttttcatgacagtccgccgtatccttataagcatatacgctaactatttatatatatatgttcataaagatacaaggcaagatgtaatgtctaaccataacagctggagcttggacacctacagcagtggttccatttatttttcaccaactacattgcatattacatcggttggttcactgaccaacttattgtcaccaggacgataccctatacctagcatatggtatgtcctcttgtatgcttctaaggactaagtagaccgcacccccactaggtttgcatgtcattattttcctcagacatctcatcttgactagtttctgcgcacatcaaatggtaataatatatgagtatattatacatactcagcaagattagtacatatagctatagagatgtttttaaagacagaaaatactactacccatagatattaacagccgataaataataaaggatgtaacatagtaaatgagttaaaaaaatacactgcagaggtattaaagtaatcgtcataatttcattccttcaatccattttcgtccccaattagggataccctcatatgagaatcacaccgtcgaattcctacttgtgtgaggcgttcctcatctcacactgatatcagcacctgatatcgttattttaggtatcggccgtctcatgctaggtatcctaatcacgttattattctcgctgataaaatcatcaatccattattcgggtgttaatattgtttattgttagattgttagtatcatcatctcaatataatacaggtaaacaaattcagttagagatgattaagtaaaatagttgatggtgcagccttacctagtttcctgccgtcctatccgtgcgtctcaccaagtcaaatatgcaaatctttgatattaatcaatatataaatttgaatgcaagatagctactaacagcctactagaatatagctagctgatgtgactatgctaaaggagggaaccaactagtgctagtaggtgcttgcatgtactccctccgtcaaaaaaaggcaaactgtgggttcccgtgccaacgtttgactgtccgtcttatatgaaatttttttataattagtatttttattgttgttagatgataaaacatgattaatattttatgtgtgacttatctttttaattttttttataattttttgaaataagacggacggtcaaacattggtcacggaaaccagggtttgtctttttttggacggagggagtacgcatgtagctgctgctagccattaaaattcgatgcatgcatgtagctgctgctagccagccagagtattagtcttttcactaatatgtatattttctacactaatccatctacttgtagctagacatcaggtgtttattctagccatgtactcataaaaaccaatggacaagggctgtgtttagttcaccctcaactaccccaaacttctaactttctatcacatcatattacatcaaaaactttcctacacacataaactttcaatttttttttccaaactcccaactttccccaaacttccaacttttttcaggaactaaacacacccaaggttcagtgtattacctggaaggcttctactagctctaaactctcaagtctctcacagacctctcgccacagccagagcagggaaaagtactactgatggggcatgagctgtggggtcgcgtacgagttaaatagtgcagcttccttcagtctgaagcggacatctgtccaaagccatgatgatggggataggattcaccctccctcttccttacactagaagggttcaatcctatccatcaaccctcagtgatatttatctgtcctcctcccaaaacaattcaagaatgtataaatggttccctgctgctattattcactactactacacatgctgatctccgtgacgtctccttttcgccataccaatatgatgggatgccactcgtctatgtattggagcgtcactcatctacatcaacatgaagcaagaacgatgtcatctgtgatgccaaggagtcgttcatgcttgtgctacaccaatgatgctattgaccgttctgtcgacgaggcatatacttcttccaaggttgttgttgttatcgacgctctcatagagcccctttttgggctcatcgtcatatcaataatcaattgaattagtagtagatccaccatctgaagtaggtaccaagccacattcgtctagttgttgtctgcatcaacatctcgttacaagtccttgttgtacataggacttgacaagccaaaaggcagctggccacgtctaatctggtttccatctacagcagttgtattcatcaactcttcattcttttaatctcatctagctaggagatacactaactgactccaccaactcctcttcccatcaacaccattcccacgccactgttgtgacgtctaagctacatgagattcatgcatgctgaaaacctatccatccacaccaccacatcgttcaaagaccgatgagcacgaagcgacgagggcatgcagaggctatatgaaggctaggtcaccaaccgataagaccatggatacgttgccggggcccaaatacatttaccattttcacaaacactcatcatgcatggagaacgtgaagcgaagacgaagagacgaccacaagcaccttaatcgaaggtgctatgcaggcctaaacttgtggaggtaattaattaggagcctagacttgtactacctccgttcgaaaatacttgtcgctttgagtttttgtttgtaatttttgatcattcgccttattcaaaaaattatgaaattattatttattttgtttgtgatttgctttgttattaatagtactttaagtataacttatcattttgtatatttatactaatttttcaaataaaacgaatgggtcaaacattaaaaaaaagtccaagcaacaactaaactagtacggaggtagtaaaacggaggaggtattttacgataggggagtactacgagtactgtgctattgacaaaacgaaactgttgacttgtgagaaagcgtcgccactgtcgcattcactgacactgcgggcccacccccactcctccctgtctccaacctcggtttccgcgcataaagaagagcttccgcttccgcccccacctccgcccccaaacccctcaaaaccctcgtcgtcttctcgcgatcgctattccctcctccattcctcctcctccacctccgagacctagggttccaatgtcgagcggcggcggcggcggcgacgactacaagcgggaggagtcggtggcactcatggtcatcgtctccctcgcggcgctctccctcctctccctcgtcgccgccttcgcctactactgctacatcacccgcaaggtctcccgccgcctccactcgctcgacctccccaagcaccaccgccgctcctcctcctcctcgcctcctcccatgcccccgccgctgcctccccctcctccttccgcgaatgccccgacgctcgggaaggagagcccgtctagcaactccgccagcgacggcgcggcggcggcggtcgtggtcggcggggagaggggggccgtccaggtgttcagctaccgccagctgcacgccgccacgggcgggttcgggcgggcgcacgtggtggggcaggggagcttcggggccgtctaccgcggggtgctccccgatgggaggaaggtcgcggtcaagctcatggatcgccccggcaagcagggggaagaggagttcgagatggaggtaaaaaaaataatctgcgtttcgagtaattaccagcaattgaaatgcgggtttccgtctgagattggggcctgggacagaataacatgcaacgggcggtaaattcgaatttaccacccattgcgagttatatatgttgatgaaattttgcggtccaatggagacaatgagacactgcggagtttccgagcgaaatggggtcactgtcgtctattggggttagttttggtttggcatcttgtcaaagatgtttccaaaaatggagtgttcggttgcttggtttggcctgtagttggctctaaacacacacatggagctctaattaccgtaaatctgggttatgatgttgctactgctggaattctaagctgttctaatcaagtttgagcggttaatatggggcattggtgatcttttggcaggtggagctgctgagtcggcttcgatcaccttatcttttgggcttgattggccattgttcagagggtggacaccggctgctggtctatgaattcatggccaatgggggtctccaggagcatctctacccaaatggaggtatgcacaccttttagcatccaattacaactatagttgaatttgatattttacaatgatttttaggcaggtttgatgttgttagttaagtgttgcaacatttgaacaccaaactatgagagcaaattgactgggaagctatccctgaacttagttgactattgtctttggatggcaaaactgcaaaacactagtgatgccacagctagaactagggacctagctgaattaattgcttttagcgcacatgaagtatttggttgataaccttattatgtcctgatactttgaggggaagaaatggagcagttgtaacagttgtcttgctgaggaaacaaacttatatctgactaaaaggagggaaagtgagattcaaataatacaggaataaaaattctaaatttgatgcttagtattacatatcagaagacaaacgaattgggagttgaatatttcatgtactgtaccttggtttttattactagacaccattggtcgtatgctaattcattatgaatttttccctagattctgttcatggattaacgaaaatgtgcaagagctctatttgcctctgccattctatgagtccattgggactgcttggtctggatacatgatatagcaatgaaaataattacattctctgtaatgctgatataggatacgttgtttgatgtttacatatgctcttgaagattgactatcccttcggaatgacagttagagaagagaacttacctaattggtgaacctatcaaatcacctatctcaaagtcacaatgtcaaaagaatcaaacagaatttccagttcatcaagaaatggtttatgtattcatgtaaagctttagcaatttagtggcctagatctatagtatttaaatatactgtctacactatttgcttggtttaattgctaaggaaagcatgctaacctcttatcagtgtgaatttactgattttagtctgtttaatactgtacaagaaagtggaaactgaccgttttaggccttctctcttccagataagaactcttagctagtcctatggtgaacaaggtgtcttcaatcttaaaaatctggtgttttttccacaaaaaaaaatcaagccttgtaatattgtaaaatcggtcatctggcctttgttgagagagcaccaccattatttttcatccttacaattgagttattaatctgttgagtcttgtatatatggcctgccgagatagttctaaaagttatggtttggaaaacaagtgaagtgaattcactacaaaattgcagtcattacatatgcattgtgttctttctttattggtatacattgatactgctttaagtccttaaagtgggcaggtagttggcatactgtgaaattacagattaccacatttcaattcttttggttgatatgaaaatatgaagtttctgaaaatgtttccttgtcatttaccgtagcatatcttttttagtgatggtattcattcagccaaattttcttcggaaatcctccccgtcgggcgcccgatggggagaaaaaaaatcaggcgccccgcgccgcccacgcctcgcgcgccctcaccatgcgcccccaccacgcgcgcccattgcaacagccgcccggatataatggaaacaccctattaagggggatccgtttcattttttgttccaccaacaatgtttcagctagtatactcgtgatgttttcctatgtatggatcacatgttgcagtgaatttttgatactgtttaatattttcaacttgatggacacgtggtttgttgatgtacacgagttttaagtgttgcaatggctttaaatcgtttgttgcatacgttgaaccaaattgtttcatctagcgatctgatcgtgtttcacttttttttaagaattgaaacattctttcatatttgctgaaacattgtttttatatagggtgaaacaacgcctgattttctggaaactgtttgtttcatacgttgtagcaaaatgtttcatgaggtgatttggttgtgtttcagcttttgaaaagattgaaacattttcgatctacttggtgaaacaacgcccgatttttgacaaaaatatcgggcacccgatttgtaggcgcgcccatttttctcgtcaactgatatcccacaaagctgacattgtaggttcctgtggtggtatctcaaaattggactggcctactagaatgagaatagctcttgaagcagcaaaaggtctggaatatcttcacgagcgtgttaatccacctgttatacacagagacttcaagagcagcaacattctactggacaaggacttccgtgcaagagtgtcagattttggtttggctaagcttggatctgatagagctggtggtcatgtatcaactcgagttctaggcacacaaggttatgttgcaccagagtaagaccaaattctgaacccattgtgaacgaacttgagtttgatactgatacattcaattctttttccattttactgtttgatttgataatataaatgaattgttgaactgattatactgtctctaatgtggtgcatgctacacaaactctgaagatatgctttgaccgggcatttgacgaccaaatccgatgtctatagttacggtgttgtacttctggagttgcttactggcagggtgccagttgatatgaagaggcctccaggcgaaggtgttctagttaactgggtaagaacattagctgaccatcacatagttgtaccgatgtatctttactttgaactgtttttcttcaaccatcaggaattataaaattagtactactgtttagttcatagtataaatgaggtaatggaacacttagtacttcagttgcaaaagtttgagatgctttccaagtgaggaaccaatatgtactaaggtacatcagtacatgtacttcaacactaaaatttaccatgcacttcaatcgactctgcttcattattcctgtcattttcttatgctagtgaatcacgttacagcttaattaggatccatctgcctctcttgttatactaggtaggaaaggttccatgtaattatttatcttcaaaaataatatttaaacattgcatatatctgacctgtggctagttgcattgatgcaggcattgcctatgctcacagaccgagagaaggttgtgcagatcttggatcctgcactggagggtcaatattcattgaaagatgctgtccaagtggctgccattgctgccatgtgtgttcaacaagaggctgactacaggccactaatggctgatgtggttcaatcgttggttccgcttgtcaagaatcgttctactccaaagacgtgcaaccctagtgtccaagcgtagaagccacttgaaggggaagttgaatgctcagtttccaggttggtgcttgacttttctggaaattttcatctacatctaacaactactgctgagtttatgagatcagtatgctccataacttaattctcttcctctgccagtgaattcctgattttgcgaggtgaatcgtaagcagttagatttagaaatcaagcattaatttagttcgatggaccagaaagctagtttcagtttgaagggaagtcctctagtcatgtgcaattagtgatcatgttaggtggtttggcttagtacttatggttgtgccctgtgggaatgatcagagagtgttgtttccagctggcagaattgcaatgtactgctgaattttcttttggcttgtcaattatgttaggtgtctttggagatccatgttcgttgtcttaactcttgtgctaatacgttggtctcatcagcttggcctataaacatcgccgatgtatctttttgtatatgtatatagtaggattctggaacttataaaaacaaacatttgccagttgagcattttcatgcatttcctttctcgttttctttaagcttccagcacatacttcagagaagcggcaaatttattatttctgtagaatgtgactaaaagttcccaaaaaaaaataacaatgtggtaataatgttcaggtgcatgtcaagtttccaacagcaaactattgtgacgggttgcaatttgagacattgtttatgttctctcttttatatattgagaggggagggccacatgattaatgtcgttgatgacccaaggaagatttgttgatagtgcatcatatttttggccttttgtaatttatcgtacaagcatcagaaactgcaatggacggttgatcggttagttgttaactattactccgtatgaattatgattgcccaaacctgaactgaagttgccgatgaagctgcatatgcattgctgtccagaaatgatggacttcaccagattggatggaattatttgcagtcttccaaatcaaaagtactatgctattgtttggaatttgtgaagttcataggaatcgaattattagtggaaacaattcagtttctctaaggctcaattcgtactgatctgcctccccaagtactttacgtaataagatttatgaacttcaaaaactggaatactgcagcaaatcttcagactaaagttatttgcatgattttacctaaattttttgtttgcactggagtaacatatcggctgtcctggtaatcaaacacatagaaaggcacaagtgccacgattatctgaatattctccagaggcaaacacactttgagctcgctttcagaaagcaaagcatgttgcatcctcctgttgcctgttgcttctcacaagaaatttatttattttatttaattttgttcagagaaagctatccagattccagatctcgtcgctgaccagcaagcacatggcatggccacatggcccaggtgtgagattctcagacgtttcaggaagaatcctaccctagtaaattacccatgtttttcaccagctcctctaaaatcactacgagcattaatcgaaacgacggttaataccatcaatccatatttttaaatttgatccgtgtatgccaaagggctaaaggattttttttttatactttcaagcttggatccgtttgaatgtgctgtcaacaacaaaagtttgatagagttcaatcaatttgagggctgtttggcttcaatccaaaatggcccttgatcttgcacatcgctgccatgcaatgtatatattatgatttcaatttccacgaaaacataaggaaacttgcaggaactaccctctatttgagctctacagcctataggatcctgactattgtttagtcttggaatttggaaatgtcaaaattctgaaattttagtaattagggccctttgatttggaaaaaaaacatagaaattttgcaagattttaatcctataggaaaatttcctatgaaggcctttaaaacaagggattgaatcatatgttatcctttgaaatttctatggaatagacaatttcatagatattttagagaaaatttagcaagggcttcaacctcttgggaattttcctttgagtctatctctctcaaccgattcctacgtttttcctgtggtccaaacaaatggttattcctgtgcttttcatgtattttgtaatcttctgttttgcacttatgttcctattagaattatgtgtttttcctattccttcatttttacatttctgcaatttaaaagggcccttaatatgtgagaatggccatattagcatgaccgtaacatcaatctgaacatcgcccatttcatctctaccctaccatcacaaccaatagagttgtactgaactggaattttttacactgtggcccttttgtaaaattattttacaaatatacctcttcgaaaagtaatttggaatatggaccttagctcttgacgccaaagtttttatatacgaacgtcagagacgcgatgggtccccacatgttagtgatccacgtaaaagaagttaacggcccctttgaattaaaggatttatgtaggaatttcataggattcaaatcctacagcaaatttttctatttggccctttgattcaaaggaaagctttccaaatcctatgaaattcctatggaatgacacattgcatgtggattttagaggatatatagcaagagctccaacttcttggaaaatttcctttgagtttatctctcatccgattcctgcgtttttatttttcttgtgttttgcaattatctgttttacacttccattcttatcagaatcctgtgtttttttcctattcctctattttttttcaaccctcgattcaaagggcctaaataagatgaactacttttctagggcgccaacacacaacatgtgtggcaaccaagttaggagtacagtatgtgtacatgatgccgagcaccacactcttgagaatgctgtagtgtgggatcgcccacactatcgaccaaccctacaatgcttgtgcatgcggatgtcgctgccatagcggcataagaccatggcacgctcgacgtgcttgacgccaactaatgttggtctggtgttcaccgccatcatacagttgaagtcagtgcggtccaatgagttaaatggcattggcgcaaagtcactggctcagcaatgaaggaaataaggtcagcgcccgagccatcggcactgacccctagccacactagtagccagggctcgaacgctatgttgggtaagaggaggctcgacgccatggacttcagcaccatggttttggacctcggcgccaaacaaggatcaagggaggattcaaacctgaaaagtaagtatttttcggcttacttacaaaatcaagtttttagaaaaggggctaaaatgtaaaaaataaatccagtcgtaggggaatcaaaaccaaacccgcagtttccgaaaaccaattggatggccagatcatggcccaacccccaacattcactccaaaacccaaaaccttgcacattgaccgaattccatcccatctgacgactgaccaacattgtcatctctagctggacaatgcaggaccaccaccaatcagctcctctggttctgtacacagtgaggggcgttttggtcaaagcatccgacatgtggggcccacataacggtcagtgctttgctacagcctacaggcagaggcaggcaggatgcatgtgagagacagcagccattttccccccttctttttctcttttttccgtactgatttcggcagcatcaaggactagaggaggaggaggagcaataaacaagtgccgccatgtcgcttgcccggctttcaggggcgcttttggaattctcgtttgaccgcctacaaacccacagcctgtccctgcaaccaatttggccctgcgccacgccacccccaaagctattagtactaaccacaccccctctctctctctctacacttagcagtagtactaagaccctcttttataaaatttttaagtcactatcacattcgttagcagtagtactaagaccctctttgtaaaacttttaagtccctatcacatcgaatgtttggacactaattataaatattaaacgtagactattaataaaacccatccataatcttagactaattcgcgagacgaatctattgagcctaattaagtcatgattagcctatgtgatgatacagtaaacattctctaattatggattaattagacttaaaaaatttgtctcgcaaattagctttcatttatataattagttttgtaaatagtctatatttaatactctaaattagtgtttaaaacagagactaaagttaagtccatgatccaaacaccacctaacatggacaattaggctgtactacaaccttttgccaagctacgtgtacaggtaaatcgcacacatgttgtcatctttggaggctgaaacatggggaaatatcatgtgaaaaccgttaaataagtgaaaactcatgaaaattatatttaaaagttctctaaatttatataaaaattaatagagataaatatagacatgaaatacatttacatcaaatctcaagtcgaaactcaacttttatttgagagaatataaaagacaaattttaggtgaatagtgttctattatttttcatccgaaatttggcatttttgttactcccaaataaagttgagtttaacttgatatttggtgaatatatttcatgcctacacttctctccagtaatttttcatgaatttattaaacttttagttccgattttcacgtgttttcacttatttgatggtttccatcggatatgtccctgaaatatggtattgaagtacaacatagttcatacttgggtcgtgtttgaagtcatgtaagggcgttataagctcataggttttgcttacatacaattggtgggataaaaaggcaccggtaatttcttcaagattgataaaataaatgtctagcgctataaggccatggcacacatcaaatgttgtttagaacaggttatttctagctccataaattgttggatttgaatttgtgattacattgataataattgattgaatcagtttgttcttattttagagaaaataaaaaaaataaaccactataatttaacttacaaactccaaaactagtctggatctgtaatttaggttgtgctaaacaaggcctaaagaaaagaagtaatgtttggagaacatgtttttaaatcaatatggaccatcttctaaaatgggcacactgtgcaaccgaaatggttattagcaacttaatatccaatccttaaaaaaactacattgaaaatatcctaaatcccaaaattaaattttaaaatctaattttggtagcgattgattatttgtaggggcaaatgatgaggccctaaatcaaccatgtttagctacttcctcgctttctttaagtatgtttcatacgctacaaactgatattttttgcaaatactttttattaaaaaaattattttaagtctgcaaaagctaatgtttaattagtcctacactaataatcctccttgtttggcttgccgctgataagcttagtcaaaaccctgatccgaactgcacgtaagaacggtcaagaaaccatttcggttacatcacacaacacagcctcatctctcatgctgtcatgcttgtggtgcacctagcaattcctccctccccatctgtcttcctcctctaatctaatccacctccccactaatccaccagctgtgtacactgcagcagcagcagcagctaaccactctcactaaaaactatagcagctgcagtaacagcagcagcatcacccaccttcttcttggtcaaagccatccatcccaccactcacccatccctcccagtataagccaaaccaatccatagaggaggaagaggaggaccaggtggtggcacacctaagctttgtgcagtgccattcacgcacctgcagcttccagctttgccacatggaccagccggcgccggcgccggagccgatgctgctcgacgcgcagccgcccgccgccgtcgcctgcgacaaggtatgtgactaaccggatcttggcgtgctgatccgtggttttgcggttctttgctgtgtgctgatttagtgtgctgttcttggtggagcagaagcagcaggagggggaggcgccgtacgcggaggggaatgacgcggtgaccgggcacatcatctccaccaccatcgggggcaagaacggcgagcccaagagggtgagacacgagccttcccccccccccctttgttgttttggtcttggttccatttcttgagttgcagtgaaatgctgccggttcttggtttaggaaggtgttcttgtgtgttctgcagctagtttcttagctccgtgtagtgatttttggtgatgggaaagccattggctctaagagaggcatgtggattagtggtcagattttgcaaaagaagtaaactgttggtagatatcagccaatttatttagtgttagttgttcatgttcttgtattactgcaagatctgttgtaaataactaaatatggcttgtttggtgctcatttttggtggtttgtaggggaaaaagttgggtgtgttggattacattgttgtgaacactagtgctcataattaaattttggtcttaagatggtaattttgtacttgattttcagacaattagctacatggcggagcgcgttgtgggcactggttctttcggtatcgtctttcaggtgattcatctttcagaaagttgttatttgtttctttcttttcgtgctgtcgacttgttggtctgatgtttagcttgctggtttcatgtgtaggctaaatgcttggagacaggagagactgttgccattaagaaggtattgcaggaccgacggtacaagaaccgtgagcttcagcttatgcgcgccatggaccaccccaatgtcatctccctgaagcattgcttcttctcaaccacaagtagggatgagctgttcctcaatcttgtcatggaatatgttccagaaacactctaccgtgtgcttaagcactacagcaatgccaaccaccggatgccacttatctacgtcaagctttacatgtatcaggtgtgtggattgctaatcaatcataaattttgaaatgcctgccttcctgtgtgtctcttctaagtctattctacattggctgcagttatttagggggcttgcgtacattcatactgttccaggggtctgtcatagggatgtgaagccacaaaatgttttggtaggtattcatgatcagattattattttgctatgcgatggcctttgattattggctctgaactcctttcttgcaatacaggtggatcctctaactcatcaagtcaagctctgtgactttgggagcgcaaaaacactggtattggccttttcgggctgcagga

SEQ ID NO: 59160 - DNA, 1143 bp, Oryza sativa
attctcccgtcagttataaagcggtaattttaataaagagaatgcaatagtttaaaacaatataattttcgcaataatcgggttcaaaatgttcgagaagagcatgacttgtcttgctcaaagaaaaggtattcctaagcttcactgacaaactcaaattgcacaacgagaacctccgaagcaacaacaactacacgaacaacaaaataaggctaaaactcttaacaacgaaacgataacagcacataaaaacaacatatgatggttcttttaagttataacatcaacttgtagctcatagaaccgatatatgactattcgaaatttaactgcatttcaaatagagattttttaattgtttaatgcaacatcgctcgagaagagaaatgatcgagcgactggcagctgagaccccacaggacaaacggctatttcaccgtggaccgggttcaccgagacagtctaccggaaaagtaaagcgagacccacttgtaagtcttggagaagagaccgacaagtggatcccataggacaccacgcaagcagccacatacgcgaacagacagctacccgtgggagggataagacaatcgtcactggcggcaacacagggaggacgagcagaggacagcgaggggagggttctcaccacggacacaacaaggcgagggaacagcggcccttgcaaccaatcagtggtggatccagaaaatcagtttgttggtgtcataacgtgtctatcggtgtcatagtatgctaattatacttagaacatagtgttatagtatatggataaacagttttgttatacgttttgccgaaagtcgtcagtgtcgcctaacaccgacgtttatactgtagatccgcccctgcaaccgatgacgagtttggcacaacagcgggattgagatccagaggaacttgatccacaacagcgacgaacggaggagggcaacggagacaaatatgtcgacgacgaggggacggctccggcgatcttcaagcttggcgaagaggtggatgaggaagggctcgacgctgcgaacttgtcgacgatgatagggttgaccttcgggtcgacggtggggatggagcttctgagtcttcacttgacgaggcggcatgcatggccgaggaagaaga

SEQ ID NO: 59161 - DNA, 10961 bp, Oryza sativa
ttgaacttctacggtctttctcttctccatttgaaccccaattctatcgcctttcttagcatcttttttcatctttgtgaggcctacattggggtagagccctttcttgacctctttcgcttctactacgagttgcgttggatggagtccaacagggtgtctggttgcatcgggttctgacttcgggatggcctgaagtcgcgttatatccccttccagtgcccttcttctcgcagcaaatggaggacgaggtggttctaccttcagatcaaagattcggaccctgtcttcgttgttcccgaggaacaaccggacaagatttcgtcttggaccgcaaagccccctttgaccccctctctccagtcatttatcgacattatcaacgatctctgagtacaaggcttgtcagggtatgaagtcgctgcagacttcattggtaggcggatccagccgctccaggctcgaacccatccagcctttgactattccggaccggaggacgcgacccgggtttctcctcggggtatctttctcgcatttatcctgacatgctcatgttcgcgttcctcttgatttatcgaaatttggttctcgattctcaggtctgaacagcgaagccgtggaacgtcgtgttggccaggtgatgatcagtggtccgacaacggcgagtgccatccccgttcccctttgtgagaaaggggcggccgaacatgatgttgccatcaatgtaagtgtgctcgataggcattctacgttttccttccgagatcacattgtgacttgattacgcataggctcttcctctgactgacatcatcgggctgctcgcggaccatcaggtggtggcgtctttgaaagagaaggtcgccaatgaggcgtctgatgctgctgctgctactactacaagtggtggcaatgttccgacaaaggggaggaagttctcctctgtaagcggacatcgtcgcaaggcatcgacccccttggtaagctatcatgtcgtcagatcgtacagccagaagaatttcgccttacttcgcatcgaccgtttttcaggcctcggacgcgtctcccccgtctccacgacgacaacgccttgtgacggttggtgagaagtaagtagacgaacttaagtttccgtgattttattcgagtgttgtctgaaccatggccgtctcacagggcggcgcgggcgaaggctgcgcaagacgagtccggagggacctccggcgcatcgcccgctgcggcctcgatggatgtcatgctcgcactcgggagccacgaggcgacaccaagcggcccagtcagcgatcccgcggctagccgtggtccaccggctaccgtcctcacctgggagaagctccaggttgagatggggcgcctccttgaggctggtgctcgcggcatcggtcgcgagattgcggaggcgaggtcggcggcgtcgtcggcaaacgagcgggctgatcggctggcacacgagttgtcggaggctcgtgaggacctcaagaagatgagggagttggtggccggcaacgagcgacaatggcaggggctcgagcaccgcatgtcggagctcgggaacaatctgtcagaaatccgtggctcgttgcgggtcgcctatactggtcagcaccagttcgccggggagtgcagtattaagtctactatcccggcgaatcccgacgagttctcgctgacatcttctcttgcggagctggcggcggcgatggaggaaatcccctccaagcatgcggccaggatcggggaggagacatcaaacgggatctacaccggggcgtgccacgtccttgcgtgtgtaaagctggcgcatcctgaactcgatctgcgcgagatcttggatcagggggtggctagcaacacgcataaggaggtgatggaagaagtcggtgatctgggggaatctgttctccccctttttgaagagtagggcctcttgtactcgctagatatgctgtataaaactggatcttaaccgcctttgtgcgagcagttattgttccagcttactcttgtatgttgatcttgaaagcttttttgtcccttgtagagatgttgatgacgaggatatccagcagcgcgggcaacccgagtcaccggcgattattccggccctcacgtttgaaccacatgcgtcgcccgacaatgtagaccagaccattgctacggggacggagatggcgaccacttccttaggttagcggtccattcatcccttttgctcctccgattagatcacctatgttctcagaagaggcgtgtagcctgacttagtcgttcccacactgagcagatctcgagagtgctctcgctggccaagatcgtcgtatccaatattggaagacaaaatttgaagtagcaaaactcgagaggactatgcttgtagtgaagaaagagcaggctgtggaaacgctccgaggtcgtgaggtgtggttcaactcatacttgaagagttgctgcacatccatggacaaggtttgtagagagctccgagtacctcgtggggatcccgaggagtccgtggtcgggtatatctcgtggctgaatggggcctgtgcttaacttgatgacgtcggcaaacgtatcgacgaggccttgaagcaggagtgttgtcgatcaagccgatatgctggggggcacgtgttggcttgcctacgggatcatcgcccgcgcctggacctcgattttctctgtgagggttttgctcgttctcggaggactccggcggagatagaccacctggcgaggttgatggcgccgttggcggagaagatcctccagtctatggattggcgttggccttcttggtagtcttcgtatcctgtgatagatatctcaggaaaaaggtgtaatatagctttggatttgtgtaaaaactgtaagaagtattttgtgaaatagaaaagaaatctatctttaacaaatctttcttacttcggatgtcgtgtgtaagagtgtgttctcagttcgcgactttagtcagtcgtttgagtcgtacactctccctagcccccagccttgtcgtcggaggaattttctcggaggataaggctcttggacctttgacctgccttggttgaataagctctgatcctagcccccagccatgaaattggaaacttaatttccgatttcgcggcttggttaatacgcacggcgagaactcttacatgaccagatcttacatggtctttcgtctctatcgtctctacaggatctgacaaggccttatcggctctgggcgtccccagccgaagatcccttaggttcctcggaggccttgtcgagacggcgtaaagggacatgaggataggtttcaactctaggtgtcatcagggtaagggatcatcgggcggaaacactttgattgtaatatgggcctaagaataggctttattgatactgtaaggtgccttacaggtacggatggtattgactcatacatagaatttatgtagttggtcaatgttccaagaatctgttaactcgcgaccctcgccgtctgcaattttgaatgcgcctggccgcaagacttatgtgatcgtgtatggtccttcccatttgggtgagagcttgtttcgccctgcttggctttgaacccgtcggaggacgtagtcgccgatcgaaagtatgcgtgctcggatgcgcttctcgtggtaacggcggagggcctgttgatagctagttgctcggacggcaactcgttcacgatgttcctcgagtagatttacatcgatgtctcgctgctccacctggtcctcgtcggagtgcttctgtactcgtgtactctgatgtcgtagctcgctggggagcatggcctcggagccgtacacgaggaagaagggtgtttccttattagacgttgtcggtgtggtgcatacggcccatagtactgatgggagttcttcgacccattttttgtcatgtgacatgagcttgtcgtagacacgggttttgatcccttgtagtactatgccattcgccctttcgacttgtccgttgctttgaggatgagagaccgaggcgaagcatatcttgactcctagcccgatgcagtaatcctggaaatcggcgctgatgaactgggagccgttgtcggttatgatgcggtgcggtagtccgtatctacagaatatccccttgatgaatttgatggcgttgtcggcctggatttcccccgtgggtactgcttcgatccacttagtgaatttgtcgatcgccacgaataggaacttgtagccgccctgtcctcgtgggaatggcccgagtatgtctagcccacagcacgagaaaggccaagtaagagggatagtctgaagcgcttgcgcgggtagctttgtgtgtttactgtggaattgacaggcttcacatcgctggaccatgtcgcatgcatctttgagggcggtaggctagaaaaacccttgtcaaaaagcttttccgaccaatgtctgaccggcggcgtgtgacccacaaatgccttcatgtatatcaaggaggaggtgtctgccgtcgtcggacgagacgtatttgagaagtaccccgtttggcgctttcttgtatagatcgttgccgaccatacaatagatttttgctttacgggttattttcttagcctctgtatcgtcctcgggcaactcctcgcttgtgatgaacttgattagtgggatgcgccagtcatctgtggtctcgatatcggcaacggcgtgttctgcctttgtggcctctgagctaatgtcgggggcgttcgggctaactttgccgctaacctcttttactgatggctttatcaggatgtccagaaaagtgccgggctcgagcggttttcgtctggacgcacgtcgtgctaggtcatctggctcgatgttgtctttgcggtagacatgtcggacctcgatcccatcgaaccttttctctagcttcctgacttttgcgagatacttggataactcggggttagaacatttataatctttgtgcacctggtttgcaactagctcggagtcccttttcacgattagtcgcttgaccccaagtgtggctgcagctcttatcccggcgagtagtccctcgtattcggttgtgttattggtcgccctgaagttgaggtggattgcgtgcttgaattgatctccggagggagacgtcaagataaatcctgcccctgctccttggctgttgagtgtgccatcgaacgccattgtccatgttacgttgtcgacttggttgtctgatttgttatcaggcgtagtccaatcggctacgaaatcggcgagtacctgggacttgatggctgttcgtggcacaaagtggacatcaaatttgctcagctcgactacccatttcgcaatgcggccgacaacgtctttgtttctcacaacttcaccgagagaaaaagacgagacaactgtgactctgtgggcttgaaagtagtggcgtagtgtcacgccctgataaattcatcccgaaataaaaatcattttctaaaaggaataatagaattaattaaaattcgaaaagaaattggcaaacactaaaatgcgtacaagaaaaattcgaatgtggcccggagaatttttgttaaattctccttggtctaaaaggagccctcaaattttacttgaattttcagagcaccggaaatgattattaagcaacaaaaacaattatcagagtttattaaaaagaaaaagctaaaaataatcctccttttcctttgggccaagtttggcccaaagtcctccctctctctctctcagcccgcggccaaagtctccctctcctccctctctttccctcctctcccgggcctctcctcctcctcccggcccacctcttccctccccctcccggcccactccctcctcctccttcctcccggcctgcctcggcccagcagcccggcccaagccgcagcgccctcctgccctagtcgcgcgcgcacgtgcgccgcacgcgcgttgagcgcgcctcccgcgtgggtcccgcctgtcaggcgcgcccccaacctccagccgccggcctccttcctctctctcccgtgaaccctagcgccatttcctcctccaaatccgtcctgaatccaaccgttctttccaaattgattggggggaattaatccccattccttcctctttgatttcccccgttttcccccttgaatggctcccccaatcgccgggaacggacgcgccaactccggccaccttccatggccgccggccgtgtttcccgtcgccgttccgccctctcccatgcccggctccctcccctccgctataaaacggaatcccctcgctccgttctatcgttttatccccctcccgcgatctcccgtggtctctagccacctccccgccgtcgtcccctctctcccgtgccgccggccgtcttcagccgcccctgccgccgcgtcagcacgccggccggccgtgccgtcgcctcctccagcgtcgcagccgcctcctcttcgccggcctaccatctgtttcccgcgaagacctccggaagtgcatccccaccggcaacagtggcgttgccgccactgttccgcctccggccgcctctgccgcgtcccttgtgcgccggccgacgtcgccaccacctctcccggcaccggaacgccatcctcttccccggccaagccacggcgtcgcccgtatttcgccggaacgccgtcgcgcgcgccgcctctccctcggtctcgtcggcagcccctttcgccgtgccagtgcgccggccgacgtcgccgtctccacctccggcatcacagcggcaaggtcgccctcggcctcgcctccccttcgaccgaaccgctccgcggtccatcgtcgtcgtctccgttcgttctcctcgtcgacgtcccgtcggtctcccggctcgtcgtctcgctgcgcctccaccgtcatcgtcatcgcagcggcgtgttccacgccgtcctcgtctccgtgcagctgctgctagctgtccctcgtcgcctcctcgccggccccggtcgtcggcgtcgtcgtcctcccgtcgttcccggtcgtcgtggcgttcgtccctccgtcgagccgttctcgtccgtcctcggtgtttcgtcaaggtcgctgcagccccgtcatcgtcttcgtcctcgcctccgcgtcgtcaagcctcgtgccggccgtgtctcgccttcgttcaaggatcgccgccgaagtcgttccctcgccgtccgtctccgccgcgtccgttcgtcgttgtctttcccacgcctcgtcgcgtggtggtaaggatctctcctctcgctgccccgtcctcgtcctttcagtgtcgccccgtacccgttgtgcggttgtcaaccccggtacccgtgtaccggtgtcggtagtcgttcacgtgtgcgggtggtgactgtgtagtgtccgtgttagtgtgcccactcggtagccgcgtggtttccacgtgtgcaggccgtgtggtgtctagtggagtccgtttgtcggccactcgcctcggttgacacacggggtccgcttccgtcgacccgtggaccgtctctatgtactcggtctaccgtggtcctttaggttgacatgtggggtccgcatgtcaacagcgcagccttcctgtcttttccaggctagtgcttccacatgttttatagttgaaaaacctaattataataatccgcaaatctccatataacagcactaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccgaaggttcggaaggccgttctctttgagcaaggcaagtcacatcatccttgagcatattgaatcccagtttataaaattattttgatttaaattaatgcattaacgctttatttaaattcccgcgttatcactgttttatttagccatgcctatttacctttgttaagacattattattgctattgttattattaccttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatgtcatggcacagggctggtgtcctgctgctaggggctcaatcctgcctgcctgtcccgggggttccggctataggtggggttgggtcggtactcttgtttatggctaggatgggttgggaactatgtcacgtcttccgtccgtataccgtggtggtatgtggcatgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatcttcccccccccttcagtaagagaagctttggagaaaaagtcttaggtggaatcctagcttataccccagttgagcgcctgtgaagatggagccgtaggcctgctagtccgctgctgtttatttttgattgtcaggccttaagtgcctttgtaataatgtaaatattatcgatataataaagatgtgccttttgtaccatgtttgtgtggtgtaccccggcttttcctgggacggggattaatacactagcgttcgggaaaatgtatttttctcggtcgcgacacgtagcttccttgatgtcatgatgaccacgtaaagcagcttttggatctgtggatatcttgtctttgcgtcgtggagagcttcgctgacgtaatagactggtcgttgtactttctccctctcgacaacaatgacggtgctaacggaatatggtgtggcggtaatatagaggaataattcttcattaggttggggagcaacaagtacaggggggtttgataggtagcgcttgagtgcaacgaatgcctcttcggcttcctgtgtccatacacatttgtcttgtttcttcagcagagcgaagaaaggttgtcctcgttctcccatcctagcgacgaacctgctcaatgctgccatgcatccggttagcctttgtacttccttgagtcttgtgggcgacttcatgttttcgattgtcttgatcttcttgggatttgcttctattcctctgccagagacgaggaaaccaagcagcttgcccgacggtactccgaacgtgcacttctctggattgagcatgaggcgatatcgtcggaggttgtcgaacgtttcccgcagatcgtcgatcaatgagtcgcctgccttggtcttgacaacgatgtcgtcgacgtatgcctcgacattgttgccgagctggttgctaagtgcgccctggaccgtgcgctggaaggtattccctgcggttatcagtccgaacggcatcttaacatagcaaaataccccgaacggcgtgatgaatgctgtcttctcttcatcctcttttgccatactgatttggtggtagccagagtaagcgtcgagaaaactcaacagctcacagccggctgttgagtccaccagttgatctattcgaggaagagggaagtgatccttggggcatgccttgttgaggtcggtgaagtcgacgcatattctccattttccgttggccttccgcactatgactggattggctagccactctggataaagtatttctctgatgaagccagctttgagaagtttgtcgagctcttctcgtatggcttgttttcggtctggtgcaaatctccgcagtttttgctttactggcttggcatcgggtcgcaccatgagtttgtgctcaatcacctccctggggacccccagcatgtcggatggctgccaagcgaacacgtcagcattgtcgcggaggaaggtgatgagcgcgagctcctatttctcgcttagtgtcgcaccgatcttgacggtcttgttggggttggcactggagagtggaacgatcttgattgcgccgtccggtttcggcgtcttgttcgtcttgctcacttacttgggtggcttagtcgttgcgggtgggctgggtgtttgctcgatcatgtcgaggctccgtttgtcgcactgcaccgccaactttgcgtttcattgaataataattgtgcctttccgccccggcatcttgagcacttgatacgcgtactgagatgcggccataaacttcgcaagtgcagttct

SEQ ID NO: 59162 - DNA, 6276 bp, Oryza sativa
ttcgtcttgctcacttacttgggtggcttagtcgttgcgggtgggctgggtgtttgctcgatcatgtcgaggctccgtttgtcgcactgcaccgccaactttgcgtttccttgaatagtgattgtgcccttcggtcccggcatcttgagcacttgatacgcgtagtgagatgcggccataaacttcgcaagtgcagttctcccgatgatggcgttgtaagctgtatcgaaatcagcgacatcaaaggtgatctcctccgttcggaagttgttggcttggccgaaagtcacaggcaacgtaatcttgcccaatgatctggacgaggattggggagtaattctatgaaaaggttgatcggttggtgtcagcgagttcccatcgcgtccagggtgctgatgaaaagaaggttgattgagctgccaccgtcgatgaggacccgtgcgaccttgatgttccgaatagtgggttcaaccacgatcggatatcgtcctaggatgacggcggtcttggggtggtcttcttccgagattctatcttctgttcagaccacttcatcttgggtgtagccccctgccatgtctaacagacttcgcgttccactttcttgtactctcgtttcgaggagtatgttgtggaacccccgaagatgtgtgaaacgtggaggtcagagtctggatatgctgagtataattcctggggagccgcctccgcgtcctttttaaccacgcgtactcgtttgcctttttcagatgcaatgtgcttctcgagcgattttttgaaaacaaggcaatcttccaaggaaagtttgtccgtcttgtgcatggggcaccatgctttttttgtgtcgctactttgtgggtctgggcgcttgggaggattcacgtattttgctgcgaggacttccgcttgagctttccttttcccatttttgcgatttttcttcttgcttgactcaggtgcgtccgtggccgatttcttctctcccccgatcttcggcttatcgttcttgcgtcttagcgcatcatctgcgtgggcgcatcgctcaacaatctcgaacaatctccgagtggttgtgatgtgtcttgttgctaactcctaggtagtatagcgatctctgacaccggatttgaaggcgcgaattacagaagcgtcggtgattttggagattgtatttctgcactcgttgaagcaccgaacatattccctcaaggattcacccgagttctgtgtcaacgcgtgtaggtcgtctttgatcgcgtggcgcttgtaagttccttggaagttggcgacgagctgttgccacaggtctgcccacgaagagattgagtagggcagaagatgcatcagccacgaacgtgcagagccttttaatgcagttggcaaataattcgccaacgcattgtcgtctgctccggcggcgtagagtactgtggagtagacttgaaggaactcctctgggtcagtgctcccatcgtacttttctattgctccaggtcggaatctctcaggccatcggacatcacgcagggaacgactgaaagccctacacccagcgcggggggcggtgggttgtcggcgatcatgtgtccttcgtggatgtctgtctgatgatgaggaagacgaggatgatgacgatgatgatgggtcgcttggttccggcgtccgattacgaggatatcggcctggatctcgagaatcctgtcgtcgtcccccgctattgtcttggcgccggtctccatcatcgtcgtcgttatggcgacgtcctcgaccagtatcgtctggcacccgccgttcgcgatcgttgtgatcgtggtggttgtggcggttatcacggcctcggtcttcgtttaaacggtcccctcgatcttcgttatcagggcgccgtgaagagacatgacgtcgggaatgattctcgttgtctcgtgtgcgtcgtgcctctcggcggccgttgatgtgatctcggagatcgctagtgccgcgaggtggaagggtagctcgctgaggcgattccctccgttcagggttttcaccattggcatcgccagttggtggctgctctgggtgcgctgcggcagcgacctcttcgaacacgttgctgaggttggtcactgattcccgtagtcgctctgtccaacgcgcgagatcgtcgttcagaatgagattgtagggggtttccctcagtatagagttgacgactctgatgtgctgggctggagtggtcaattgattctccacttctgcattggtgcgtgctgatgtgccgacatcatcgatagccaatacctcccgcggcgcgctcattgtcgatgatccatagtcttcgagaaggtgcaagactgatggttcgtgaggatcgatattgattaccccaacaaatcgatctgaagttggcgtcgctcctcggtccttgtccttattcctgatggggatgtgtgactattggaccttaggggatggcgctttcatggcgctgagaaagaccttgcagtctgagaggtcgtgattctttgtcttgtgaataggacaatagacatcacgagttggagaaatacgctgaattccacgctctttgcaggcgcgaatttcagcgcggacgttgaggaaaacccagcaggcttgcaaagtgtgtttcctggttttgtggataggacaccaggaccttgttgcttcggaagtcatcttcctcggctcgcggttcatgtcggaacgacaaggtttggccgcatcagaacccttctcgagctgggatgtcgtcgatgctccgttctccgcctcggcgggaggatctttcgacatggagtcgccttggtttgtagccactgcattcttgtttccggtcattggcggaccggttgagatcggcatcgtggtgcaaaccgggaagacgatttcgccgacttgagtccataccagcatcgttgaagcagggaatacttggctgaggttggcgttgacgctgttatcgactaggctggatgacatagtagtagaaccttgagtaccaagtccccctacctggcgcgccactgtcgacgggtgatacccgtagaccggatatagagggtattggggtacattggtacaaggatctacgtaatacgacatgaagtagacaaaagacgaggattatactggttcaggccccttggtaggtaatagccctaatctagttgatgtgggattatatggtggaaaacacaggttacaaagggaacaatggaactttagggatccgacgagatcgtggtcgagttggttcgactagatccttggcgatttggctccttgcaggctccgatttcgtaggctgtgagggttgtgttggctccgagattcgatgccccaggttcccctcggggggtcccttttatatcgcaagtcaggcggtgttcaagtagaactcggagataacagaccctatacaatacattgacaacccagtcttgtcgagtaggactctttccatccgtagactccgtgaaggattttcttagtgtacacaggaagtatccgtatgcgcgtaggtataccctaccaatatgtaacatatatcgaaaggtaaagggtatgcctaacccggaacctgcaagaactcgagttacttctgtactccctccgtcccacaatataagggattttgagtttttgattgtaatgtttgatcactcgtcttatttaattttttttttgcaaatataaaaaacgaaaagttgtgcttaaagtactgtagataataaagtaagtcacaaataaaataaataataattttaaaaaaatttgaataagacgagtggtcaaacattacaagtaaaaactcaaaatatcttatattatgggacggatggagtattttcttttggttttttccgagtgaatttgtgggactgtggagtactgtactgagcacttgtatttttgttggttttaaattagtcttttgcccttcggtccgattgaccaaagctgacttgacccagcggtcgtctcctcttcgacctctctctcattctagagtcattgcatagtgacgaaactgcgattcccctgattctttttcattaacagttcaagcacactagtaaaaagccgttcctttggcaatacggcacactcgaatgagtttgatcttgcggtgtttcttcggagttgaaaaaaaaaggtactcctacctcgctaacgttaggcccgagcacgaaagctaaagataaaagcggcgcattggtggtgcttgaattatagtttcttgatataagatgctcctacaaagaaaagaggttgccatggggtctgtgcaatgggccaaaacacaagcaacacatgagcagcatttgtaactgctgctgagttatgcaggcacggtgtgacaaatcagctttgcatgcttattagtcttggtcattagcaaaagtttgatttgatgcttacttaccaggctaccagctagtagattgatatatctagtgatggcgctggcgcaccacggttggcatgcatgacgtagtcatgataccactctccgtttccctctccacatgttcccctttggcggtaatcaccattgtaaaggcaatcattaggaggcaaccccgctgtctttgcttggtgaccgaggtgattaaaaggaagcaaaggcgccacagcgaagaaataatctattccaaacaatacacttgtagtagtagcagcagtagcagtactgttggatcaagccatgcaggtatatcgagcaagtggcaccattgttctgtgtggcaaccgcctggcagcgaacccccaactgctaggtttctgatcccgagacgaatcacatcctcatctctctctctctctctctcgaattttctggcgcgcgaattttaatgcaggggccagagggggcgcaacggcacacagtaacacagtaagagcaagtttaatagtatagctaactactagctttaattcatctatagccaatctaatagctcatctatacaatagttacatactacactattaatatctggtcccacctgtcatacacactgcgtcttggagtccgtgatatagttggctataaatctatagcccgctgctcttctctctctttatttatctttttaaaatatgtttatagctggcttatagcatactattgtacatgctctaatcacgtcgttttaaacccgtgtgcctctgttgttgccacacgcatccccacggagcgcggtcaaagtggcacatcgaacgcgtcagtgtgttgtacggcgcgtgcagccttaaaccgcttggtctcttggctggctgcttttggttgccttgatcgagcagtgcttgcagtagtacagcaagttcacttgtacactacggagtacgcttgggttgctcgagcagcaacgcaccgctgggctggagccggcgaaagtgaccgggcgaaccacaggctcttgcagcggacagatcgatgtgttcctgagaaagcagcagcaaatctttcacgaaaggaggagaaaggcaaagcgcggccggctaggtcggcacagtttaaagccgcgcgcgccacctaaagccatccccagttggcatgggatggcacggcagcgtgtctggagtgggaatatggttcagccgaagaatttgttttcagtttttggtatttaggttatccaaaactgaagatcaaatcatgctatgaaactattaatatttttttggggccagcggcagatgcctcaagtagattttatgtcaagatagaagaagttcagtacatagaactaacaatcattatctgttatgattcaaacgcgtcccaatcgataccaacccattagagtgaattactacatctctctaaaagttatttttagtgaacatcaagtgacatcttagatagcggactagccaacctagccgcagaccatgcccaccattctccatgaattccccgggctattttccacagccgaaaagttgccaatactaattaatttggttttgtagcttggcttggtattttggttgtcatgtaaatgtttgatagctttaggcagggcgaggagggcgtagacattgggggtacggcgggtggcagcttggctcggcctgtggcaggcgacaccgtgggtgattcatgtgggtgtgggtggtcagtgggatatatgggaggactagtcgactatgaatttaggtttattgtatagggtctattgggctaaaggcttgtttagattattgccaaaatcaaccataccaatatttgggggaaaatatgtagtgcaaaccacatatgtagtg

SEQ ID NO: 59163 - DNA, 1411 bp, Oryza sativa
aaagagtgatgtaaacagtagctacgaaaattaccataccatctatctcttcagttttgttgaatgatgtaaaatccaacaataagtattttattcacccattttacactagtacagatcattccatctgtgacggcccataacaagactggaatttgcgggctgtcacaaggaagtaatctcaatcaggccgaagtttcgcccgattgagatatggtcgcacagccatggtatacaggcataaaactaaagcccatcacggatgacacttatctgtgacgggccatagttgaggcccgattgagatgagggttccatatctcaatcgggccctaaaagaagcccgtcacagatgagggtcatctgtgacgggctccaactagaggcccgattgagataagtttaatgcccgtcacagatgacactcttttttgacgggcttttattaaggcccgatagagattacttgtatgcccgtcacggttcattgttttagggccgttacagatatttgttgcacagtataaatacccccccaccacctagtgtaactgtatcccactgttcactattttagtgggaggctgtagggggcgattttttgtcttttttccaaggaaaacagaaaattcccaaaagtgatcaaaatagatctatcaagtgagtaatattaatcattaattgagcaatttcatcacgtcttacttttgtaatactgatcttataagatgtgcatgtaatttgtttttttattttgtaacaattgatcgaagttggatgtatgcgaaaaatttgaaacgtcattctacggagtacagaaagggcgtaataaattttatgaacgccgcggaggaggatcggaaaagaagaaacagtgattatatgtgttgtccatgtgcagattgcaagaatgagaataagtttgatagcggagaggacgtacacggtcatctgatacaacgaggattcatgaagggctatacatgttgggggaagcatggagagtaagaatcaggaaatagagcagcagcagacagaagtggtgcgcataatcaagaagatgaagatgagcatgacatgtttaaaccttctccattgggcggtgaaatggttgatgtggatcacgatctactgcaagacatgttacgtgacgttgaggacctagcccagaatgagagagatggaatgaagttcagcaggttggtcgtgattccgagacgcctctgtacgctggatgcaaagcaaaacacactaagttgtcagttaccttggacctaatgaagctgaaggcaagtagtggatggacagacaagaatttcacagatcttttaggaattttgaagtctatgcttcctgttgagaacacattgcccgagacgacatacgaagcaaagcaggttctgtgtccact

SEQ ID NO: 59164 - DNA, 7027 bp, Oryza sativa
ctatatatgtggtttgcaccgtatattttcccaatatttggcaatgccaaattttaatgtatttggacctaccaaaattcataggagttagatgtattttgtttgaagccttaccaaaactcggttgtatttttagtagtggaagtaatattgatagggtaatattagctaaagtatgatagggcttgcagtagcaacattgtaaacatgccataaatttcggtcaattcagttaatctggttaactgaggtttttttttcaatgcggagaggtatataatcaagttgatcgacctaatttggttagccgaggatacaactgaatttatgaccaagttcttcatcttggtctcagtgtttcggtttggtcaatcagttggctagtggcactggcttgcacatagcttttgtccacccaatgtgtgagcaagccagtgccgctagtgaatcgcgcatagatttccagtgaaaatgtccctccggccaagttctcgccaatgttgtgtgaggagagtatttctaatttatctcgagcgagttgagcttgagactagggttttcaatttcggtaaccatcgaaattttgagaatatcatgaattttggtgtttttccatgaaattatttgaaaatttaacatagtttggctgaattcaaacaaattttgataaactgaaaagtatttgaaaaaaatctgaaacttttggacgtgacatgtgcttgctggtggggtaaaactttttaaaaatttcgaaccgaaatttcaagggaaaattgtaaccatgccattataattttgcaaaatttgagatatgacatcctgacccacatgtcattgactcatgtgggttctacatgtctttaagataccgatggtatatctcaaactttgcaaaattataatcgcatgattccaaattacccaaatttgaaaccctgctcgagatcagtaaggcagtaaagcaccactggcaatggggccgtgctgtccgacggaaagcctagcccatctcaagcccatgaaagcataacaaagccccaaatgatttgacaaacgacaatctcgtcgacaaacgataagaagtcgagccgaaagcaatacaactctgcttcagcctcgtctttaccataccagtttcctatacacaattaactctgcaaccgcgacaggttgactgcctctgtagctgtcctcggctgtctttgggtgaccagaagtctagtttgctttcgcgtgtcaaatcggcatttctgagggattagcacgcggccatgcattgcctttgatcggtcgcctagaatgcaggtgcacatacgcgcacatggacgaggatccactaatgtctaatgatccagcaacgggcagaggcatttggtgttttttgctttatctctcgctccgaatcagagccttcgcacgcgtccatgcatcaaaagaaaagactgcgacgcctactcttagcactgcacaagtgtggaccttagtcggtcgccaacgtaccaggctgccagctagtcactgttacaaggttttgatcacgcacaaagtaatggaaacggtattcaaatgtagacacggactttgtcatctcgccaaacaacattccctgtgcatttttattgttgttgctgctgctaaaggattgaccacattcaaaaataaataaacagccagattctgacaaatgataaccgttaacactggtcaggagtatagtatgtggcgacgtggcgtgcgctctcaggtcattcacagtgcatctagatggcattcagctccaacctcccacatccaagattccataccacacatgcatctcccgtgaccaaatgaaaaatgggaagctaaaatgggtcactcgttcctcgtcagtttttgttaggaggggagaagaaatcttcgctcggaggggagagacagcgaccgagttgggaggggcatgccgggatcgtcgtcgccgacctccgccgctgtcgctcagaccctcgccaaccatcgctgtcggcatattcgttggggagagggagggggagaggtgccgctgccatcgacctgtagctgcctcccgtcttctcccaccagatccatgccggtgagttccatgccgccaagctttgtgccgttccgctccacgccggccggaggttgggggagacgcggtggtcggaggagaagggggagactcgatccgcagtcggatccgttgctgcccgggccacccagcgccgtcgcttatcggggaggtgtggtggccggaggaggaagggggaggtgcggcggcagccagaggaagggggaggctcagcggttggaggaggaagggggtggcgtggcagtcggaggagggggaggcgtggcagcggagatgaggaggggaggcgcgcagagcgagtagtgagggggaggcgcggcactgagaggagagggagagagaaagttttttttgtgtggaccccactcaaggctacatagcactgtgaaatttgtggcaaatattattcttaggtgttcttggggctacgtggcagatgaggttcggcaaaatgtgttgccgcattgctaatgccctcaccatttttgagcttgaatgatgggagcttgaataaagtagacacacctgggagtatgtcacgtctgctagtgttttcaggagaagtacatctaccctaaaaaaaacgagaagtactcctacatctacacggctgacgtggtacaaagtggtgccgatctgacagtaatattgtaacgaggccgaaacagaaaacacctgctataaaagggacttctatgtgacttctggcctggtgtattggctttactgggctgtaatgccgtttgctgggtttctaattcatacaagtacttaagtccaagagggcatggtctgtatatgggctgagcaattcctttccaaaggaataagttcactatagatgtctcaatttgtcacctagcgtgaggctagcatgaaattcgttcgtaaaccaaaatacaagatataacgagttcctcaatttacaaaactgtagcatccgaggtcctagataatattatgcctagttttaactgacatggtatgctaagccagcgtgggatccacgtgggcagcgtgggatccacgtgggccacacatgtcagtgcctagcactttctttctcctcctctcccctccttggagcaagaacatgcccaacccaagacccagaactcatctcctgcctatgcccatgcccactattctcattggatataaaaaaaaaacatacccgttgagtatcggatacccatagattttaaaccacataatgtaatatattaatttatatatatggataatcggaaaaagatcctctgacttaattgtttttttagagaatctgacttaattgttgtacagttgagccactgacatgtgaaccataataaagtgggacccatatgtcagtgactcaactgtatgtgtagttaagtcagaggatctgcttccatttacaatcacatttagatatgtatgtttagccaataagtataaaaccacaaacaatcaataccacaagtcataatcattcacatagtattaaatgcgggtaaaaatccgtaaattccacaattacaaattatttcatcacatagaaagaaagcagttgattaagccattaatagtattggtcatgtcttgatatataagaagtacatcatttgacacaaactcctacaaataacaaaaattaataacatatactatcatgtcatcacaaataatttcacgtattccctcactttggcctccttattttctagctagcaaacaataaatatccattaaacatagtgtatattagtatattatgcattaaacattttttaccgtgctcctaacccaccgcatgatacatctaataaacttgaaaattgtaccaggaatctatctatctatctatctattatattattaaaacaaccttgaaaggtggcaccacgttcgctgtgggggctagaaattcccacattaatcggagaaaaagaaaagaagagtccaaatagaaatacaatcttaaaaaaagctgaaattcggaattaaaagtaagaaatattgaaagaggagtccgtataggaacctaatacgagattaatcaaattcggaagaaaaataaaataaaatccgaaattagcaaaaaaaaaaggagaagagttcgagtaggaatacaattttaaaataactgaaattcggaattaaaaataagaaatattgaaagaagagtacatacaggaatccaatacgagattaattaaaattcaggataaaaaataaaaaaatcaaaattagaaaaaggaaaagaaaagaagagttcaagtaggaatacaatttaaaattaattaaaactaggaattaaatataagcaatattgaaataagagtaaatataagaaccaatagtagattaattaaattcggaataaaaaataaaataaaatctgaaattagaaaaagaaaagtaaaatttcaactaggaatataatctataaataactaaaattgttgataaaaataaagactattgaaagaaaataccatctaaaacacatgacgagattaattaagtaacagatctatataggagcagagtggtggaggttcataggacatctaaaaactattaataaaacgccaaacaaaatactaatgacgattaaaacgaaggacgacgggcaggtcgtgaatcatcggtcaaggcggttggcggggcttctagaaagtaaaaaaataaaacccaatgataatcatatttgatttttaaaatctcaattacaataaaaataagaggcagctggcgggtcgtataggagtacaatggcatagccaccgatggttgtgggtcttctagaaagtaaaaaatgaattccaacgatagttatgtttgagttttacaatcccaatggcaataaggagtatgcggcggatgggtcgtagaggagtatattggcagcgtttgataggatttctattatgaaaaaaaatgaaacccaacgggacaatatactctaaaaactataaggtccaatttttaaaggttcgggcgtctaaaaataaaaaataaaccccaatgataatcatgtttgattttaaaatctcaatgacaataaagaagggcggcagcggacgaaccgcagaggagtacagtgacaaagtcgatgatgttttggcggaacttctataatataaaaaaatgatcctaaacaaaaactatgatatatttttaaataataatgacaataaaaagaagatgcaatggacggtcgtagaggagtataataacagcgtttgtcgagacttctagaaattataaaaaagaagaccaacaggacaataaagtctaaaaagtttttagatccaatttttaaaggttattaggagaatgaatagaaacagtggtagattgagctatataataacgaataatatgatagaagtaaagggtgctgatgtgattttcaaaaactatgaaatttgaaacacaaagataataaggtttggcctttcaaaatcttaagacatcgagataactatttaataatttttaagtaaaatcatattaaaacatatataattttatatgggtgctagccgcgcaattgcgcgggccacccagctagttctgagaacaacgatgaaaaacaacttaccatactatcacctaaatcgatggactcattacttttaatcattagaactatatgtagaaaacttaaaaaataaaaaaccacttactacccctgcccactcgcatgctcatgaggtgcacattgccctgctcctcccctctctagctcatgctctcccctccttccttaggcagagttctttccccaacttttccaacatacttccctcgttttccacgtgcatgcttttcaaactgctaaacagtgcgtttttttgcaaaaacaaatttctatacgaaagttgctttaaaaatcatattaatccattttcaaaaaaagtaaatacttaattaatcatgagaaaatacatcgctctattttgtatgcgcggcaggtgagttcccaacctcacctcccgaacacaaccttaatttagatactaaattaatagagaacaatttccaagctacatatctcattctgtcagggttatggataccacatacccagtagtaaccgactaagcttggcaggacccaccatataccaagtcttatacggaatcatacctcatatatagaaggagtttcggataaggaaggacaagaagagttctatatgaaaactataagggctactcggattgtatccatattggtttccttagttctacttagacaaggggatatctatgtgtataaatataagaccccctaggaggagggggcagaccaacaagacacatcaacatcagagataagcctagatagaccctatccagtgcttgcggaggccaacaacagggatctagcgccatctctaatcttgacgagttcatattcgaggaggaagactaccctgtcgtcaactatgtgttggtgatccatgccgccaagttgacgacagctagataggttatcccaattattatacttgtgtgattctaatgaatatagagcaacaccggcttcggccaacaggagtagggttgttaccttcctatgaaggggtccgaacctgtttaaaatccttgtatccatcctttttatctcaatctcgcatatatcctggtaccaatgatctccataccttgcaaataccgtagtcgatacctaaaacgtcgacacatccctaatctatcgataaaataatgtgaaattttgacagcgtatattgagtcatatatcattctacaaacatacacatctaaattaactagcatggcggcccgcgcagattgcgcggctagcatcattatattttctctcatataatagcatatctgttttctcattatattattaaaatatattacaatgacaacatagttttaaattttgcaataaccttacgaaactactaat

SEQ ID NO: 59165 - DNA, 5733 bp, Oryza sativa
tgggacccacgggcccacctgtcggcgagagggagagaggaggccggttgggggaggagaaatagactttagggggggaaagagcagagggggctgagggaggggaggacttgggccaagcccgaaaggaaggaaggggaatttatttgcttttctttttatttaaattgatttagtgaactttgtggcattaaaattatttcttgagctccgaaaattcacggaaaaatctagagagtgtattagggcacagagaatattacaaaatattcccggccaatgatttttaaaggaaaattttaattctccaattatttcacttaattatattgatttaacttttatttaatttctagaaaatgcattatttaatgatttttaatcctgaacgaaaatcggggcgttacaaaggccaaccactacaccaggcggtcgtctaccaaagagacccgcctctgctccttcagcccctcttgctcaagatcgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagtcctcgcttctagctccaaggaagctagatctgggcaagggccaggaagagactaagggcaaagaggtcaagaagaaatacgtcgctccacaggacttccaactaggcatgccattggttggagatgatgtgcttgccgcaatgggcaccgcttgcaaggaccttcacgcatactacatggagaaatctaacgctaggaagccgaataaagctaccgatatccttggagagcacgatggaaagccattccttggtccaacaaattatatcgtcgtcgacttcaaggatctatttgacctctgcaggctccgagcggtggacacaagcctccttaagtgctactccttgtaagtattgtcgcccaactcaatctggtaataacaatcggattaactcgcttacaagatcgtttatcctgtgtgtaggttaagttggcaatggtgttagaagaatgcaccggaagttgccttccttgatccacaagtggtcactgtcacaaatctccagaatgaccgtcaaggaatggtcaactacatctacgacaccttgtggtcccgccaagacaaggagtacattatgtacgcctataatcaatagtaagtgtgttatctaaatatacacaacagcatgacacattccttcagtacttaattaactttcactatattaatgccgcagtgcccattggatccttctggtcataacacctaagtggagtacatgtcactacttgaactccagaattgataagaacgcatatgattggaccccaatttaactagcgatagatgaagcgtgggcccaatacgtgcaaagaggaggcctcaggaagacaggacatgacaccctcatccacaaaaaggatttcccggtgaagcaacaaataggtgaccagtgcggattccatgtgtgccacaacatgcgccttctgtacagagaaaaggtgaagactttggctaagtttgaggtcggtggtctcaattgtgatagactaactacattttagtacttatatatgatcgatcaactaatctggaattatgacaatgtagggcacaataaccaagtctctacctaccagctttgaggaggttcgtgagaagatagccagcttcatcctccgcgaaataattaaccccaaaggaatgtttaggcttaaactaaaatgatgaacaatgttgaacttttatgtttaggcaatgatgaacacttattatgcaactgtgatgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctatgaatgtgtggttgtgtgaaatatattgatgtctgtgtatgtgaatgcatatgtatatgaatgggtgatgctggggagctggggatattggatatctgtatttgtttctatcatttctgcagcgggcatggctagcaaaggcctgaggctagccaaaaaacaaaattttttttttttttgtagattatagtcatctgtgacgggccataactaaatgcccgattgaggtcagtagtcatctgtgacgggctctagtttaggcccgattgaggttagcggtcatctatgacgggctctagtttaggcccgattgagatgagtatcatctgtgacgggctctagtttaggcccgataaaggttagtagtcatctgtgacgggcgctaattgtggcccgattgagataggtcatctgtgacgggctatagtttgactggtcgtctgggtcaaaactatcggtgacgggctttacttagggcccgattgagatagattcatccgtgatggccgttttcccgattgagataactcttcacatcagtgacttctagcctgtgacgggacgctgtgcccgattgagatggggcttaccacccgattgagatgagggtatccgttctagtgttatcaaactacaccatacattaggagttcaacagtggccacggcagattatgcgaaactacatacttccttaaaaaggcgaaaccaaaaagtggccatgaacagaaaacattctatagtatcagtgcaaccaagaaatacagatggaccagcatgcaattcattttgctataaccaaatcacattgaagggcacattgaacaattacgaaattttttaaaatttcctatatgtctagagaatgtggaatcaggatagaaatgtcagcgagatatatggtaacaagtcttcaataataccattattgggtggcaaattctcaagttgacctttcgacaactacaccggaacatatgatttccaagataagttaacaaagaatttataacgtaacagaatctataggcatggtcaaacaaaaataaatcatatagtagacaagcaattcaaacggcatttttcatcatcaaatagcactaactggcaggtcgaagaataaaggaagtaacaacaagatcgacaagctccagaactagatattgacaaagaaccttcatcagaaaattaactcgcacaaatttaacaatgagttactactaaatgcgattcattcatagcatgcatgcctcacatagtctcaatgaagggcggcattaacagatcaggatcagggctacatagctagtcaattaccaagtagatataactgatacgaactgatagacacaaatagatacacaagtgctgcaactgcaagatattaggggcataaagataagctggaaacaacatagtttgctgatcagatagaaatcacggtagctgatactagctaatactacatactaatcgatccatagataatagagataggtaagggccagctgaatctatcattatcctgcagccaaagtcagtcttgtactccaccatctgtgatcacagcgagcgatagcaatttgggtcgttgaagtcgtcccagtcagcgcagacgacgtcgctccagtcgatagcggcccatccttccttgagctgagcctgcatttcggcctaatcggtgtagtagctctcgtccaccatgtagcagccattctcctcaacttcgcggcggacctcgtcctggaattcctcgaagctgtcctcgaactccttgcccatggcagccatctcctcatgcagctggcgctgctccggcgagagaagcgcccagtggacgtcgtcggggcagggggatggctccctcttccacgccaggatgaagtcgacctccgcctgcggcaagggctccttcacaagtggcttctcgctgtcttcacctgctgcagtaccactggaggccgccattgccgcatcggcaaacgttgctgcaaccgccgccttcgcagccgcgcctcctccccctcggtctccatgtgcttgatgcccatgccctgctgcttcaacgccaccgccatcggaatctgattcgccttgccggagatgtggaggacgtacgaatgagcaagatgaggcggcggcggccgatttataggggacgcaaatcctagtaggaatcgaactcggtctcgggatggctgttttttagtcggagtcggaatcgagtccggctcgatcggcctctctccgtaattgggccaggcctatcctcccgcggaatttaacccgtgggaataagttcatccgaggtcccttaacttgtcaaggaatctgattttcatgcttcaaccgtgagttcctcaattatcaaaaccagtgcaatataggtcccatgatagtttggactcggtcttcatctgacgtggcataagatgtaaaatttaacacttttaaaattataaaacaaaatatatgagttggtcaaataataaaattaataagacaaattttgctacaggacatcgtgaagcctacggacaccgcacgaagtgacttttggggaagacactctcaaaatatatggatatttgctggtggaaaccgcacgcattaaattaataatttccaggtggaaaggagagagaaatcgcgtgaaatatcgaaagtgcccttggacccacatgtcagctctgctattccccactctctcaggcggcagcaacatggaacggcgacggcgatgaggaacccgcggaccggcggcggcggcggcggcatgaggctcgggtgtcgctgcggcatccccgcacgcgttcctccttgctacggcctccactcgggtgacacggcgagcatccccgcgcgcgttcctcctcgtcgccgtcacaagcgaaggtggcgctgtggcgttccacaccttgctactgggatcccacactaggcgctggatcacgccggcctcactcaacacaggcgggagaagggggcggtggcagcggtgaagacgtgggtaatctcgtcgggcatattatttattaaaaaatgtgagacccacctgtcatactctcttcccctcttcctctctctcttctctctctcgcgggtctcgcggcggcaggtgttcggtgccgcgagacacggagcgggcggctgcggtgaactccagctgaggcggcggcggctacggctgcgtttgcactaatggataatctcgttactgataggcgatgatggcggagtcgcgtgcggcacggtcctgcgcgcgcggcagcctcgcgacggctgcggctgcatctgcgctgatggacagccttgtaactgatacttcctccattccaaaatataaggcataaccaccataacccaaagaccaagaaaataattattatcatcttatagtttggatcatcctaataaatacaatgcatgcatccaatagaattagagaacatgagagtggaggatttaaaaaagtaataatttaatggagaaggggtcatagttaatcgtctacatgcatgcatgccttatattatggaacatctaaagaagtggttgtgccttatattatggaatggaggaagtattaccgtttgtttttaaaaacaaaaataaaaggcgcctgatttgtcgataatgattacaaccaggcgcccgacgcgggggga

SEQ ID NO: 59166 - DNA, 10327 bp, Oryza sativa
ttagatgccgaatttctattttttttccttaattgtatatctatatggatcccatactctacttctaatattccttatttttaattccgaatttctattatttcctaattttatttctatatggaccgtatactctatttctaatattccttatttttaattccgaatttcaattatttcctaattgtatttctatatggactctagtctcctcttctaatattccttatttttttaatttcgaatttcaacaatttctgaattgtatttctatatggactctagtctcctctaatattctttattttttaattccaaatttcagctatttctaaattgtatttctatatggactctgccttttctttttctctaattaatgtgagaatttctaggtcatgagagcgaacatggaggttcctttttttttccgaattttagttagttttaaattcctatatagactctatactctacttctaatattccttattttttaatttcgaatttctatttttttcttaattgtatttctatatggactctatactctacttctagtattccttatttttaattccgaatttctattatttcctaattgtatttctatctagactctttactctacttataatattccttatttttaattccgaatttcagttatttcctaattttatttctatatggactctggtctcttcttctaatattccttatttttaattccgaatttcagctatttctaaattgtgtttctatatggactctgtattttctttttctccgattaatgtgagaatttctaggccatgatagcgaacgtggaggctcttttttctattcctttaattatataatagattctacaatatcccaacaaaaattacaaattcaaatatgaaataatattttatcgaaggacaacatccctaccctttcatatgatgtgaatcaacataaaagtatgaaacaattcaataacgcatgttaccgcatcatacatagtttttcaaacatttacagctaattagatatagaattaattcaagcatgattagtccaagtcacgacatagaaaatttggtgcctttagttcaaggaaagatccaatcactctatgaattttttgaaatttgctcgagtaatcaagcaagcctaatagtccttatgtcccaaaataagaccaatacagaacatgaaaagactaaaatacccttactacatcaaatcctaatgcaattatgcctctatttttatctatccccaacatatttatcctctagttcaccaacttcgatgtaatgattactaaaattaaacttatttggaaacaaaccggatggcccaaaataaagttattatagaacagagggagtaatcttttacgtaagtcctctaaaatatgttctatgttccaatctttttttttgagaattacacagtacaacacagatactcacaacgcaaacacactcacctctatgaacgcacgcacgcacgcaaaccctacccatatgagcatcttcgaagactaggccggtaaatccttgagattgacgaagtcatcataggcgcttcgctgtcgacgagtacgtctcctactactaaaagcacaactccgttaaatcctggaaaattcgctcgcttctaaataattatctaaacaatgttgttgagcattatttaaaaaaaatcatactttttaataatggcataaataattcggttgattttctacccttataaacgcaggtaaaatacatgcccgagtatttatacgggttacctttatagttaattttaaaaagtaactatcattacagacacatgattatatattataggatttttacataaaactgtgtatttccttaagaaaacgtacaatctaaaatccgtttattccggaagtggcctaaacatatcaggtgcccacctggaagccaccgacgtgacataagtataggaggcagcggcactttccgtcttccctttaccttgcaccttaagtaccagccagatcgaactccaatgcttgatccatgatatggtaaaggcaagcacaccaccactaacacatgacatgatacggattagcttgcaagctacccatcgcgcacgttgcccagacacgacggattcgttctatccaccacactccaaaaccccagacacggaccgagaactcaaaggccaacccaatccaaaccaaccgcggtgcccccactccacccccgcacactgaacacggtacagctgttgccgcaacacgcacggacgctcggtcatgctcaccatcaaattttgccggaagatgcgaaaccaccgagccgacgccgagccctttccgcttaaaagcggcctcgtccttccgccccgaaacaatccgcggtcacatgcaccgcccaactccccaccccacatgccccgcgcccgcgcccgcccgcgcatcgccacggacgcgcaaagcggccgcatgcgcaagcctcacctcgccggcaggtacgccgcgaatgcgcttcgaatcctttagccccattttgattcaaaggaaatttacaggaattttaaaggatttcattcttataggatttttctatatatccctttgaatcaaaggaataaatcccatataatcctatgaaattcttatagaatgcctctttctatgtaagaatcctttgtgtttttcatgcggctcaatcaaacggtcattcctatgtttttcctgtgttttgtatttccctgttttacacttatatttctgtcaaaatcctatgtttttcttattactttggttttttttcattcctactattcaaaaggcacccttagtgtgcatcatggccacgtcgccgtcgtcggttagtagtactacgtaccatcaacactactactatctcgcaatgataaaaagggagggcgggtgtgcgagggggtggagcccatgtcatgcaggggccgtggggagctggggcaacgaacattacttgtcacgggctccagttgacaaaaggcaaacggatcctgctgcccgatcgtgtttttggcgaaaaggagccatgggggccatctcgtccgttttgcgcgctgctcgctcgtcggctcgttcaagagatgaaacctgtctatctatctatcggccatcgcaagcaaagcctctccacttgcaaaaggaactggttagtaggacactgtcatcatcgggaaaatgaccttaaaaagcatgagcctcacgttgctgcactgatgttgacggcactgttgagtcgacaaacaggagagcatagcaagcagaggctgatcagcatttgggaagtaataagatgttactagcagtaaacatcaaggaaaacgttgacatctcccttcgtccaaaggagaccacggagtttgatcgatttcacacgcaaatctgacaggggaacactggtaaattacagaagcatagaatgttttgctactatcgtacggtgggcgcgagcaggcagaaaatcgcagagcaagacagcaacaaggccagtatgagttcactgggcagcaggatcatcatccacgcagcattcagtcacctgcacacagaccagatgacgttttcagtaagaaatcttcagacattgcaggatacagacataaacacgcacgaagtaattggggggagatcaagtagtcgtaccattagttgatcgagaactggccgccgagaagtcagaggatgccattggtatggagatcgacagttgggtgcctgagaatgacgaaagattagcattctcatcagcgaggtctgaccatgaatcccttccctttggccactcatcaaagaagggacgcagcgtctggttctcttgcttcacagaatcgacagccgcatagtcgttcccaaagaacgaaagtggctgcctctgaacctttgaaagtgagctgggggtgttctgaccaaggtcacttagtgcccccagctgagaatagcttgaaaggggaaatggcgagttctgagatggcagcagccgccatggattttcaatagatgtgttgatagcttcagtaatgagttgactctgctcatccgccaaagatcttgtgccataagcagtatacctgaatttgagaagatacagtgattgggaattagtaggaaacacgaatgcaagtgctaggcatgtacctatcgaaaatatgtcaattctaactttttagaacagaattaggaagaaaatattcataagggctcaattgtaagaatgaaataaatccatgtaccggaggaaatgtagttaacctaagtccgacagataaactagaaagaatccaaagcattattatcatacaaaaaaaataaaattaccttttccaaaagttagtattcttgtcatgaattcatataagaaaacatagaaccatggtttaactaatcatatatagcagcagatcatggcccaagaaacattctattttgcagtaaaaccagaagacagtttagttgcagcagcaagtcagctgaaccctaaacagttgatgacaagagcagaaagaaaaaaacaatcaaagactaaggtgaccgaataattcaataactaaactaaaccaaatcaacacgaacaagcactgtagagttatacatttggtgaagtaaataatgaggctaggtactaaggtcagactgagattcaccgaagataaatcaaagagttcctttttttttgtagggaagataaatcaaagagttgcattgttaaaatctaatcatcaacattggatgagtatagagttgacttggagcatcatgcagctcacgctggccactggaaaatgtttcaggtatagtggtgatcggtgagacatcttcagagacagtattttgcaagggccaaataattgactgcccctgaagagcagagacagaaacaactggattctgtggaggaataaagaagtggagtaaatgccaagggaagccatgatcagctaccagcaggcacaagcactgcgagggcagacacaaatatgtagtagtatcatctttatggacagtacatgtttcaaactactgggccaaagccatgttaagaccctgcaccccagtttcacctgagcagaaatctcttatggagactgtccccggcttctggggctgaaaactgataccagaaagtatgggaagggcaaagaggcagcactctggaaacctaaacataacacaaatttttgcagtgcagagagtaaagtttcagactttcagtgattgcagcaccaaatcgaagtagtactactgagcatggacagctgattcgattgccaccaatgcaaacaaatgggacacagttattaaccgatcacaatgaaaaatacagattcataactgcatccacctgacaccaatcagttagagcatggcaccttttttttagacaacggaaggatacatatcatgattcaagacagtgctaaacaagtaaatatggcgtttgattaaaaaaaaagaaatgaacaatcacctgagatctttgcctgttccaccaccaacagctgcataaggggcagcattatccatgtgcagctgagaacccaacgccgagccaaatgagctgggcatgttcctccccccgcccccgccattgctgccggcaatagcagggtaaagagagtggttttggaagctgctgccattggaggcagcagcaaggggcgccgccgcagaaccgacaacagatgagggcggttgggactgggcgaccagctgcgtttccacaggctttcttgaacggttgcggccgcggtgcatgtggcgctcgcagtacttggaatccggcgcggcctccttcgagcaccgccatttcttgccgtccgtacgccggcaccgccctggctctgggtccagcttcttgccgaagtacggaccatatccaactgtacaaaaacaggcacatcgtagcaaccgtgttacacacaagaatgcatttgttggtaatgcattttgagttcctaatagaatggcatttgaatatttgagaagtccatatccgatccatatgcagggcatagttatctgttcttagcaatcgctcaaaaatggcgagcaaaaaaacagtttgccagggtgttggttcacagagaaaatggcttatcccatgggcatactgataaacaaaagattttatttcagacaagagcgtgtgcacgtcctctatcagatcaaacagagacagaatgatgggcaaacttccccccccccccccccaaaaaaaaaaaatgatgcgctaatcgtgaagcgagcacgagttttggatttaaaaacaagcctttttattaccaaatccggaggatagcataaaaacacacacgcatgtttcttgaatcgcgtaacccggattaacaaatgacccggagccaattaacaaatggaagcaaagtacgcctgatcggaataaacaaagaagccgacactaaacaagcatccaaaagcaatgcagcgatggtagaggagaggcaagaaataggaacacgacgtacgggcgggatggttgtagaagcgggcggcgagggagtcgagtccgcggcggatggggagcacgagatccggcgggacgggcacgcctgccaccaggtacttgtatatgagcgcctgctgctccagctcctcgtactgcgccgcggtgaacggcggcagcctcgccgccgccgccggcggccacctcgcggtcatcggcgcgtcctcccccatcgcgacgccaccaccgcccctgcacccacccacccacacacaacgtctcaccgtgttgtcacatgcaccactggagccaagaaaatgggttgtagccgcgggttcgcgttgcttacgcggagagcggggtggagcggcagaaggggaggagggaggcggtcgcggctgccggggacgagcggtggtcggccaccgccggagacagggaggcatacggcatcgccatcccttccctctctctctctcaatctctctctcgctctcgctcgctcgcaacgcaagcacacgccgcggtctttagtaatggtgctttgcttcgctcgctcgcgcgcgcgcctttattgcgcggcttgtctctctctctctctctctctctctctctcccgctgcgcctgcgagctctcgaccaggggcgaggagtcgcggacgtcgagcccgacacgagaaggcgcgctccgacccgagctagacgacaaacacctgcctccccccgggcctgtcgacctagcggacgtagcggcgtggtacgagcagtagcatttccattttctcctctctctctctctctctctctctcgttatctcgtggcgtagtacgtacagcaccgatttttcttcgagtacagtgcgaggctgcgtttgtgtttggtttgctgtatttttatttggaaaatgggggaatggatggatagatggatatacatgcagagacgctgtagtgggcagcgcgagtagtgacaagtattgcgtggggggagagaggatgggggaggggggtggaggggactgtcgatttgggctgttccattgttgcggttcccaacgccggagcaataaaaaggcgatgagaggatgacggagcaaccgtcgcagttgcttttcgacctgccatttttttgctactgttagtctgctgctccaacatcttcttgcgtctacatagagcgtgtgcatcggacatcttgaaggaaaataaaaagagttttgaattcagggtgtgtttagttcacgctaaaattagaagtttggttgaaattgaaagatgtgatggaaaagttaaaagtttatatgtaggaaagttttaatgtgataaaaaagctgtaagtttgaaggaaaagtttgaaactaaacttagcctcggtactactccatagagatcgaagacatgcaaccgtaggtcaatgaaataaatatatgctcatgcactgttgccatcgataatttagttgtatgcatagaaattacattttatccatggcaattttggaacaaagtatttttaactaaaattttataggatcgaaattctataggatttttttttctgttgagtcctttcctccactttttagagaattcaaacctaacctcaaacctcatgatttaatttcctttgaagggcttatttggtttataggattttcaaattataagaataaaaattgcaaggagttaggtggtcacatgcactctagttcttataatttttttcaagtatgtcttacctcgtactaaaaatcctacaaaataagaaacttagaatgctaaaaaaagtgcttaaccatctcaagtgcttgtatatacgtatacagactcaatttatatgtatagatttaatagtattgtatgtcaaacgatgcagtcaagattacaagatataatttggaaattctgattttgggttatacgatgaacaatataaaacgggagagcagtagtaatagtagtttgtttcagtttgcttgccatgaggcaattaatcactaccaggtttcgagttcacaataatggtgtggtacttctctgttttattcgacgttggaatacctcaaaacagtgtactaatatactattactacctctgtcccatattacttgtcttcttgagtttttgtttataatttttgatcattcgtcttatttaaaaaattttggaattattaattattttgtttgtcaattgctttattatcaaaatactttccatatgacttatctttttttatatttgcactaatttttcaaataaaacgaatggaaacgtccactatactaggacggagggagtactattactactacagtaccacaagatcagtaacatgtggagctggattgacgtactataatgcagatgcagattttttattaatattatttggtgtgggttatctgggttttagttcttccagtaacattttccaaagactaatcggataaactgcggttgataaatcgtaaaaaataaattgcaaataaaaaaattatatctataatactagtggtttgaaaaccggctgcaagaaaaactacgatgaaaagaaaacttagaataaacactttaagttctaaaacttaaattaggccttgcgtagtttccaattttttttctcaaaaacattacatcgaatctttggacacatgcatggagcactaaatatagataaaatgaaaaactaattgcacagtttgtatgaaaatcgcgagacgaacctttcgaacctaattagtcgatgattagccataagtgctacagtaacccacatgtgctaatgtcggatttattaggcttaataaattcgtctcgcggtttccagtcgagttatgaaattagttttttcattcatgtccgaaaaccccttccgacatccagtcaaacgtctgatgtgacacccaaaattttctttttcgcgaactaaacaaggccttataagccaataagtaaattgttagacctatgttcaacgaattgactagtttattagtggtcgaactgtatggagactcatgtccattaatgcatttaccattttggtcgatttgttttaccttcaatcaacgtataaactgataaaaaaggcgaggcacctgaatttttttcaaaaatcgggcgctgttccatcaagtagaccggaattgtttcattaaatagattgaaaacgtttcaattgtttaaaaagcttaaactcaaccaaaccacctcatggaacattttacttcaaagtatgaaacaaacggtttccaaaaaatcaggtgttgttttaccatatataaaataatgtttcagcaaatagcaaaaggatattttaattcactgcaacatttgatctatacatagtgaaacatcacgagtacacttgatgaaatattgttggtgaaacaaaagttgaaatgatccccttaatagagcgtttccataatacgtgggtgatttgttgcaacgacgcatgtggtggggcgtgtggtggggatggcgcggaggtgcaggaagcagcgggtgcccgatttttctggcgttgatcgggagcccgattactagcattttcctagaaaaggcagcggatagttctcttgcccctaaagtaaccaatataaatgtaacctagtataggtgtgacgtactgacctatcctaagaatatgaatctggacatcctagaatatatcacatatgtattaggttgcagttatattaggacgaagggaataataggaatatcctagggtatgtctgatttcgtactctatcgaaatattggtagtgccaaaatttaggtaagttttggcagtggcactgccaactctttcgttgggtaaa

SEQ ID NO: 59167 - DNA, 544 bp, Oryza sativa
ttataaatgtctatatacacgctctagaacaattggattttatttagttgaattttgccaggtgacattcgtcttgtctctagtcctcacttgattagtcaacactatagactcaaagctccaaataattggtgtgttgatttgccgggtcgattggatctaccacttcaatcgcagctatttctttgtgcttaattacctattcgcaatatctaattgcatttatcatgttcttgcagtgttctctcctttgcattgcagggatcatcaactgcgtgtcacaattggtacgacatcgttttatggtgtagcgattgcatgacatcctgaacttgctctggttgatagctacgtcgcatttgattgaagtgagagttatcccctcaccagaagatcaggctatgagagagagcttcatcaaggagttactacatgtggtatgggaagtctgatgcaagtgcaatgtgtgagccttctgcaacgtggtagcatccctacctaccataatagcaaagatcaaagaaaaagagccagtgacttcgat

SEQ ID NO: 59168 - DNA, 2127 bp, Oryza sativa
ggaccacggccaacaatgcattggtgacgggctcctgatacctcgcaagtatcacctaatacgtggtaagaatcgcttgatacttgacaggtataacctgatactttgcaagtatcacctgatacgtggtaggaatcgcctgataccttctaggtatcacatgatatctcgcaaatatcgcctgatactggttaggtatcaggacatgatacctcagaggtatcaggacctgataactaattggtatcattctgtcctaacgggattccgttgaatagcagccccgtttttaagaaatcatgaatcctacaaacttagcgaatataaacatgatataatctatgatatgtaagtggaaaagaacgaagaaatttgaataattttttttctcataaaagaatgaatttgaatagggttgacatcatgtcatcactcttaatgtctttttcccctatgatgcaagtttcacctattcgtgaattatcaagacataacaatgcgatatactaatcttcaggtcatgataatatattatttgactcacgaatggtgccaactccatggacggcataatgtatgaactagccagctaggtatatttagtttggcacacagtttcaaacccagccgcaacaaattctttcgttatcttctccatgcaacaaagaacaaaacagaaggaatcagctaacttaaaatacaatcaagcatggaggagaaaacgtgtgtcgccatcatctgacggtcgcaggttagcgatggaaatatggaattatctgaaaccttttcttcctgagccagaattctgtacgcaagtaataaaaaacttcaggcgattagcccccaaccaatgctctctcgcacttagctgatggaccacataagcattagcatatcaaagaaaagtgtttatctgtcccagaatggcaagagaacaaaaaaactgaaggaacttggcaacaaaaaggggcaaaatgcatccggtgagctttacagaactttatgcactgtaggttatagtctgatagagactttggtttaatctgtagagataacgtgctgcaaatacaagttaaaatactcttatacgaaaaatacaagctaaaatacagtctttctaaaagttctagcagaaattggtaagaaatagtcatgacttgttaagacaataataataaaatagttgaagaaattagataagagatagttgtaattagctgagatgaataaaataagtagaggaatggttatactgcggtacaaattttcaatctaaaaacagtttggagaaatgcttatattgcaaaggctgcaattatcgaaacgaggaggttgcttctgcaaacgtaacctgaaaaaaaaaatctcatattctcatttgttacgcacctaatcccgccaaataagtttgatgagaagattcagctcggtgaaatttcgctaattgcggaaacaaatcgccctgctggtcgttgcatctaatcgactgaccacaaccgtggaaagcaaccggattagttgcgaaatcaatgaatggtttgattcgtcaggcttttggactcccactgaggaaaaaaaaaggtcagtgcatgtactagaaaacaacgcatgcttttgctgcagtattcttcagcacatgtacatgttgaattcgttggaagctaaaccaccccacaagctattggttttcgggaggaaatttcttcagggtacgagcttgattagcagagctgaatcgtatacaccacgtcttggcatgctcttggacttccatgttaacataattcaatgttgccatgttggcataatttcaattaccacttttacctgaataatctcgtctgttactaggctagcagattcctgagcagagtattagctggtgtgttgttcgttaattgggtggtatgaaaatttttaattgtttcgacgtcgcatcatgctgatagacagttgttatacaaacagcgatactacggcttggttcagttcccaacttttttttaaacttttaatttttaatcacataaaaacttttctaacacaaactttcaacttttttgtacattattttaattttagcgaacgaaacacacccctacagctcgtggaacaaatcgggtgatc

SEQ ID NO: 59169 - DNA, 530 bp, Oryza sativa
tatacgatgataaattaggtcagttgattcagcaagaagaacagcataaaatatcaagtgatgtccttcttaatagtagttacagttccaaatttctgcatcatgcatgcatgcatgtagtagtatgatacggccaggtctaccaacacctgataacgttagattcttcaagggacaaaagatgtcgaacttgacgaaaggatgattccacgatcagtgtaggcctaccatgcgtccatgcatggcatggcacagaaacaaaatgaactcttgtgtaatgcgaaaaacatgtcgccgctgttgcttgtcggtgagctagttgagctgatcgctctcgccttacatcttttcggctcccgggagctggttccttttggcgagagcatgattgctggaacggaggcacgatcgggagcaagcaacccggaaaagaaaagggaaaagggggacaagatgcatcaccaagcaagcaagttttccccctgtggacttaaaaactgcaaaatgaaatggggtgtgatgccaagtga

SEQ ID NO: 59170 - DNA, 602 bp, Oryza sativa
tacggtcctacctcacaaaccagagcctggccaacaccagcgatcagaacaatattctttcatcagctctttcagagtttcagttcgttatattattatatagcgaacgctggtcaattgacaatttgttgtttagccacacattggctccttgctgttgctgttctcggacggacctgcattctcttttactttcaaccacaacagagtactctgcctacgaactcatgaacattctacagatcagcctgtactgttacgactgtacacaggacttccgcctgccgccattgatagcggtaacaccgtatcaatgcaagtagttaatggagagaatatcagcccatgttaaccactagtaagtatatattccagggtaaaacaggtaaaacctgtgatacaaagcagtcacataactgaaaaagcgcacgatagtttgtgctactacaacagtaaaccaggacagaacacatccaacacgatgacgacgaggtcatgggggtttcgacgatagcaatactggcagtacgaattcgaggtgccgcacaacggcgcaccacattcacttcagcagggttttaacgatggatttgacattgagc

SEQ ID NO: 59171 - DNA, 3188 bp, Oryza sativa
  unsure (1)..(3188): unsure at all n locations
ttcctcgccaccaaagaagctgaatatttcccggccgatgacgaggggaaaacaccggggtgggccgggataaaatctcgcctcggcttaaccgaacgcctatacttgcgtgggccggtatcctttccacgccgggattttccatggggattgggccccgatcccagccaggaatggcccaaccgaacaagccctaatggagttcctgagaatcggtacttaattgtcatgggtacaaatctgctgtttttgcataattctgttcgtgaggaggatggttgcctgagccggcattagctctggcctcgcggcaaccgtacagccgcctccttcttcttctcttccttgcggctgctttctgaagaaagattggttcttgatttgctgtcttgtggccattcttgcctttggttttgtagcagtaatggactaattttcttgaaattttgcaccattttttgttcttaagccacgtagacgggtgctagagagaacaattcaaacaataatatctttttgaaggtagttttgttagatttctgtgcgcggcgtggcgccgcgcaaccacttctagtagagataaattacacagccatacgagagcaaactgcttcgtttaggtggaaactagaatgcctaaaaaggtagaaaaccagaaaggcatcccaagtttcccaacaactaataatacaataaagttggggaaaaaagatcaaatcagttctttattaaattaaatgtgattttacacaaaatacactgaacaagtcattgtcactactgctttaaagtccacgcctattcagaagtgataatcctgataccatagtagacggtcaatgagtttcttgtagactttactagtcatttctgactagttaggaattggccatttagtcaatttaatataaaaaggagcatatatggtcacatctaaaagccaaaccaaataacttaggcttaaaaagacaaatcatttagagtactacacagcggcgctgttccgtaatatcaacaggcaatccttttgcagtgaatctaggtgcttgctaattactagtatataagcatagcatgtagaacggccaaaagacgttgcttaaattcaacaaatttaactggttatctttttatggaggcagcaaaacaatctatgggaaacccaccaacttgtccatcgtgcaagaattctaacattagacccaactaaacgttatgctttgcatatcaattgatgtacaatttttcatcagcaaaggtctttgactgaaaattgcaattaaccatgaattgacaccaaaccttagtattgtaagcaactacgcacctccagcaattagaaggaaacatctttcactcagagaaaggtagaatttacctcattcatccggtggtgttcgcacaacagatgagtagtaatgtgcctccaactctttgaggcttcctgctgcttcctgcccaatcctctccagcattctctctgttccttcaacttgttgactaaagatttcaatccgcctatccacattttcagttaaagaagcaagcccagaaaagatagctgttctcttaagctctgacactagtttcaacagagaatcagctgaatgtacctgaaaagcatgatagcatatcgcatctgaaattacacattcaatgggtttgccaaatgatactgattactagaactagcctccaattatattacaaaagcatactttgtacaatggatgattgcaatatgttaatataaaggtagatcggaaaatacataggcaacaaaatgtgattcaaactcattattcattaccatcaccatactgtctatgataaccaaagtaaggccattgcgtgtctgaggtaggttcttctcaatccactattatatactgttggttattcatgatcttgtatgtaatattcctanacaggtaggcgtaattgaaaaaaaacatgtataaaacaagagnacacgctgggctgggagatatgctccagaaacagaatggaagangctctttcttctttctgttgtaatccctaatcaaccttgcttgaatgctattaatttttacatagtataagagcgatccaaagatcaaagagcagccacaatcaggaatctgtcctaatctattcttggtgtgtttgtgtgggctggaggagcagctgggaccatcggatgtgtgatctactgtggcttgttttgttggtgttggatgcattattctgttgcatatctatcttgagttttgatttctgaaggtctatgttgttattacaatagtatatttgctcctcttctgaagttagtccagtgccattgtagtgcacaaaaggtgtttgtttaaatgcctgtaaggatacccgtgtgatcgctggctcatagaatctagtctgcttgtttggttcaagcacctcgttgcttgtctgcatgtccctccaagtggttccagcatgtcttatgtctttgactgcttgcatccatgacactgggcttcattgcttgccatcaagggatagccggattggctctccatggtgggcaaggatttgttcatcaagggatagccggattggctctccatggtgggcaaggatttgttgacggttattggctactttgcttagcaaagcaagattaatttgcctctaccaaacagctgaggtttcactcttgcctaggattgccttctagttataagttccaactggatcagggtgcacctgaaatcaagaaatcaatactataactcctaaatcctaacaaacagctatcaaggatatggcaccaaggattcactgccatggcttaatttgactcctaatacaatggtaataccaaattgagcaagtaattactcagttttcttcttacacaccaattgtctccactactgaggtaggaggaacatctccagttctccatccagccggcacagcaaatgtgatatcaacgcttaaaattaggagtatcgtagctctaagtttgctcatttagacaaatgctatagggcaagatttaaacaccgccgcgaagaaacaaatcatggagcaagtgtgtaccatgcgggagccgcgcatgtccatctggaaggcctcctgcgtgttgcgcaccggcgggtcgttgacctgagacgagcggagcaggaggaggaggagttagggtttggtagtacgacaccaag

SEQ ID NO: 59172 - DNA, 1473 bp, Oryza sativa
cccattagggcttgttcggttgggccattcctggctgggatcggggcccaatccccatggaaaatcccggcgtggaaaggataccggcccacgcaagtataggcgttcggttaagccgaggcgagattttatcccggcccaccccggtgttttcccctcgtcatcggccgggaaatattcagcttctttggtggcgaggaaaaaatcctcttgacgcggcgacacaccgagagggggcgctgcggcggggacggctgcacggcgcggtgcgactccgacgcgacggcgacggcacgctctctcctccggcagttgactcctccggtggccaccttcttcccggtgagttccttcccttcccattagcctcctcttccagtgttagggtttcttgcgctcgtggcctcgtgctactgcggcggtgcacgacggtggcaggcatggcgggggacgccgcagcatcacaccccctcaccatggcgccgttgaagctctaagcgctacagtaaggagaagcaggaggacatggatctgttctttgttcctcacaaggtttcttgatttattcttctttctcccttgatttgttctgagtaatattcctaacttagtctgaagctctgatcatgtccttcctggatctgatcctctgtttgtagtgccgtagtgagaatatgttgattctcctggtagttgagtagttgaaagaccacgttttctgattctcaatgtgagttgttttaaatttgtacataaaggttatgaaaatggtttattcttaaaattagttggcaggtaatagtaatgccacaaaaacatgcagtgcgtaataatattgaggcatcagaagtgaatgctgttcatttttcagaaatagtactagacaaatgttgttcatcagaagtgattccaacaagttgtctgcccataatacaagtagatcaacgagccattccacatgccatattttctgaacaaagtacaaagttcaaattgaagtagtaagaaaaatgagtcatgtgcagctttagttcaggcctgtaaaaagctcttggcagtcggcagaatacaacttacttaaatctgaactattttggtacatggttcaaatggtctaaaaataatttcctaggttggtccatttttagtagatcttttgtagaaccatctaatgaagaaattctggatgtaaatcatgatttttgcagctattgcttgcttaatctgcagactactgatttttgcttctactatagctactattgaattcagttttttgcttgctcaatcttatgtgtcctaatttcattttgatatctgaagcactgctagtattagtctcatatgcatgtccatgtttctagcactgctagctattaggcaaagcacacaatacagcttacaaacaatcacttgtcaaactgaaaacttggtaaaaatgttgccaaggatcaatagttggctggttccagg

SEQ ID NO: 59173 - DNA, 6987 bp, Oryza sativa
acctcgacatacttttttattagaccggagcaaatctcggagaaaaaagaactcaacggacaacgggagcccatatatgcttatcttttcattgaaagaaaatcatacggttatatgccctattcccgcacaatagacacatgtgctctctttgaagtccagcacaatggcgacgtatatgaatagtacgaatggaaggtatcgggtgcttaaatcactagatttcgttgcatacttgctctcttgctgccggacaaatatcacacagctgagcaaggagcaattgccaagacggaaattgttgttgtcagacatcatagagcgatggaaatctagtagctcatgaagagcatattgtccccagcaatgtgtgcacaagtgcacaacacttgggcatgcgcaacgtcggattgtatgtaccggttagacaaaggggttgccacatgccaaccagtattaatgtagcttttttccaataatgagatcagcattttcagtctgtttggtcctttgccattgtttgccttgccaattttgggcagtggcgagatttataatttaccaaaattttgggaaaggcgcttgttttagattattaattgcttccaaatttttattcaatgtctatgccaaacttaattagccaatttggtaatgataaagttttgctagaaatcaatggtagagagagtatacggcaatcccaaatgtatttgatatgatttagtttggctaagatccaaaaaatctcattccgtgtgacatcgtatagttgtcattgtcagtcatttgaccggttatgttctaactttagggtgtgtttagttctttggatataaagtttttgaaatatacggacacacatttgtagtattaaacgcagactaataacaaaacaaattacatattccgcctataaaccgcgtgtagcgcccgttccgtcgtggcgcctagtgggaaaactatctcttaaaaatcctaaatgcgaaaattgtttctttgtttgttgtctagtacccgtgccattccagatctcaaatccccaatccatcatcgaatccaaaccctaatctcaaatctgtcccaaatcaaatcctctcgaaaaagtctgttttgtctccctcgagttcatgggccgatctcttctccccggtccatttccctctcagcccatctctcctctcccctccatccttgcccgcacgtgcgaggcacgtgcgccgctcgggtgctgagcaagagagagggctcgctctctctttctcttctccctccctctctgctctcgctgccgcttcccgccgacgccgcccaaatcgccgcgccgttgcttcccgcgcgcgcgcgcgccgtggtggccgaccggccagtcgccgccgccgtcagtgcctgccgcgcctgagcccgcgcctgccgccctgtagccgcgcccttccaaaccgccccgccgtcatcaccgtcatcatcgacccggtcccgccactccacgcgcatgcttccaaggaatggaggcagagctcctcctccatctgcctcatcgctctctctccctctttcttttcccaaagaggcaaggggcaagccccctttcttccttcttttttcccttttatcttcctccgccggcgtcatgccctctgtcgcagttttggcctcgaccgccgagcgccaactcgctccttgaccaccctaggtcggtttccaaaccgacattgccctcctattaaaccaaggtgccctcccttcctttccctctcccattcgcctcgcaccaccgcgccattgctgtcccctctgtctttctatcgccaaccgccgccgtcgcgtgtgccggaggagccggtgcgcgctacgacgcggaaggggactccgggcactcgtcttcttcctcttccccggcccgaggccggagagatcactcccgtgccgtcggcctctcgtcacagcgccccgcctcgtctcggtagggcatccctccgttctccctcctcgctccatctcttccccttagctttgagtagcagctcgagtaataccccagtagctagttggcgccaccccaagccgcgccgccgctcgcagtaggctcgccgccgtcgccgcccgcgctcggtagtagccgcccgtcgccggccttcctcggcaatgaccagtccaatccgacgctagaaacggattcccggagtcgcgtagatgctctagctcgcccgaatcgatctcccgtcgcgccgtcgccgttttcccattctctcgccgccggttgctgccgccgcaatccgccgccgtcgagcctcctccggcgaatccgagcagttggctcgtctcccctcgtcccgtgcaacctcccggtgcgctcgcccttgcctgcatcgctgtagatcgccccgccgctcgccgccgccgtccgctgtctattccggccgacgtcgtcgtcttcctctcgtcggcccacgtggctgccacgaaggtgccacgtcggcgccacctcggccgcgaccgggtcaagctgaccccggtccgccgctcccctccgcctcgctcgcgcgcgcggtccaccgcgagccatgaggctgcacgtgggcccgctgcatccgcacccaccgcgagccgcacgcgtgcatcgcgccccgctccaaaccctagcgccacatcgcgtgctcctcgctcacggtgagccgagacgccgacaagcgggtccactcgggaccacgcgagttggacccggcccaccggctccctctctcctcccctcccgcgcgtgccttgggccgccttctcgggctggctggcctattcagcttggccgagccgcccctttctctcgggccgcgccctagccgcctgagggaagtttgtttcccctccctctttcattgctaattcaaaaagggtttaaataaatccttttcttttaatccaaaaatccaatgatcttagaaattcaatatcttttcaaccatacatccgtttgactccgttcaacttccaaaattcctcaaacctcgagatctatctaatggcatgcttagaggtcaataatagagctttaatttcgccgtttgttgagtcgtctcgttcgcgtgtagcttcggagcccgaagacccggagtgcgcggttttcgaggatcaagctcaagatctcgagtaaggcaagtcacctttgatcatcttgcacctataatttaaatctaagtatttctttttcgcaaatattgcataaataggattatcacgagtaattcggccacggcttgcgagatagcctgccggcccccaatcctaattgctacaattaccctccttgaattattgaacacttaaacctcctttgtcgaccgttgtgcttcgatgcacgggcctataggcacgcgcatcggaacacctcccctcaaatttaaaatatccaacgatgggtaaaacttgggttttacaaaagacttggaaaacccgacacctgggtcggtgcttgcgaactaaatgaatttccaaaatcgcagatcagggaatataccgggagtacggtttcctgctcttgcacttaaggaccgttttccttggaatttcatctgaacataaggcaagtgcgaccacatgggtggaatgggacgcccctggctgagtaattagctaatcggaggagccatgatgccaagagacatgtggattcaacggggtggtgccgggggaacccccgggcttcgtggcacagtatggtctgggacctaacctgatgtcggtctgggacccctctcgttggcatatggtgaacctgtgtcggctttcgaaatgccttgtcatgaaagcctcaaggtctccagtcgtggccgttctgcacgggctgggtgatccgggttagtaatgtcgtgtgggtaaagtgtaccccctctgcagaggttattaaactattcgaacagccgtgcccacggtcatgggcggacgtgaggtgactcctagcgtagttttgtttgactactgctttgtgaaactgctgttgtggaaagggttcgatgttgggaaaatctgcggctgatgggatcagctagggccgggtggctgtatgaaagccgttggccgggtgccaaccttgaatcaattaaaagactgatacattgcacatactccgaccggacgagacgcactgtcttatccgtgtcgtttgagaagcactcacttagttgtttcaaaaaggagtttaaataaaatcaattgcaaaaacaacagccttttctttgaagcctgcattaaacacttaattcccatggcttgctgagtactcatgtactcacccttgctttatataaataatcccccctagttgctgaagaagatgaagtggatcccgctgacgaggagttcttccaagagcaagtcggctacgatgagttttagggtttcggtttagttcccaagtcgcgcctgtgatgattggtccaagtcttggcttccgttttcccttttgtaatgcagttgtgagctcgggatctgtccgcagcccaacataactgtactcctactctgtaataaagaaacttctgttgctgtgatattctgtcttcctgtgataccagcactgtttcctaggactggtatcgattaacaggttaatttggagcgtcacgggctagttccgttcggggctagttcggggcgtgacaccgcgagacaaatttattaagcctaattaatatgtcattagcaaatatttactgcggcatcacattgttaaatcatggcgtaattaggctcaaaagattcgtctcgcaatttacatgcaaactgtgcaattggttttttcccacatttaatgccccatgcatgtgtccaaacatttgatatgacgtttttgttcaaaattttctaggatctaaacaaagccttagattatatagaaacttgcttccacctcacatattccagctctcctttttcaaacttaaaaattttgttactaactcaatattggtagtaggctagtagcacctgagatcctgggttcgactccccatgggagcgaattttccaggatttaacggcgttgtgctttcagtggtagccgacttacccgtcgacggtgagacgcctgtggtgacttcgtcaatttctctaggatttgccggcccagtcttcgaagatgctcataggggtagggtttgcgtgcgtgtgttcataggggtgagtgcgcgtgcgttgtgagtgtgtgttgtactgtgtaattctaaaatggggctaaaaaaacatatattttcacacacaaacctcagataagcatgagatgggcctagccttacaccgttacaatatgtacgtgcatgcatgaagcatgccatccgcaatataggtccatgaggccacacgccgtggtaatgttgcgttcaatttgcagcccactctgtcgcagttgacataaaggcccagagcctctttttttttttaagccaacaaaacatacatacacattataacagttgctagctagcctatcagaattgagaaatttcatgggtgtagttatatttatggcgccatatttttcatcaaaaaatagtcggcatgtatttacattgtaagtccctaaattacatatgtaattttagtgtatttacaatgtaagtcttaaaatttcatatgtaagtactaaaattacatatgtaaattcgaaaattacatactaattacatatgtaagtggggtgtaaatgaggtgtaactactgtgtaagtggctgaaagaaaattgactgtagcatatggcgtcatatttctagcaactccgaatttcatggtttgagaaattaagtacctcaaggtacataaattttatactaaaaaatttagtacaatgtagtagctaacaaaataaacatattaggatatacattagaaactatagtagctcttgatatcttcttaagaatggtaaaattacccatcaaatttggtagtactattgaaggtttgcatttttcaaagtactgtcagaatttaataagattgcaaacggtcgcacgcgtctacgatcagaacccggtgctaagaaacaaaatgagtatacatatacgaatacaagatcatgcggtggagtagatctagagacatggagtatatagttattaggatcgggagtcattgggagttcatcaaatctgcctcagcccatacacccttgcaggtcccattcatcctgaacaacgagtcccctctgttcctgcaccggcgaatcgcgtgatctccacggtggcaggcgatcggcatctgcagtggctcttgcgaccgttcgccttggaaggcgttcaaatgatgttccagaaggtgaggcttgatgtcagctatcaaaattgctcggttggtgtttccgcggttgtttcaggccatgcaccgaaattcgatcaaacactagcttgcacacatttttgtttttcaaatttgtatcataaaccggcactggacggccagatcacacgtgcatcactctttggcttccgcccttggtgaggtgagttttggagcaagcaagctagaccagtcaaggcttaacattgctctcctaaactacagataaagtttgggtctgaaagccaaaacttggttgaaacatcaacatgtgtaatataactgttcattcaaatctaacaagcttaagcctaaacaaagagggtcgtaatttatctcccgttttattctctttcttcacttctctcttctttatgttgatgtgaattttttagagtctgctgactaaacttattttacccgctctaacaaatccttctcatttaacagttcgggaaacgtgcgcatgaaaaatgaggtagtagaagataaaaaaaagggaagttccaaacacacagtaaagcaagatgtaatattcagcattcagcaattgttaagtcttccgacattttttagatgaaccgttgtgaaaacacaaagtggaacactaagcaaaaaagtggaaatcaactaggaaattttagcttagtcacaactag

SEQ ID NO: 59174 - DNA, 7773 bp, Oryza sativa
  unsure (1)..(7773): unsure at all n locations
tcccttatattataggacggagggagtaacacatagttgctgagattataatcgaagaagagcaaatcttaagtttagatagcaaacgtttacacgtttttcgatatctaggctatccaaaatctttttttttgggacaatacccacggcagtccctcaaatttattccaaggtcaatttattagtcctttagttccattttgttcagacataccctttaggtttgtcatacagttcaatatggttcttagtcccaacaaaagtgccatgtggacataagcccataccctaaatcttatgtaagatatatagtgaaaagtgtctagctttacggttataccacataaaaaacaacaataaattttccatgctttttggcctgatcaaaggaatcgatatgtacataaatttgaatatattatttacatttgatgactaaagaagtaatagattttgagtatatatatgcaagcgaagtgtgtagataattttgtgtggtattagtaaggataaattacacattcagatatagattttgtataagatgatattgttgagatatcgttttaagtgcagggttgaaagactgtattagaccttaagacatgtttttattaaaaaattttactgaacgaaacttttgagnccnaacattcaataagccattaaattttggacaactacttcaatgtattaattaagtcttagagctgattcgaaaatttgtcacttatttagcactatcaaaattagagatggatcatccgaaaaacttaantggggttattcgctccctcttttaattttagagagctccacctgtcatacacacatgtatcttggagtccatgctgcaactgtctacaaatctgtagtccgcagcttttctctgtcctcttttatctccgtgaaatatgtttatagctggcttatagtctggtggtgtacctgctcttattgtgctggtaagctagtaaactaacttttgatgacacggtgaaaattgcagccgaccgtaggcgttactattgatcttgctctaataacccaatgtaataagggggtggggcttatagcccctctctcccaaacaccccctaacacaaccggctgggactcctcacaatttgttcggacgctgtattagagcaagtctaatattaccgtccactactaactccattcatctgtagtcaatctaatagccattttatacagtagttgcttactatattatttatatatggtcccacctgtcatacatacagtgtgtcttagagtccgtgctgcagctggctacagatctatagtccgctgctcttctctcttattatttatctcgttaaaatatgtttatagttcgctaatagactgctattataactgctcttacgttccaaccgttacaggtatcatcaatgcgcattgtgttttttctcacctgcccaagatcgcatcctgcaaagagcaagagcaactgcccaactggcaagagctcagtgtagccagtagtactaccaggtgctcctggaaaaaatgttgaatttgggttcattaattagcgaacagactagccagacaacctgctgccctgctctcaagtttctatatgggcagttaatggcctttcaaaaagcgtactacctctatttcaaaataagtatagtagtaagaattcatatccaacgtttaaccgtccatcttatttaaaaaacttataaaaaatttaaaaattaatcacacataaaatactagtcatatcttataataataataataataataataataataataataataataataataaataattttaaataagagtacacttggttagtttttctcccccggcgccagcttgagtgacaggcacagcggcactgttacaatattgccgcgacagtgccaactcagactgtgtttacgtcaaaattaaaaatttaattaaaaaaactagaatattaggaaatgatctaatatcaaataattaggaggggtgaggctttaaacccaggtcgtctagcccaccaccttgtggagctagccggaagacccctgggcatttctcaaaaaaaaatttaattaaaattaaaagttttaaaaaaagttaaaagtttatatgtgtagaaaagttttgatgcgatagaaaaattgaaagtttaaagaaaaagttagtaactaaacgagcactcacatgacaaaatgcgtagccccggaggacgtttaacgtgcttccaccgtagagatgccgggccacggagacgagcacgacgacgacgtcacgcggaaccgcgagcggcgcgactttttctggccgaatccatgtgggagtcgccgtgacgacgacccgcgccgcgcgagcccttgccagagtcgccgcgccaccgcatcgagtaattcgttttctttctcttggaaacgtgcgtttccctgaacacgaagctggatttgtttttgctccccatgctgtactccggggtgatcacagaatcgcaagaacggacgtcagcacgctggtgcagcgccggactgcatgaagatgaaggactagtaaaaaaacatcaactcccagattattttgggttgaatttgcatgcctgtgttgcccgtgtactcctagtatgttcctaccaggacctcgccggtgtcagctttgacgaggaaacggaaaaagaaaaacaaaaagaaacaggtaggaacagtgcatgcatgcgacccagctggatcgctcggcaccacccagatatcttttgtgcagaggggaggaagggaaaagtaccccacgcacgaaaagaaaaaaaaaatctaagtactgtaccactgtgatgcacagacggccaaaagttttctctcgcagcctccctcgcgccgtttcaccgagcaggcaaggtatcaaaccaatcgacggagcaggccagcaggggccagggggagcagcacagtagcggaagctagcggatcggagcagcagtaacggtgtaggggcacagtagcgaagcgttgcaaccgtgtcgcatgcatgcgccgctgctgcagcgagccgcgcgacggcgaggtcgccgttgacgccgcatgcatctattgctgctcgtcgagttggcaatggcatatggcatcggttggggctttgcaggacaggtggtgcacgtgatggggagggaggaggcatgcttccctatattagcccagctacgggggcgcaggcgctagagtaggatgccaatgtcacgtcacgcccgctagctatagctgcaactgcgtctgcgtctgcgtctgcatgcctacgcttttctctgctccatccatcgtgacactgtgtttcctcagggggagagtagtacctctacctgcaactgctagatgcgtgatgggccgatgcgccgcagagatataaaggagcacttggcttttcttccccctggccaagacgggtcccgtccgtcgatcgatccatttcttacggtccaagctcgttcacatgaagtactagcctggatttattatatttacttaaaaaaaactagcaaaagtgcccgtacgttgcaccggacgattacgaagtgtgtacagtgaaaaaaagcgttgtttggtttagacatttaatatggtaaaaaagaattgtttgtttttaaataaataatatgctttatatttgcggaatatacatgatgtttagtttggatgatttttagcatgggagaaaatggatggacgaacaatgcacatgtagataaaaatagattatttagttggagttagtacatttttttaagaaaaaattcccgtgcgttacaacaggaaagatttagaaaaacaaatgaaatttggaattaaaaataaaagaaatattgaaagatgggtttagagtttacatagaaataaaatttagaaataatagaaattataaattatactggatgagaagtctagaatattctccaaaagagggtagagtacatataggaatacaatttagaaaaagaattgaaattcaaaataaaaaagaatattttttgaaaataaacagtcataaacaattaaaatggtattaatgctatttctgaaaattacaaaaatacttaaaatcaataagagagaaaaaactgatttaagcccgacccaatagagcggccttctgtgcttcgcacgtgcggtcggccccataggttggcccaatagcgcggcgacctaaaacgtcgctcggcccgacgtgggagaagcatggaccgtccgatctgatgaacagtctcgattgatcctaacctagataaatacccgtaaccctaaccttaaccctaaaatctctctctctctctcgatcccctaacacgctctctctctctttctttctcgtaaagcaatggcgccggcggcgactattccaacaggcgatgatggcagcggccttccccaccgagcagcggcgacgaagcttctcggtgacgtgttggcacatcagatccccaccatagcgtcggtcatcggttcagaatctagccccccgagttcgcaacctccattgcagcgaggtggcgagaagcagcacgtgatggcctcatcttgtggtaatatttttgatgttctttgatttcgatttatatttggactgtgattttgtttttaattggattgtgatgatttcaatttttagataatatttaactattcattttattcaattgtgtaaataagcaaaagtataagtcatactaaaaatatctttaatgataaaaccctaacaatcgagccgagtcggtcgagctggcggggcccacgcgagtagataaggatctatctagatccatccagtcgccgcccctcccattctcgcccagccctccaccccttncgccccttcccccagttgcctccttcgttcgccgctctctcagccggccggccggctacttccctccccatccatcccccctctcctagccggccggccgtttccctccggcgagcagaccacttctcctcccactctctctccacttctcccccctctctctgcggcggcggcgggaggggcggcatggaggcggctgtggcccggcgggggcaagaggggcgggccagacctcgcttccgccagatccagcggcatggaggtgcggctgcggttcggtggggcgggagaggcgacgtcgtcgtctctctctctctctctctgttcatggtggggaggtgcggcggcggtggcggcggacgtcggccgccacctcgcctccgccagatccagcggcatggaggctgctgcggtccggcggggcaggagaggcggcggcggcgtctctttctctctctctctctctgttcatggtggggaggtgcggcggtggtggcggcggacgtcggccggacctcgcctccgccagatccggcggcatggaggcggttgcggtctggcggggcgggagaggcggcggcgtcctctctctctctctctgttcatggtggagaggtgcggcggcggtggcggcagacgtcatggaggtagtgggacggacggtgtggaggcaggcggccgggcctcgcctccaccagatccggtggctgcggccgggcggtggcgggaggggcagcgggccggacctcgcctccgccagatccggtggcatggaggcggctgtggtccgacaggggtgggagaggccgcggcatcgtctctctctgtgtgcatggtggcggtggaggttgatgtgttcttggttgaatgttttgttctgtgtgttattgatggaatgtttcatgtgtgttttggatgaatttcgactgggatttttcttgggggcagggggcgaacgaaaaatccctgcatttggttgtgattttgggaattgattcccttgtatccgggatttgatttgattttgtgagtttttttccttgtatccgattctgagagggattggagggatggggattcgggggctgcgggcgaaggcgcaccgcgagggacgaaggtgaccttcgtccgacttgtgacgaccggaaaaatccaaatatttatattagttatagatatactcccacatactagtataacaacttgtaagggggtgtttagattcaggggtgtaaagttttagtgtgtcacatcgaatattatatatggtgtcgcatgaggtgttcgggcaataataaaaaaaactaattacagaatctgtccgtaaactatgagacgaatttattaagcctaagtaatccgtcattaacaaatgtttactgcatcaccacattatcaaatcaaggagcaaatagacttaaaagattcgtctcgcaaattagtcgcaatctgtacaattagttttttaacctatatttaatacttcatacatgtgttccaacgtccgaggtgacatagtgtaaaatttttggcagggatctaaacatgcctttaagttctaacatttaaaatttataccaaaatataacatttttttagcctacaactcttctcaaccaagccattcaccatttaaaattttcacttaaatccttttctcaagcaatcataatctttcccaattcaattccaccaactttcttaatacccttgtccaaactaaaactttttacatctcaggacagagatggtatttcacaaatatattgctaaaaaacttattctagacgccagtaacctagtgtcaacattcatcgccacaacaccaacgatgctagcaacgataacctaatctctctagcaacgataacctaatctctctagcaacaaagatgcagaggggtcagtcctagcacagaggatgtatttataaaatattttttttgaaaagggttaaatgtaatttattttttacaaatatatcctcggtgccaaagaggttggcactgaggactatttgtaagaaaaacattattatccgtttcaagataagtttatttttcatctatcctggacatactaatacaaaactaaaaagactagaatacctccttttatcgaattccaatataactattccttactttatatactatcaatacgtcctagttttcacaaactctaattcaataattactctaataatgattttgaaacaagtgagatgtgctaaaaatgaacttattgcagtacggaggaagtacattttaagccttttttgtttttttacaaataggcccctgacatcagtgtctttagcaccgacccctttcacatcagcaattagctaccatgggagagggtcgcaacgacgtcattagctcttagacatttaaccttgacacaatgatcctatcaccaagaaaaagatttatttctgaattaagtattttcataaatccatttatataagaagtttttaaaaagaccaaaatattttttaaaaaaagttctagaagtaatactattttttatccccatccaaactcccccttaacttgagagtgacatatgccatactgacccatcattcagtaactcggatgagaattgtgttctctataaggatgactaactattaaaaaaaatcactggcttcgccactctcatgttaagggggagtttagatggggctaaaaaaatttagtccctgtcacataagatgtttgacactaattagaagtattaaatgtaaactaatgacaaaacccatttcataaccctggattaattcgcgagacgaatctattgagcctaattaatccatgattagcctatgtgatgctacaatatacgttctctaattatagattaattaggcttaaaaaattatctagtagattagctcttatttatgc

SEQ ID NO: 59175 - DNA, 1368 bp, Oryza sativa
acccactcctattttgtcaaaaagaaaacattggacgacagaagttctgccagatatattataagaaataaagaatgccattgttacaatcaacagagaggaaaaaagacatgtcagagaccagagctctcaaaacagcgcaccatatatatgcatcgccttacataactgcaagatttcttttaaaaaaattgttaagggcccctttgaatcacaggattgagaaaacgtaggaataggaaaaagattttgataggactgtaagtgtaaaacagaggattgcaaatacagaaaaaacacaggaataaccgtttgattgaaccacaggaaaaacacaggaattggataaaagatatagactcaaaggaaagttagcaagaggttgaagctcttactaaatttcctccaaaatctctataggattgtccattccataggaatttcaaaggattagataggattcaatcctttgtttcaaagggcttcataggaaattttcctataggattaaaatcctctaaaattcctatgttttttctccaaatcaaaggggccctaagagattaggccctgttatatagtcttggagtcacaaatccaacgaggtggtcaacaaaaactgagtacgtacctattaagaaggtgcagtgttcatgaccatatattccaccatgcaaattgttgcaactagatttaggattgggagttatcagaatctcgcagcacctggactccatgtatttaactgcattatatcgatccaagttgaacattgaaggtcatttggtttcgccaatatagatgggtggcgcagtaagagaacaatatggaaaggttcatgcgcaaactacaaggagacaagaaaaatttgggcaccgttggtacacacaacgtatatgcgcacaaaatttttgaagtgatgtccatgtttaagttcccaggcaaaaaatagccattgccacaaaccaaagtatgtcatctaatctccatttccatgtatccgcgacttgtctgaccgaaggaaaaatttggagattgagtgaatctagcttaggtcctgtttaagttcccatgcaaaaattttacacccggttatatcgaacgtttagacacatgtatggagtattaaacatagataaacaaaaataactaattacacagtttgcgtgtaaactacaagacgaatttttaagcctagttagtccatgatttgacaatgtggtgctacagtgaacatttgctaaagacagattacttaggcttaataaattcgtctcgcagtttacaggcggaactgtaatttgttttgttattagtctacatttaatacttcaaatgtgtgtccgtatatcggatgtgacacgccaa

SEQ ID NO: 59176 - DNA, 2239 bp, Oryza sativa
ctccgtcgatcatcgatagagcaacgtgtcgacgcctgcagcagcgtcggcggcggtcgacaccctgcctctgccgctaaacccgaacgttagctgcctgaatgctcccctccccttcggcaaccgcacagaggccaacggaaccggactcatggaccttgccgggacgccgttcgccttctccgggaggaacacgctgatggccgtcggctgcagcaagcataaccacctgcgccaccgcgtgccagggcagctcagacgccatcgctagccactcctgcagctcacgacctgagcttagactaggcaatcggtaacaacagcagcgaggaagcaacaagaggcagcagcaagcttgctccaccggataaatgcaaggcgaatgcttcgactcgctcggggagagggctgtctctgcaattgccgcagggctttgagggaatccttacctggatgtcgggtgccaaggtaagcgccttcttttcagacatttgcattgcaccttcagatatatagatactcctacttgtttccggagctggaagaggaagaccatgcatggaaagaacctgcaaactcaatagtattatatataagatgtcaacgagatgtactttcgtagtagaaatctaggaaggctaaacatgaaaaggaatctatttcaggggaatcacatgtaaatcaattttaaggtgtgcagtaaatcctagattttgtttagcttgtgctatatcttatctactacctactacctaggcgaataagcaatggaaaatccaggattcagattaatgctgttctatgctaccagttatgctatgataattcaactgattgcccttcactgtctttacagtggcaacttgtcccagctggactaaaggacctcatgtagttactaaatatctccagttttttcagcataactcttctgaagttttgatctttcatgaaactaatgttaaattatccatgttattactagacatcaattagtaccaacttccgccacaaaacaaggattacccttgcaccttcacacagtactgcaacaacactccaggaggatttcagtgctcttgcccatcgagcatgattgataatggttacaggtcagggacgggatgcactcccttggttttagttccacctccacctagtcctggtacttcctgtatatcctgtttgcaactttgttcaactacatttgtcaaagtcaagtcatttacagataatagggtatatcatacttactaagaacttattaacctagtcctggtgtttactgtacatcatacacagtaagcacttatgatgcacttctacaaataatagtgtcgagtctaagtgatattgcatttctgtttacagtaagcacttctacaaaaaatagtgtcgagtcttgtgatattgtattcctgtttacgcttacacatttgttatgttatttaaacaaagaaaaaaaaactccacaacacttcagagatagaaattattttcaatgcatgacatcaaggctatcagtattaacaacgaggatcaattatatatctattaggcttgtcaaagttgcataaaaaaaggaattgtagtatctagaaataaaattgtcagtgaaattcagctagttctaacgaaaagatcgatgacatgcctatcaacattcaacagacacatcctgtccttatccttattccaagttactggcattattttgattacacttgcgtctagattatcgccagttctgactgtctgcacatatatattctcaaaaagatatctcaattaaaaacagttaggcttagaaatagtactctccacatgattaattaaatagctttgattaggcatgacctacagcatcaggaagctaaaatatgttgattggttcctcttgatgcaggttcccccttgcaacgacaaccccaaggtttgacatatcctccaaatctattaattgtgcatacaatttagcatttgatggcagccttcaggtcgaagttttcttttggcaactatttttctaggacctaaagcatgccacagggcataagtggagatggcatgactaaggggaatggctgccaaacgggtcgaaagaacttccccatcactatggtaactcatcagcttctggagtgctacctttatttttaacctaaaaaaactacagattctgaacaaacagttgaaaaaaacataatatctacataagctattgaatgcaaatcgtttt

SEQ ID NO: 59177 - DNA, 12132 bp, Oryza sativa
aacaagcaacaagccaaagtcaaggaggcctctaccgactaaagtcacatacaaacaaccaatcgtagagaggtagaagcctagaggatgaatccaatgggagataataggttataaacaatggcgaccatgcatatgaataattagaaatggaaggtatcaggacctcaaagcaacggacatcattgcattgccacactcttgttctcgtaactgtgccatctatgctgatcctttgtgtacccaggcatttagctagttaattagaggaggtgtgtcggaagtggccaacaaaatattgggatccataaataggagaaccgttggaagagtgggtgattttcagccccaattgtttttgatgatcctaattcaagattattggggttaaattttagatctctcttgcagatgctcttatctaaagtagtgaaaaaactaaactttttcaccaccagaatgcgccacatcatcgggaaaattatgtccgtcctatgtaccacacattcaatccctaacgttgcatctaaaagagatgtagtcaaaaggtggcttgggcttcgacccaaaatatgaagaggacaagaaaaatcgtactatgcctcgagcttacactatggaccatggccacaggcgacacttccttttcgctctccgattgagttgaggaggaagtgctgacgcagcccttgtcgctccaaatgtgggacgcatgccacgatgctcaccgctcaccgcacatgtcctccgcttccatgtcgaggccgccggtgcctcacatcgtgatctcgtccttctcgtctgcactgcctcctcggagacttagtcgatactttagccataagttcacaccacaggacgaagatgaggaaacattaattggagccccgtgccccctccgcggtcacctaatcctcatcaccggccgccactcccttctctcccgtcagatccgacgacgagttggccgcatcatgccctagctaccacggcagtacggcataagcttgagctcccgatgaacttgctgtgtcgggctgagtccatcagcctgtcctctcaagtttaatcgcgtgaggtgaggattatcttatcagagaaagggggtgaagagacagataatgtgagagggtgagcggtcaaaaagataacaaaagaaagaagctagccagtgagtcgtcatgtagttccgtgtctggctgttaccagcaagagttactgtggttagaaaatagtactacaatgcaacaggtgcgtctcactgagataattgatggcattatcccagtaacaggcatgatgtagtttgatcagcaaggacgctagccaatttaagtgctttctaataatgcattaattaaatacaaaataacactgatttttttactgagagtaaatttttgtaaacttgtaggaaaatatattgttgcagtgcaacaacatgattagaataacagaatataggaaatataaataaagaaagaagggagataagagggggaaaagagagagggtggtgatgtggtctctctgacatgtggagctcacgtgggtcccatgctgactcagccgtcacgtcggataaaactagggttaaaattaccaagggacataaagtgaatggttttgtaagttgagggatgtcttatatcttgttttgtggtaactcaatgacaaattgagggaccttcggtgtacttttttctattctaacctgacaatatatccttttcgatttagaaatgcagcccactctggatgcggcttccctgttcctgtgttatgttcccctccctgtccctgccagatgtcctctctctattggctactgcttttctagtggacccaggccatgcgctcgttttcttttttaacgtaaacgacgttaacatccaggatggctcgtttctgattggtgccgaggttgccgaccaatgttccacgctccaaatggtgagctgtgacatggaagcaacgcagccggagtggccgacgccgccggaggccgcggtgaccaagacagggtgtccagggcggcgctcatcatcttgagcaagtgcggtgacagcacggagagtggcagagatgcacccaccgccgctatggatccatgaagtaaaaaaaaatcctagcgcctaggaaatttcgaagacactcaatcccccaccgaacgcccgaacgccacgacttctccggcgagatcacttgctcatgtgattcttttagtttactagcacatatcatcttaaattcttaagtattaccagaaattgattgcaggaatggtcgaaccatgcctggctacccttgtctccttcatcgtcctctccaacaacgatatcctcctcatcaacaaatcaacaattaatggcctcaacttctgtgtgtcacccgcccgaggtcgggatggatgctatgggaggtcacattcttcaacgttagcttcaactccctcgctggcccgctcccaccggaggtgcccgggatgcagaaggtggagtagctcgatgtcgcgcacaaccacctcttgggcaccgtgctggaggccgtgcggcctccccctgctcaggaacttcacctctcctacaacttcactggtaagcagccgtcctgcacacgcatattgcccatcgatggcaatggtaagcactggaaattgccttgcctacccaattgccccacctagggcacgccgctgcagtgtaagggaattagggaaagaaaacggagattgctgctgtttgcttcaaaaagaaacggagaggttaagccgtttagatgaaaaaaaaaggagcgtaaggccctgggcccgctggaaaagcgatcgccaatagagcgaggacacctggcaggggacagagatagaaacacacagtcagaacaggaagccgcatccgcccactctgtcgcagtttgacatggagatggaggcccagaggccagagccatgcaagagatggcatttaccctgcttcagaagatcgccggcctcctcgccgccatcgccagcctgccgtcgcccgcgcgcgctcgtcgacagctacacgaccggtgccgcggccagcgacagggcgacaggatgcccgtgcgcgccgcgcgccgcggccgacgtcaccgacctggagctggaggcgcgcgatcgacctcgccgcgtacgacgtggtcttcctggcggcggccgcggggaaggttgagggcgccgtacgtggcgcacctgggatgggaaaccacatggcggctggtcgatagtggacgtggagcccgcgcgggccgggttcgacgtgctggccgtgtgccactacccccgacggcgcgacgcgcgcgatgaccaactccatcatcctcgcgcgcaaggcggcggacgatgagccacgacggaagaaaacagtcagtcgataaattgagggggtgttgatcccacctcaaaatttaaacacatgcatgaaatatttaatatagacttaaaaaaatagctaattgcacagattacgactaatttgtgagacgaatcttttaagcctaattgttccatgatttgacaatataatgctacagtaaatatttactaatgacggattaattaggcttaataaattcgtctcgcggtttactaattgattctataattagtttttttattagtgtctgaataccccaatcgataccctatataatacccgatgtagcatgtcaaaattttatatcctaggtctaaacacccccttattagtagagcattttgtataactcgatattgggctatggatgtggactggagcttcaattcaaccagggcgtgcttgactctactgtcacgtgctattcgattgcttcaactctctcttgacttggaaggacgtgtccaagtgataaaacgattggagcatatcaattttgctatttgctcaccaagatgcgtgaattccactttttttttcactctgataaggattcacctcaatgttttttttcaaaaaattttaaatactccattggatgagaggagttttgtaagaaaaggagggtattaattaatgaatgcaaaagtcatacaaaaatcatgtggtacaaaggaacccaaattcataacgttctttgttgctcttaatctataccatatgttgttggatctagcagttacaaattctttccgtaagaggcgacacctaaaatagcaaaacgcatgtagtaaccttttagataatgtgttgatcttaggttatatcggcccaatcatatgaaaaagctcataggagtagggagtgtattcatatgggtaagtttgtgtgcgtgtaggtgagcatctgtgttagtaccgtgtttcttaataaaaagattgcttcctccgtatttaaaatatatgggattgttgaatttatttagtcaaacttttaaaactttgataaatggaaaatatacaaatcatatgggtagatttttcttcataagtatttctacattattatataattatattagatattatcgttatttactaatggaaggatagttgtcaaagttgcagactaacatcagataaaatcaagagtattactttgataaatggaaaatatacaaatcatatgggtagatttttcttcataagtatttctacattattatataattatattagatattatcgttatttactaatgaaaggatagttgtcaaagttgcagactaaaatcagataaaatcaacagtactggaagtaaggtctcattttgacaaggaggtaacaaagggtggttattccagttggtgcacgcctaacttataccaaagtcaggcgtccatgtggacaaaaattgagtccatatatccagcgtgtactcttaggataagaatattgcctgttattagttaaagatgacagcctaagttcatatgtaattgttcagttcaaggaaaaacgtaatcagagtgaagatttatacgacagtagtatactatataggagtatgtacaaagaaacacgaggaaattttatttttagaaattaaaacatcaccaaacagtggtaccgataatatccaacaaaatgcaacatcattatccaaacaaaaagaagaaaaatgctataccaccatcttaaaataaaacaaaaatagcgaaacaaaacgaagtgctctagtctagtctagttctatggactaggaaagtatagatggacacggcgattcccatctccgtgtgctcgttttctccctccttttctcctactattcccatcccagtatcccacccattctctgttccgtacttccgttgcacccatggctcccacgaagcagaggagtcagccgcgcgcggccaggcgcgtcgcggacggcgacggcggcggaggtggaggtccaagaacccaccaagacaccgtgttcgcgccggcgacgacgaaccgagatcttccgcgccatcccggtgcgcgatcgatcgacggcgagcacgacacgtgaatacgtgaccctgccacggggggcgcgcgggcgagacgcctcctccgggaagctgagcgcggcggcgtcgtagccgcgcgcgtcctcggccgccgccccacttgcccccacagccgtcacctgaccccgcgctccgccgccgccgccgcatccggcgccaccactgatccctcgcttgcttcgccgggcgtgactacctcgcactgtacacgtaaaacatcggtagacgacacagcagctagccacgtacgtacgtgagcatccgttcgctagccgggagcaacgcgggagaggaaacggaggtacccgcgccgcggagacgaccccgaccagctcctcctccggcatgacgcggcggcacgaccaacgacggcgcgggcagagcggcgcaccgccgcccaacgtcgcgccacctccacgtccgtcgtcggcaatggcgcgcgtcagcgcagccacgatggccgccgggcccgtctccgccattgaactgctgtgtcccccagtgacaagcactagcacatgaccttgctgaggaaatgataggtgggcgggcgagtccaatttatagtggactttgtcagtgaagccgatgatctatctctatctggtcgggacgggggctcgatcggtgacgcgtggccaacgcgatatggaaaagaaggtagggaaattcgtgcagacacggtggcatccatgagtatggaaaaacatgggcagcgttcccatggaatggaacttccagaagctgctcgtcatttcccagctcggaagtcggggacggatggatttgtcacctcagtgcaattggcagggagtctttcagaagatatgatttttattagtggagcatatggaagcttcctaaatattttgtaggtgtgtcatatattgtctgagctttaataatatatttttggatctttaaatttattcaagatgacatataggtgcaaacctatttcaatccactccgtacaataacgtggcatattattgtgatgtcaaatatgttagtaggacctaaatatcagtcacataaaaaaataaaattcaaaacaagagaggagaaaatgatgttattatttttttaaaataaaactaaaagagagaggagagagagaagtaaaggacagttcttaaattgtttgtacatgactgccatgtaggttccacctatcaccacctgagcaccttcatagtataaccaagtcagccgtccacgtggataaaaattagggagtaatgtactcttatctgaagaactgattttgtaatgatggtcgaaatttatgaaattatccagttcaagaagaatctaaacagaatgaagatgtagacgacacgaggatatatgtacagagaaacacaagtaacttttatttagaaatatattaaaacatcaccaaacagtactaccgataatatcgaacaaaatgcagcagcattatccaagaagaacgaaaagaagaagaaaagaaaaggctacaccaccaacttaaaacaaaataaatactactatgccgaaaaaaaacgaaatgcgagtctaattcaagttctgtggactaggagtacccgggacgacgattcccatctctccagccctttttgtctcgcgcgctattccctcccgttctctgctccgttgcctccatggctcccaccaagcagagtcgtcgccgccgccgcgacggaccgcgatggcggctgcggcggtccgaaggtccacgaacccagaaagcgagcgttcgagatcgacggcggcgagcaggacatgtgatcgacatcgtgaccctgccacgggcgggacacctcctcggggaagttgagcttggcgcggcgcccgcggaagcgtagcgcggcggcgtcgtaggcgcgcgccgcgtcctcggcggtgcggaaggtgcccagccagacgcgcgccgcttcctcgggtccctgatctacgccggccacttgccccacgggcgccgcctaaaccacgtagtacctgcgcactgacaacagcaccgtcaccaccacccacaccgcggccacgcttgcctcgccggtgtgatctcccgctgtaaattaaaacatcgcagcacacaacacaacacaacacatcatcatcatccgttccgggtcgagcagcacaggatggagcaacaaacagaggtaccggagacgacgccgaccatctcctcctcccgcgcaacgtcgacgcgccgcccgccgcccgttcccgccagcggcggcaccaccaacgatggcgcgggcggcggcacgccggcgccgctgcctccacgcccgccgtcggcaatgacgcgcgtcagcgcagccacgatggccgccgtctccgcggcctcgaagagcgccgccattgccggcgaccgcatcgatcgatcaaggcgacgtcgagatcgaacgtgcacttgatcttgctgagggcatgatcgatacgtgggggagggaggcctatttatagtggagtttgtgagtgaggcgtgtgtatgatatggccaacgcgataaggaaaagaagcgtatgggcagcgtttccagttccatgcaatggaaggagaagaacttccagaagttgctcgacttttcccagcttggaaacggacggatcatgtatggcttcctgacctcactgcaattggccgggagtgctttcagaaagtgttttcgtgctgctttttcttattatttcacgacacctacgacatatttttaaattcctctaggtttaccggattattagtactacctccgtcccaaatatagatatttttaggatagtgacttatctcaatttctgcatctatcatcttctattgaccaatcataaccattcttcatttattttttttatttttttcctcaatcaatcataatatttctacaaccatcttttagtactttattaatacacgtgtccaccaaatactggcattttgggatggagaaagtagaatcgagtgacgttggtcaacgccttggtgatgttcgctccaagcagaagaggaaaagtatacaatttttcacgctcatgcttcctaaactggtaaatggtgtgttttttaaaaaaattctatagaaaaattgctttaaaatcatataaattaactatttaaatttataataattaatactcgattattcgtacgctaatggttcacctcgttccatagccttggccactcttaaggctgagtttgattctacgttttctcaatttctactctctcggattctgcacatacatttctcgaactaaatagtatgcttttttgcaaacaatttatatacaaaagttgtttaaaaataatactgctagaattttaagtgttttttttctaatacttaattaattatgtgttaataaatcgatcccttttacatgcatagatgattggaaaccaccacatttgttgaacacagcctaagttgttttttcgagggataggacaggaaaaaaatttcgaggcaattcctaagctaaccattggactctgagctttataattaattttcatgtactaaaaattttacattaaatttgttttctaagaaatcaaaatgaagtggtgataaattcagtagcaacttaactctaatttggtggtatcagggcaatgctcaatttcctactattgattgaaaattagagtttgcactagtgataaataaataaataaataaatatatatatatatatatatatatatatatatatatatatatatatatatatatatatatataattattataccacttaactaatattagttgactaaatctcggcaagacccaccacataccatgtcttatacagaaataacctttgggtatagaagaggttccagataaggaaagataaatagagttctacatgaaaacgacaaatattattcggattgtatccatattggtttccctaattctacttggaaaagggaacacctatgggtataaatacaagacccctaggaggagaggggggacggaacaatagatcaagacacaagatcaacatacaagccaacatgcgccaaaacaagacgccggatatcgaattcagagataagcatggctagtcccctccggtgtctacggatactgtcaggagagacatagcgctttctttaatctcgccggatgcggattcgaggaggaaggctaccctgttgtcgactacgagtcaacacttcagaccgccaagtcgacaacagttagataggctaccccaaatattgtattggtatgattatggtgaataagagcaacgaccggcttcggccaacaggagtagggttattacctgacaattcaggggcccgaacctgtataaaaatcctcgtccccatctcttttattataatctcgcatatatactagtaccaacgatccacatactatgcaaataccggaatcgcgacatcaaacgtcgacatatatatatatttgttactttggtcaaacgattaaatgcatactaagaaagtgtatatctaatgtccaacgagcactacggtacatggatgtatccggagaggactatgtgtaagagggagcgtcccatgtccgatggaagggaaaaaaaaatcaaaagctgctgcagtattagcaccatactaattattagcacatactaccccggttgtttttttttcttcccaagcgactagcaatcaggcgcttacgatattttggagaaatggaaacttctctccttcccacttttcctactaggtatgtagagctctaacatattagtctctctatgtcacgcgtctacacattgcatgcatgcaccaaagcatctctcactatctcttcctaaacacttttttacaaactttaaattattttttctcttaaattattgaatgtatttattatagttaaatatttataaaagatctcgcgtgactatattttggataaaaaatatgtctaaataattaggcattgtttaaccacgtttagaaagttgtttcatcatttgataaaaatatttttatttcactttataaaatactttagagagacgcaacatttaaaaatattgactgcaatatcatgaactactatatgaaacattaatccactatatagcattgagtcccaataatgaaacattcaaaaaaaacatttgaaacatgcaatatatttgtagcactttatattattgagaaacattgttaatcatgtatgaaacattaggttctaactgttgaaacatcataaaatacttgctgaaacatataaataaaatcatttgcaacacttaaaataatacattaagaaaagctaaatttattctttatcagaatataaccatgtgtggttttgtttaattacaataaatttaatggagcaaacggatcttagattacataagtaatttaagagaaaaaatagtttgaaatttatcaaagaggtggttatatatagggacaatatatagacagaagggagagaaggaatactgcacgctatagttgtagcgcttgggggcaacatgcagagagtgcatgcgcagcagtaattataatgaatacaatggcattattatattataaatcgaataataagtagtttaggtgaaaaattattttgagaattggtacaaagttgttttatcacttgggacagaggaagcggtcgtaacatgtattgacgcttgctgtattgggcatgcagatttttttttcttaggttggaggactgaggagaagacttctctgctatacactactgcaattttcaattctttttgacaagaaactagactagaaacacgtagagtgattccctttgagagaaacaaggttatgaactttctagatggataagatatattagaagtttagaacacctcgtcattgtaccacctttctatctagaaacttcgtggcggcactgcagctcatgttcagacggctttcaaatactgcagtataatacaaccctctgaaaagcaatggttgtcgtatatcagaaggatatttataggggtgtttggttcaatacctaaaataatcataaaaatatttggtttattacatggcaacaaaaatattttggcaagactagacaaaaattaactttgccaaaatcttaatatcaaacctaacgacaaactttgctaaaattttgtcacgtcccaaaacgaccctaaaatatatcctctaaatggtgcctagaataattaaaatccgtgtgaaagcctccaacaattaaaatgtgcaaagttaaaagtcaaacaaggcttagagggtttttgtatatttcctaaaagcctaaaatgcgtaaataaattttagtggaattttcagagtacaaataataattattaagaaataaacaaagttgaaaaggttttataaaaaaaaactctaaaaagtcccctttccctccctctccctctcgggccggctcggcccatctccctccccctccctctcctctccccgcggcccatccggcctctccccgtgcgcgcgccgctgacgggcgggcccgcccgccaccctcgctgacgggtggggcccacccgtcatccccttcctccggccgctcccgctgcctcgcccgcgccctagcgccaccgccgccgcgaatcccgccgcccccgtcctccccgtgtgcaatcaataggggggaattattccccgtgattccct

SEQ ID NO: 59178 - DNA, 42488 bp, Oryza sativa
  unsure (1)..(42488): unsure at all n locations
tattgattctcaacttaaaaatgcatatcgaggataatgatatttcaatcagtgataatcatcataaaaacaagtaatcaacacacaagtgaaggttttacttattgttggtttattgctctagaagagacataaacatcgtgagatattggagtgaacaacaaatggaaaaaagattagctgaaacagggccagtatcatttaccatgggatgtccatggacagcattatagtgttatccatgtcaatatcattatggcctaaatttgacttctaatccgcaaaaatttgctcctgatagttctccttgctaagaaattggctatcattgccatccaggatgctgtctcctcagctttctcaactccttttcacacatcaagttcaattgcaacttctacatcctcggctgtcttcccctttagcctcgagcatttcaaaaccaactgaatgtcagcattaacatgcctaattccagcttccttaaccactgcactatcgataatatccaatattgattctgctgggcaagtgaagtaaaacgtgagcacatatttcccccttctgcctgtgataaagttataaggctctttccccttggtaattnttngtanaagnncaaggctttttcaaaaaaccccaaaaaggggggaaaaccccccaaccccaatttggtgaaaaaaaaaaagaggccctttttggggtttttaaaaccccccgggcgaaaaaattttttttttttactcttatccgttaacaggcttgtttcaaagcgctcaggatctaagtgtcctaatgtcccttggcccttgcactagggttgtcagttgttggccaacttgacaccccgttggaggactggtacatttgtagctagatgaagacaagagagtgctgatgcagtttcagttgctatccataaacgatgctcccatgaaatcagtgtcaacttgttattgtgacgggtacgggataccatagaaggtgctggtacttctagttttttggatggagctttcagctttggttcagttttttgaccaagcaacccttcttcttatcctacagcatgtgacgtcaatttatcatctatttcatggagcaaacttgcatagttgcatagagtaccatagaaactgaccgacggcacaggcacagttctgaacgagacgaactactactcattattaaaagggttaagacgacaactggtggactcatgggcctcgagtgcagatggccggcccaatacccatcaatactttccatttaaaaaaaaccaaaagtgcagcagaaaaataaataaaacataaactggacattccctcaaaaaaaaaaaaagacataaactggacatggcataaaaccaccggttggaacgatctgacctctagggtttttgaagatcctcgccgtcgccgccatgtatgggaactccggcgagggccccccgtgaggcggccggacaccttccctgcatcctccaggacgcggttagcagagtctccaccgcccagatcctccactcgtccggctacaccgcggcggagccagccgccctccgcgccctctccgacatcgccgggcgctacgttgcctccctgggccgcgcggcctcggccatcgccgaggcccgcggccgcacggagcccaacctcgcggacctcaccctcgcgctcgaggaccacgcgctcggcgggttccccggcgcgtccgaccccgcccgccccgtcctccgtccggcgcgctctcggagctcgctggcttcgtccgcgtggtgcgggaggtgccgttcccgaagcccgtgccgcggaggggaggggccccacgcggcaaggcgtgggagagcttcgcggcggcggggaaggagcctccgccgaagcacgtgccgcggtggctcccgcgctttcccgacaagccggagccggagcccgaaccaaaggcggcgtacgacgaggcgacggcgaggtgggaggcgcgcgttcgccacgaggaggaggcgaatgcagaagaagcggtggtattgaagccgagcgttgatggcggcggggagcgcaggggagtagtaccggagaagagggggaaagtgagcttccgcgtgcgggcggagaggaagaagcggcgggtgggattggaccagcagtgaggcggtggcttcgaacggttcgcggagaatcgagaaaaatccgcggcaatagtgcgggcggcgagcaaccaccgctcggccgtggccgtggagaatggagatggacgacacgccgcggcgttgcccggtgacccctgtccagtcgaggggttgaagaagacttgacgagttttgggctctgcctgggccacacgtggcgcctataggctactagcccacgagccacctgccgtcgtggctgaactggccgaaaaggtcaagtgtgtgggtgattgtacaagttataattgagttgccacagtttatcacaaattttggctttagtttgttcacgcggtgaatttgtggcgtagagctggtggtttcaaatttcacagtactctgcttgatatactaaaagatcaatttcttgttttttgaggacgtctgagatcaaatccacatgtatccctgaagactccctcggcgattcattcgatcatccctcctgagtcctgccttggattcgtgatttctcgtgggttcctcaccgtgagattcatcattttcatcttcagatcttgacttgtggagacgatgaactgggtaaccgagattcccatccattaaacaagaagaatcccttgttgaaattaaagcaggaactgagacaaagatgcaaggaggaaaggcaacagttcagagtgctttttgacatcaacgggatacagagaaaaactacattgttaacatcaactggtgtaatagttatgatatattacatcgaattgctacacatgcttataaacagaacatacagtcgaagaaactattaattctttggacagtaaataacaggcaaatctgaatataactgaggggattatacatgacatcagagaaactatgaactattgactatgagatgaatgcataagattagctaaatagacatcctaaaatgctgaagttagtactttacaggagacagctatgccaaaagccatttttatagtcaccaacactgttgctctgcaaagaatttcccctccatggagtcattggctcaactactgtgtgagaaccaagaagcactcgtgatgagagcctaaagggtctcaacctccagttagaaatatacaggtgctgttgatctttacatgtcatgtcaccactgctaattagttatcagctgttcccaagttatattgaagtaaccatgccatttgctctttactgactgtagcccaaatgactgaaaagcccgcatcttcgattagctgggaatgtacacgaaacttgcaggtccaaggctagcaaatcaacaccagatacatttaacatcacagttgacgcctatgaaggatctcgcaaggcaggactagccattctaacacggtgagcaacagccaggggcggcctgccaacagcttccagtatcctagtaaaggcaaccttcgcagggacacatgtgacaagtggaattccccctggtttgatcaagccgccaaaaatgccactctgcttatgtgcttttgcttgaccacctactccatgatgcttttttccagggaaatggaagagagggttcggaccttctggcttgacaggcttgcttttttggattgcttcttttgagatttagaggctgacggccccctaacatttgagatgcttttcttatcaaccttaacctgatgatttgaatttgagtactttctaaaatctgaatttgagtactttctaaaatctggtttcatctcccagtctggatatgcaagggtaccttcatcatcacaatccaatgcccctgaggggttagatcggggaattctttgcatggcagtcctcctgcctgtacaccaagcaggttgccctccagttctcccttccaaactaacatcaccacaaaaaaccaggtggtcagtggaaccatcttcaagtatttcaatttgaacaggatgcccaacaattgctttgccattcagtctgctcattaaggaaacaagaggaacatgctctccctggtagctagcctggaccttcaagtcaacatcaaacaacattgggcccctgccacgaagacgtgaactgtacttttggtagaatgagggtccgctccaatatgcattccgatcaaaatgaaatatcttatctgaatccctgtttaggggagaaaccttggaagaatcatttccatagtcgttaaaatagctgtagcttcggctaaaatctcttgtagccttcaaacatgaagaatatgttctaccatggtacaagttaacctctgaatgacctgtgtcctcaaaaaaatctgtttcttcggaatcgtaattgacctcttcgttttggtaaaaattttgccccagcaattgctgattgggaatttgcatactcccttctctgggatttctaccatttattttatacggagatccttccatgaaaccatctgatttgtctaaccagggatttccatctgccatatccgatctcttaggtgcattacggctattacgtttacctttcatatgccattgggagacgcccaactcagaagagccatcctcttctgattcattcacttgacacatataagaagaataggtcagctcatcagcatcagcatcaatattcgcatgcctgaacttgtcagaagctggtaagaaataaggatcatgggcatgtgatgctggatgcagaatcaaatccgaacctgcccaaaagatcaccacagtgatcaaacaagccaaaatcccaaactcaaaataaaacaagagcatagccatgaaaccatagacagaactgatgaaagcttagctagagctaaacagaaacaaaaacaaaggtacacttaagataatttgagggattatctaaatcatttggctatctcctttttcttggaccaggtcacacctcgattccaaatttggcaggattcattgtacatacccaacataagctcagataagtccttattgtcatataagttcagaataatagaatggctgctaatctgtcttataatatactgtacacaactaaaacttcacaacaaagtaagtttggttaaacccaaacggtgttgttttgttgtctcacaacctacatattgtttgagtcattgtcggttcaaaactttttaaaaaaaaagggtccagaaatgtttgggcacctaaaaaacaaatcaagagtgagcatatttgattactttgatgctatactgtaagatataaattgtttgaaccttatgcaacaacaataatatggtaacatttttcgcaatgtgaacccacgtgtgtacaagtaaaaattgaaagaagtattagcatggtgtgaacacatacattgtaaaagttcagcgtcatcttctgtctcactctcagagcattccctctctgaagactcatatatgtgcttctcaagaagatcagaagatgtctgctcctcagaaaaagcaggatgatgaagataactttcagtctcaaaatcacctcctgtagaagccacttgtacggaaggtaaatcactatgactatgagtttcaccagaatcagtaggtaggaatacatatctacttcttttagctcggtaattggcaggtgatcgatccatttctccctgagttaggacatccccatagccatcattgtgctgtgactgatgaggcaattttggactgctgtgcaaaatctgaaccagaggttggcgtctgtcacatttttcaatagattcatcaaaatcacttccatctgatctaatcttttccgcagttgtgattttctccttgctatccaaattttctccggcctgtatatgcctcacatgcgagatgtctcccaagtgattgccaaaaagattatcagaaatgccccgagtaggagaatcttgaaagtttctctttgagccagcatggaggacatattgctcagcttccttttttatatcagaagaagcagttatgcccttccgtttcttactctttttgctcttgtagcgggtacttccaagatctttgttatgtttagagcaaactgcatttcacaaagataattgaggttttatatccaacatactcccttgaagatcatgcaaacaatttagtcaacaatgaaggaagctaaatcaaactttgccaataaatgggcttaccagaaacgttagcaggtctggaaccttgagtctgatgctttgatgcaagcagcttcttctccaattcaagagcatgaagaatagcatcttctctacgtgcatacttctctcttttcttaacagaagtcccttcagtagcctctgccttctcaatacatgcatcaaactccccacacctaaatgctttgacgcgctttgatttttcaatgttgtaccagtcgctatggataagaaaagacaagtacataagtttcagaattcaaaatatacataggcaatcatgtaaccaaacaaacaatataaatgcatagtgtgactattaattcatgagaaaatagtgcaggtaaaatagaatcagaatgatttctaaaaggcaaggcaaacatttcaccaatttacataaagtcaaagttatttcccaaagaaccaccatctgtttggtttccacatagcaaacatgcaaatttctctacagaaccaaaatgctgaacatagcaactgtatagcaacctcaggaataaggaagcaatcttataatcctcctagtttattttcagttcttcaagaccaaacatggtcacactgaataccatgaaaacacatgtttagcttattgttttttttttacaaggaacagtttgcaggttatcagttgcagaaatttcactacacattttatattattatacattacagatataagttctttttcttttttctcagaatttaaacatcgaggcacattaaaaaaaactgacatggagctaaactacaaaaatagaccattttatgcacacagctatacacagattgcctctcgccttcttccgtccaagtttcaaacaactaaattactgaacaggaaaattgcatagcatctcaaatgcactagaggcagcaactaaccaaaaaaattacctagccatcagcaacagaagtagaaacttggaaacagatggaaaataagggaatcagaactcacacactggcatcctcacgggcgagaagcttgaccggcgtgccggaccttggcgacatgatctgcgacggcggcagctcgtcgggccccagaatcctgccgggccaccatgacccgttcctccgccgcacccacacaatggtccccggcgaggtatccccaacgccgcagcaggccacctccccgtctcctcctcccccctccgagcaccccgccatccctcccccggccaccaaaccaagccctaaccgccgcctcgcctcgcctcgccttgcctcaccccgcttctagaagcttccctccctctcgagatctaccctccattcaaatcacggagggcgcctgcatctagaagccctctcctccgcgctcgctagatcgccctgcccctcgcgctcgctcagcgccccccccccccggcagcttctagaagcttctcagcgaggatcccaaggagagccgccgccgccgcctcctcaccccccttccccctccttctcctcctcctcctccacctccgcgaggcagggcccctccggcggcgccgctggttcgctgccgccgaggcggtcgccggaatatttttttccctcctctttctacgacagaaaagggtgggaaattaaagggcaaataaaaggattattttcttttttcctttcgggtagtagttttgttcttggttcccggtggtccgttctgcaagagagagagagagagagagagagaggcaacggaacggaaggtaaccgacgagtcgaaccaccgaagcccggaaggaggaggactgcgtggcgtaaaacatgagccggaatcgaatccaaggggcgcggacggcgcacgttacgggagcgcgggggggagtccatggcttccatgtgacggagtcgcgtctcgcctgcgggttttccgttctcgggcttgattggcacatgtacgcgaacaccgtgcggctgtacgcctgtacgtaagcacgcttaacgggtgtgagttttgagggacatatagctacataccacttttaagacgtggtaattaattatttatcactcatatagctatatgggctctcatgtgtccatgacatgtaggtccaatgataaataatttattccgagttttgatgatggcatatgggcatgtctaccaaatgttccggaaatatttgaatgtgtgtcaatggattttaatctagcatgtatagtacgttaaatattgtacaattataaaaaaatatttatttgaagttaatattgccaattaaattttaggggtagagtagtagatgtacactgaaattaaattaaacaacaacacacagagtagattctaagtctatcgtagttatagctggatagaaacactgggattgttgttttttaaaaaaatagttacattggatgggcaagggaagaggaaaatggaaaaaatatgatatgtgaaggataagggtaacattgatattgtaagtaaaattggttacgatatggttttacataacatcaacaatcagattcccataaaaatatgttagagacaatagataaaaagccacatgttgtttcggaagaaaaaaaagataaaaagcgacatgtatttttttatgtagggaaagatgtctgtcaactatcatggatcctaatacctagtgtgccttatgagttatggtggtcattacactctaaaaatctaaggataaatggggatcaagaaggtgcaatcgcgaacgatgatgtactcaagtagctacaccactttcgcactgcaaactcaacttgagcgttatggttgtagaatgaacacaaagttgtcccgcttaatggaatttagaatgctgatagattggtcatcgttggagctctaatccagaagctgcaataattcttagttatgcaaattggcgatggaaaaataacattattttgccatgatatatggttaactgcatctttattggcggaacactaccttgcactatacttgcatgcaacatctaaacacatcatagcaggtacgtccatgagacaatgactttgctcatctataatctccatgttatcatctatggcaattgactaatagtcgtaggctcttagctctaactagaaattgtagatgtgcgcatgagtcgtaacaaaggatgatgatgagacacaatgtgccacatgatgctcccatccctctaaatttatttactacaaatgtagggtgacaatagaggagtgacctaactagttagcgatttatatgggataataaggcggcgccaaaaataaccttcttgtatggttaatgtcaaaggagcatctccctatacaataaatctatctattccacaacaaaaatgacaaatacaaacaagttggatggtaaataagagtcttagcatgagataaatcttatctctactcaattcaggtttgtccaataaaatgaatttatctattcttaaaaaaaatgacaaatgcaaacaagtcagatggcacatagtcatttttcactgtaaaacattttccctgtaaaacaccggcccatgggacgatttaattggaatggcccatataaatggcccataagttgcagaataaattccattaggcccatatggcaaatactcagacgcttggtcgtcgagccagcctgctcccaacttttgggctgcttcctgcacattcctcacatgcgcaagccctaaagcccataaagcccagcgcaagccctaaagccagcaacggctaatttctcccctcctcatcgctgcgcactagccgttgcgacttgcgagttgcgatcgccgccgccgcccacctcccatgtcccatcggccatcgcttcctacaaatacgctcccctgtcgagaccctaaaccccacaaagcaagcatcgcatctctcttcttctccccccctcctcgccgcctctcccctctcgtcgatccgacgcgcttgggggagtcgacgctttctcttctcgcttgctaatcaaagctctcgcataattcccgtctctgtttcgttaatttccgcttgtttcatttaattacatagtcttcttagcgtgttgatttttctgtttgatcctgtgattgatctagtttacttctagtgatctttattgctgctggtattactgctgtttgtttccttgttatttgcgtgcttgtgctcttctgtttctgctaaccatggacgcaggctcccactcgatctcgtcggagaagagccacggactcgcgccgcggccgccgctccaggaggccggctcccgcccgtacatgccatcgctgagcactgcctcgcgcaacccgtcggccaagtgctacgtgagtccttggtttccccccgtccatgcgtgcgtatagactgttcgacgaaatgcctgaccgggtattgtgctgcgcgtgctctgcagggggataggttcataccggacaggtcggcgatggacatggacatggcgcactacctgctcacggagcccaagaaggacaaggagaacgcggcggcgtccccgtccaaggaggtgtaccggaggctgctcgccgagaagctgctcaacaaccggacacggatcctcgccttccggaacaagccaccggagcccgagaacgtctctgccgcggatactgcttctacccaccaggccaagccggccaagcagcggcgctacattccccaggtaacgcacgagctttgatgttccttcctttacattgatgcaacgatgtgggattgtgattactgatgcggctttgaaaccgatgtagtctgccgagaggactctggatgcaccggacctcgtcgacgattactatctcaacctgctggactggggaagcaagaacgtgctgtccattgcgctgggcgacacggtgtacctgtgggacgcctcgagcggatccacatctgagctcgtgaccgtggacgaggacagcggcccgatcaccagcgtcagctgggctcctgacggccagcatgtcgccgttggcctcaactcttccgacatccagctctgggacaccagctccaaccgactggttagtacattgttcggtatcctataatatttcgtgtcctaattcttgcttgatcagtacatgaatcagattgttctttctctgcagcttagaactctgagaggtgtgcacgaatcaagagtcggttcactcgcatggaacaacaacatcctgaccactggcggtatggacggcaacatcgtgaacaatgacgtaagaatcaggaaccatgtcgtgcagacataccaggggcacagccaggaggtgtgcgggctcaagtggtctggttcagggcagcagctggccagtggtggcaacgacaaccttcttcacatttgggatgtgtccatggcatcgtccgtcccatctgcaggccgcaaccagtggctgcacaggctcgaggatcacacggccgctgtgaaagcgcttgcatggtgcccattccagagcaacctgcttgcaactggaggtggtggtagcgaccggtgcatcaagttctggaacacacacaccggtgcatgcttgaactctgtcgataccggatcgcaggtgtgcgctcttctatggaacaaaaatgagagagagcttctgagttcacacggattcacgcagaaccagctgacattgtggaagtacccgtcgatggttaagatggctgaactcactggccatacttcccgtgtccttttcatggctcaggtgagtttcttcttgattagtagttttgcagtcactgcctataagttaatctgttatttgctgatcgtcttactgtgattgaactacagagtcctgatggttgcacagtagcatcggctgctgcagatgagaccctgcggttctggaatgtgtttggtagtcctgaagcccccaagcctgcagccaaggcttcccacactgggatgttcaacagcttcaaccatctcagataaggatgaaccaggtgaacaaattcgtctatttgatctggtcctttggacagcttaaaaatgatcgtgctggtatatttctagaactcgtatttattcctcgattgtttaaccatgttgagcctcaggctttggttattgatcttttgctcactgattttccttttgcaatgctcttgcagattgagatggccttggcacaataggctgtgcaagaagagcattgcagtgcttctcatgataatgatccaatcgtttcggttagtgtcattgctccctagttagcacttaacacaaatgcatagtacggtgtaaatgatctttgtttgtttcgtttgctagctttcaaacggaagatcgcaagtgagatttggcttcatcgatatcttcatctttgattggtagatactatcttcgacttcaagttcacaaagagcaccaaaaagaacctggaaatgtgcaaaaccttatcacttatcggggaatgaaatgctgagttggtgacttgagataggaatatatacttctggcaatttagttagttattctgtacattatctaaaaaaaagttagttcttctgtagagcatatgtaaagcacacacatagtatctaaaaaaattgatcttgttttaattgcgccaaaagatcaatttttgaagaatcttttggtggaaacatcaaatgatcggtttgatgtaacaaaacaagaggtgtagttcaaatatttatgtacgttcttcctccgtttcatatcatactattcaaaactagtcgtttgaccttttttagtcaaattttatctagtttgatcaatttttcaatacaaaacaaacatatttgtagtagtagtatttttgttagttcatccagagtacggacacatttgaccaaggttctaacttctcttaacagatagtagcacttgcattttttgttcatctgaagcagtagtagggctgaggtgccgtagtagggtataacaatattggaaatttgattgaaattggaacgatgtgatggaaaagttaaaagttttgatgtgtaagaaagtttttatgtgatgtaaaaattgaaagtttgaaaaaaaattaaaagtttaaagaaaaagttggtaactaatctagaccacagtagaagggaaccatgaggacaaacaaaggaacagtgatttccacccatgtggcccgccaaatcggagcgggcaggattagattttaattccacccctcccttgtcgcgttatgcctctccctcacagactcgcatccggtatccgccttctccgacccgagcgcggtgccaggctagccagttcgccactaccgcacggcgcggcgcggcgtatggtggtaaaaaacaatacgatgacacagtagtggagagcacgagagattccgtgtgcccccgcggccgcgtgcaccagctcaccgtctgacttgctgcttcgccgccacccaacagccagacccgcccggccgggctaattctcggatccccttccgcgccaacgacacgcgcgcgcccggatgcatgtgaccaccgccatcaacgctccgccgcgcggacgcacgtacgttagctcatctgctcttgtggagtggggtttggctacgacgacgacgacggcctcctcggttaatctgctgtgatgctgctccatatgtacgtgtacgcttcacgatcctgtgttcgcttgcggtgatttggtttgaggctaattgccaacgaacgcaggctctggctaactactaacctaggaacatggaatgatgcttgctggactagagatagtactagcatatatatacaggtactggtggttgcggatgttgtctgttggcgtccacacagaacattacaagagatgagggtagtagcttagctaggtgtttgatgagacgatgatcagagctgtggcatctacagttagtaagtgctatttatgtgcacacaagtacactgttccggggagtatggagaaattgagccttcgataattggtgtcacaagctccgatcagaagtgataatttgttcgatggcatcagctccctcgctttaagcatacgattctatctccaaaactgaaacctaagtatgcgattctcttggatggggaagaagtttacttgcttaaaggggggataattaaagtgggaaccggaacaaagacaaacgaaacgtgggctcctcgaatctacatgcaaggaagagagaatcttatgctgaccaaagtaccaaaccatctctctctccctggctagctgtagtagagtagtaccgagtaccgtcacttgaaccacctaacacctaccgccgtttactgtcgcaggcatcggattccagcaggattactttggctatgcatacacaatttcatgtcttatcatcagctattcaccgtgggaattttattccaggttcccaattttggcttacacaccgatcgggccaaacgtgtgcactgatcctcacagcgatggactcgcaaattgcaaccgtgccgtcaccgtcgtcacagtttagacagcggctccatcgaccacaagataatccatccacttacgcaggcacctttctctgacgaccaacacaaattgcgtctcgtctgcatatctgtcgcggcagcgactgccatagtgccatcactcgcgggcgtcacgactccacactttacaaaaccagcacagttatcgcggttattacgtgcgataaacttctcagcttttaaaatcacgatatatctcatggtaaccgtgtagttacagtgatagttgttaaactgtgaggtggtggtaaccccaacccaaaacgatttagagaaaccgacgactcacgccgatgcatgccatgcctgcatgaacggcggcggcgatcgatcgggccggggaggaattgaaggctaagggagaaaaaaaaaaggagtattggaggggtggggcggcggtcacaaccaagttggcgcaaatattcctcccgggcgaggccaaggcaaagccacgcgacatctccccgcgtctctctcgccggccgccggccggccccaccgcatcgccccggctagctagcttagctatggctctcgatctcaccaccaccctttcgctctccgccccccggctgctacttgcctgccgccggaatattcttatattctcccccggcaaaacggaaggctaagtacaaccgcagctcgctgtcgaataaacgaccaaagagcgcatcgcgtattcgcgtgcgaattccatcggcacgaacgcgcgatacgcatggagagatggggttgatcaggccgctgttgctttcatcgatcgaggaaaaaagtaacgggattctctctcgtcctttgggttgagtttttttcacctggcaatgccacggcgcatatgcggttgaattgttcttggcatcatcgggtgtaaccgtgtaacaaccgatcgatggtcgtcgatagagcgcccggccggcgatgctgcggcatcgtgatcattgaccggtgaggtgacacctaatcaccggtagtagtactactattctttatgcaaaatctatacgtactcctcctagtaatgatcagagtatcagaccggacagaccagacagcttctctggccgacgaccgaaacgcagcggcacacatgaacacatggcaggggccgctcttgtcggggcgcgaggcgtccacgtggcgccccctcccacatgcccttcgttgtcctgttcccccccgctcgaaggacgctagtacgtgcacaccgctcgatccgacggcagcggcgccggcggcccgtccacgcggcgcgccgcggttgacccgcgttgcctctcggcacaaggctcccctgagattccggccgcgcgcgcgggcgcgcacacatgagctcatgatgtgaacgtgatgatggtgcgcggtgcggcgcgacacgcgacgcgatatgctttctctctcctcctcttcttttggctccgcctcgcgcgccactctcccgcccaggcgcctctctctctctctctagtttctcgcaccacctgcctacatatcgccacagccgctgtcgtcgtctcgtctctgtgtgtgtgtctccatcagacgccggccatatagctagcgagaccggcacattcccatcgggaatccgcctcgggcttcgccgcaatcccacgctaactcacgccgcaccagattcacgctcccagctacaaactcccagccgcgcgccggccgcacgcgcgtgcgcacagctagcgatcgatcgtgatcgtgaccgcggccgggttgactgccgctcgacgagcgcacacatcgatcagccggccggacgaggagattgtcagatcgtctcggctcgtcgacggattggccatcatgttcgaggggatggagagggcgggctacggcgtcggcgtcggcggcgcgggggcggtgggagccggggtggtgctgtcgcgggaccccaagccgcggctgcggtggacgcccgacctgcacgagcgcttcgtcgaggccgtcaccaagctcggcgggcctgacagtaagtaccaactccatgactccatctccgaacaccttgcaccatgtcagtatatgtcaccatgcccatgcttcgatctttctctgtgctacatgcgtccaaactccaaacacaatcgagctgctggagctgtaggccagcagaatttattagctgtgatgaatggaacagtgaaggaaattaaatcctgttcttgtttgcttgcttgtttaattggagcctttaattgtctaacagcgaaaaagaagcatgtccatgaaccatcatgagagatgccacagtgatccgtatatatgatcatgctgatcatcactcatcatcctcatctcataccattttggggccatgcatagttacatctgcatagtcctgtactgctttgtgacagcaactttatgctttggggttataatttcgttttccatttgactgtgtttggacagaggcaacccccaagtcggtgttgagactgatgggcatgaaaggtctcaccttgtaccacctcaagagccatcttcaggtctgatcatcttttttttactggtttttcttttgctttatttgcttcttttgatctaccacctacgatgctaatatgtgcttcttggcgacatctttttattgatccacagaaatataggcttggaaagcagaacaagaaagatacaggcctagaagccagcagaggaggtacatgcttttgtaaatactaaatacttctcactaagtactagtaacaaagatgtttttaaaaatgataaacccatcacgcatgattcatttctgtttcttctaaaccttacatttttcatgctctttgacagcatttgctgcacatggcatcagttttgcctctgctgcacctcctaccatcccatcggctgaaaataacaatgcagggtaagttagcagtcatcaccatgcttaattccagcttatgccaagttgattgcagtaagggcaatctaattttgactctgtcgcgtcgaaagcaacgccttcaagatcatgaagaggtgtatccgtgcaggactaacagcatctttttagttggcagggggggtacgagataggctttgtatatagagcgattggtcgtactatttgcgatttgtaaatacggtacaagtcatctactcttacagaagtaaatgcggtgcttaatttatagaggaaaacggtataggctgctaatgatttggaagattaggttgtgtgaaagggacactgtgtgctaaccgtctgcagatcaggtcaggtgttaactggtctgttgcgaaaatggaattttgtagtcatgttacatggtactagttccacaaaataacataaaaaaacagctaataagcagcacaaattgagtattcaggaatcggtctgtctctatactctgtcgaagcattattatacagtatactataaaaaatttgccgacagaattgcattaattcacttgaaacaaaaagaaaacaattgatcgcaatcttgcatctaatgcaatcactttctgaagtactaatccattttagaaaaaacaataagtattgtttgttttatgctttggatgagacgagcaattattcagtttggttttcaatgtcgcattcggattggcttataatttcttgaacaattttgtcatgattcagagaaacgccactggccgatgcgctgcggtatcaaattgaagtccaacggaaactgcacgaacagcttgaggttagattgccaatgcatcacccattagcttccctgcttgaatcgtagtgtagctcagaacacaaaaactaacaggtcaatgtgttgctccacgtacaggttcagaagaagcttcaaatgcgaattgaggcccaagggaaatacctgcagacgatactggagaaagcccagaacaacctctcctatgatgcaactggaactgcaaacctcgaagcaaccagaacgcagcttacagatttcaacctggctctttcaggattcatgaacaatgtttcacaagtgtgtgaacagaacaatggagagctagcgaaagcgatatctgaagacaatctcagaactaccaatctaggctttcagctctaccatggaattcaggattccgacgatgtcaagtgttctcaagatgagggcttactgctgctagatttgaatatcaaaggaggaggatatgaccatctgtcctccaatgccatgcgaggcggcgaatccggtctgaagattagtcagcacaggaggtaaagattcagtagaatggcgaccatctgtagtttaaattaagagttacctttgtcctatgagaaattcttttgtggcgatattgagggtgcttaagtacagtgttggtccagagtgtactaatgtaaaatttgtggggtaaaggctctgaataatcgtagctaatcaatcatgtctagatctgaatatcagaatatatacactgtatgagtattcgtacctgcactctaaacgactaaagcaaaagcattatcaagtcttgcaacagtccaaccacgttgaacttctggtcattttgtagtagaaaagaatccttcgtggtatcattttggagtaagcacaccacatcagatgatcagagcaatcaacggcaagcattttgccattttactacaggggaaggtctgactgaacattggtgtagtgcagctacaaccaagatgtgcagcagaaaactacatctgaaactgaaaggatggaactggagcttctgaattctgaaacagagctccagcattactgaggtaatttatatcatttgggtgctaaaaccagcagttagtgcagggttcaaatggatagtagcacatgtgaaattgaccaaacagataacaggacgcaaaatgattggtttccaactttccagcgaacagaacaaaatgcaccaagaatgatgcagtctacgctaaactgaataatcaatgtattaacccacaaacagtggctatcttatggtagggagttcaatagcataattccatgcacacatgaatccggatcacgagaaatcatgtcaactcgtgaacataagaacattgttatttgatactatttctcatgtatgttcctaacttcctatctactactgcggtagcacagatcaacagcaactcgtgtttcttggtaacaactgcagagctgagcaggacacaagccgccgtaagatttcttcagtgataatcgagcggggcagggatatccttgagatccatcccctgaaaatgaacatcctgcatgcacatcacaagcaaaagaacaatccagtcatcacaagccgtacacaaagcccacagcaaacttaggaattcacacgcacgtaccgacgcgaagtggttgacgtcgcggtggtgtgcctcgtcggcgcggacgacgacgacgacgtccttgagcgtggcgccggcggggaggcgccagtagtcgatggcgatcggcggcgcggggacgttctcgatcttgccggcctcgatgtccttgaggtactcggtgtaggagtggatggcctcctcctcgaggtagccgacgacgcggtgcgcgagcttgggggacaggaggtagccgaggaagtaggcgttgaagaagacgccctggacggcgagcacgagcgcgcgctcgtaccacctcggcttggccacctccatgaaggtcatgaggtgcatccgctcgttctcggcctcctccagcagcgcgcggatccagccgccgctgtgctcgaagcggcggagcgaccggaggtgcagcagcatgccgcccaccatccccggcaccgccgccaccgtctccagcatcatcgcgcggcacccgtacctcctctgcaaaatcgttccattgattcccatccatttcgatcagcaaaatagattggcatgatctttgatggaaaattagttgtggttggttacctggaagaagatgtcagtgggcacgcgcagcgccttgacggtccagtaggcgaccttgtcgagcagcaccttcggctcgtggtgcttcttcaggtcgatcgtcgtgtccggcgagtacgtctcccatggctgcaaattagcaaacacattaattcatcgacgcagttacacaaattgaattcagattagttaaattaacagcaaaaaagagaggaagcgatctttaagcaggatcatggataaatcgattcttactctgaagcaagaccacttccactcgacgccgtccttgctcgcgagcttcgacgcctcgatgccccagtagctgctcgccacgggactcgcagtcgcactggccggcccttccttggcggccttcgtcgcctccgccttcgcggcggcggtgctcccggtgttctccttggacgcggccgtctcctccttcgccgcggcggcggaggtggacagaagtcgcgcccacaaggccacgccccctccgccggcgccggctaacggaggccgctgcgcatgcgcatgcgcagccgcagaggtcgagctggagactcgggggcagaggtggcggaggaggactgatccagcagcgcgggagcccatcgccggagatcgtggagacgctgctctgctcttcgctgaggtgtgcgtgttgatgctctgttcgtggctgcagacgtgccggtttctggagggggctagcttcagcgtgcagatccacgtgtcggcgatttcgttcgttgctgcttcttcggatatacgaggctgttcattttttaaaaaatatatttaaccgtttattttattaaaaaaatttaagtaattattattcttttccaatcagttgattcattattaaatatacttttatttatatttttatttatatatatagttttacatatagttttatatattttgtaaaagtttttaaataaaacggacggttaaatatatttaaaaaaaatcaacgacatcaaatattatttgggcacgaagagagtattatactgggaaaaggagttcatggtggctgctaagcggcaagctgatagcatcatagcagtggactggtctttcgtccacttctttcttcgtattttctgtggactatatagttgctttctgtgtagaaataaaaaacgtgtggctgcgcacaatgatcaggtgacatcgatcagttatgtacgcggagatgattaaagcgtataacatgcgacatctaggagtagctacgaaaatattagaaaaaaaatatggggactaagttttttttcttttggcataaggttcaattctttctcattttttagcaaaatggcatcctaattacatatataaagcatatccactaatcagtctatttttttaagaaatccaataaaattctaacaaccacggtaaccttttgacatccacaatataccataagaatgagtcataagatattatgactagtcatatacattatgggcactagccataagacattaaatgttaaaactagccataagcttacggctcaaccttaagaaataaaataataagataaaatacactaaagagtatgaaaatagattatggtatggtaggacctaccttaaaatataatttgtttacatagatgtgagacacatcttaacatctattcttgtcttcaatattatagtcatggatatatggtatgatgggacctaaattattttcaccaagaccttaagcattgctgttgcccttaatatgggaggagatatcctgttttttcatattaaataattatagaaaaaaatagtttaacatgtaacatattacaacacaagcacataaattaaaatacgatatgcaacaaaatgaacaaattaaactacaattagttaacatatattcataattattttttaatttatataagttaaatttaactttacatgtttatcaagtgatccagcacaaataatatatatttttaatttttcataactatttggataacatataaacaatgagggaaatagttttgtttccaattgaatattaatattagtgcaccacctttttaaatcctaaatgaaaaaggtaaaaaaaacacaaattgaaagtttacaacacatgtaactaaggtgccatgattcctgtaaaaaaaatgccttaatgcaatacatgacaagcacgggattgcatgagcagcaataagatgtgaagacgaggtttgaactcacagtcttcattcaaaacaaagaaagagctttgaactcatggaaaaatttctccaaaattccaacagaatagtgcttccgttgattttcagtggatttcgttggattaaattctttttgttgcaacgtatacatgattctgcaggacttcttttttctccctatagttggactgcaatccaaattgtccattttccagttccagggcctaactgatttctgggcgtcctacggaaccaacggctcgtccggcgcggcgggcgggcgaatcacgccgatctccgggagatccgggttaacggagaacctcagccaccgcttcttctccacgaacctcagcgccggctgcagcacgagccccatggccaccgcgccgaggctcaccaccgccaccttcagcgtggacagcgcgagcaccacggcgatcagcgccgtcggcggcaccagcatcgccacgcacccggctgtgcccagcggcaccctgtatgggcgcgccgcgtcggggcgcctcacccggtgcaggatgaaggcgacgaactcgaggagcatgccgaagcagtagaggaagttctcggccgccacgatctcctggaagctcatcatcgagagcagcagcacgccggaggccgagaagaggatgcccgccagcggcgtgccgtaccgcgaccgcgccgcgaagaaggacgggagcatgccccgctccgccatgcccagcagctggtacgagtcgctgctcatctccgccacgaacatgcccatgttcgacagcgccgccgccgactgcacccaccacatcagccacgcgccgccgagcagcttcgcgatgtccgcgaagtagccgtctgtccactgccccctgtccagcggcacggctcccgtcccggcgaggagagggtacaggtaggcgaccaccacgaagatgaccgcgtagaacagcgccttgggcagcgtcttgccgggattcttcacctcgccggccaacgtgctgatcgaatcccagtagttgaggttccagaacagagtgttcaggtacagattccaatcgacgttgtggaggtcgatcacgagccacctcgccggccggagcttggggagcgcgatgagccccatgacgaaaaaagggaggagggagaagacgccaaggcagatcgccacccatccgacgacggtgagcccccggtaattcagcaatgtcagcacggccgtcaggccgacgacggcgaacgccctcggcgcgcctccgccgagcgccgggacgccggacttgaggtagtccaagaagaggacggggtagagcgcgttgtcgatgacgccgctcaaccacttcatccacccttgctggaacccccagtacgggccgagcgccgacgccacccacacgacgtacccgccgttctccgggaacatggcgcccagctccgccgtgatcagcgcctccgggatgctccagatgacggggaggaccaagaagccgatgatggcgagcagcggcccggccgcgcccacgctgtcctcgatcccgaacggcccgccggacacctcgtagaagatgaggaagatgagcgggatcatcgaaaccgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgctctctttagcatctttcagaaataaggtacttgctgcatcttcgacgaagacatcctgcattcctactacgtatcatcaagctatcaaccaagcccgcaagtggatttgtttggtgaagcagcggcggctcacagagagctgagagaggtggtgccatgcggcgttcggccggtgacacctgttgcggcagagacggccacgcagtccgctccggctacacttgtaaactgcagggctaggtggctgcttctctcccgcctctccgctgcttcacggcccaaaagccttctagcacaaacttacaattgggccatagatgttagctaaggcccacgtctagcaaattgggccgaatcggcgaatctcgtcagccctgacagaccaagacatcgatgcttcagttccttcctggtccatggctgcaccgtacaggttaaaaagtcgtacgagatgggccgaatcaatgcggaaaacttaaaagatcttatcccaaacaggggtcagattgggattggtagcgatgcgacgagagaggggaaccgattagccgacgaagcgatcccggtgcacggctggctggcgaacatggccgcggctctcactcgcacacaagtagacgtaggagtatacacgagcagctaccggcggcaaaaccacgagaaataggattgagatggagacggggatcgagcgagctctcacctcttgcccggtgtcagcgtggccgagatccgccgccgccgctgccgtcgtagaagctgccgggtggcccggcgaccggaccgtggccagcgacacctccggccgtccgccggtgtccgccatggatcccccgatccctccttcctcctccccgtgccccggatgctggagctcaacctgattattattacgcctccggccgtgcggagtggaagcgcgcatccagcataaatagtggcagtacgtcgctttccagtttacaaattatcaccagcgtgagcataaagcgcgcagcacatttggactgaagttgaaccaaacgaatagaaaaacacacacgcggggaaaaaaaagaaaaaaaatcctcacaaagcgattgcctttctcgagagcaaatcttgcactgtagcgtgtgcacatggccagtgcccatctctaccgtttttgctcctacacgagacgagaatgtcagagtacgcggcatatgccaagcaaggccgtgcgggaacacttggctttaggttgagttcgagtttcccaactcactcccttcatttttcgtgtgcacgttttttaaactgctaaataatatattttcagaaaagtttatataaaggcgctttaaaaaatcatattaatctgttcttaaaaaatagataatacttaattgattatgtgctaatggccatttcgttttccgtgggagagtagccgtgcattgaataaaaattggtctcgagcagggggcgccgctaatgctagccccgtggtagtacaatactacaacgcagcagggcgattcaacccggaaacgatggaaaatcaggcatcttcccatgtgcacatggcaaagcaaggggcctctcgttctcatctgctgttatgactatctgtgcgagccgttccggcggctgtgataaccagatctagcacgtgatcaagcagtgcgatttatggacggatccccgcgacggtcgctgcgacgctgcctcttgacgggtcagaagttaatcagcaatcaggagtattcagctgagaaaaaagttcctaattgactgtcaacaaagtgacaagacttcagtcgactggctgagttagttcggcagggttagaacaactgtcaccagaattagaaaggagagaatataagttgaaaaagtgttaaaatgagcatatccgaataattgcacattgagcggtatgcctagaaagtaaagtccaatgcaactagaactggtttatctttggatctgattctgacggattactacaacaatagtatcgtttctttttacagcgaatcctgcctactcttgtagtcttgtgatgatcagcatcaacggacataaaaaaaatgacagggttacagcgaccaacattatctgaaaaaagaaatactgacagggaatgccgcttgcagtttcactgcgtggagtatattcccaaacgttggattcaacagaaaacaggtagtaaatcatattaccatctcaccaattccgccaccctaataatcgaagatatcatggtccatacctgttcccgaaaaaatacaaatccaaacggaagcaacccggcccaaaatcccaatcatagaacaaaccacacacatttgttggcatcctgaaattcataagcaggtcggcttctctctctcaaaaaaaaatagcaggtcggtttgtccgtcagagcttaaagatcacatcaagctgacagggcgaccagccaccaaccggggagagggagagcgagaaagaatggacaggcccgctgcctgcgcgcaccaccacctgctgctctctctctctcgcgtcgggggccagccaatacacttctccgctccgcatcaccgtcgccggtggggaccgcggcgaggcgatgctgtcgatggcaaggaatgtagagaacatcggccccgtggctcgtgaatgggaggggagatcatcttcgtgctttggcaggtctaacctaacggctggcaggttgcgcccccactgcatttgccctttttcttgttagcgaaatcactgcacttgatgtggtaaccccccatcatcagtaggagtaataattatcacgatccaacaacaccatcgcacaaaaaaagtccgcccgatttaaaacgagcttttgccgtatcggctcgcctgaaagcgtgtcattagcatgagccaaaggaaggagagggggtgaaaaaaaagggggcagaaaggaatactttcccttccgttggagcaaagcgggttaaaaaagggttgggaggcagataagaggggagagtcccggacggagcgcgatgccggagacgggacgggtttgaggttggggagtatggttataaaaagtaacggggcgcgacgcgggtagaaaccgtggtggaggcaaaggcgccgcgggcttggcttggctggcaccctctccttctcgtcttcggcttcgtcttcccccgtcaaacccacccacgccggccgccgacgccgccgccgttgcggcgggtgcttcccccgctcgcgtcggtgccggggggctgaggggaagagggggagggggagggaaggcacgcggctgacctcgtgggggaggggagggggggaacggggcgacaccacccacccaccgccaccatgtgctcgttgcccgcctggtaaggtatggtatctgtttcattccattgccccccatctttctcgtgcttgcgcccctgcccccgccgctgtactttcgcgtgccctggattagctggttggttcatctgcttgttgcggcgcgcggcggatctgtgcctccagccgccggatctgggtggttcgcgggcgttcggtgcaatgcgagtctgcgcgtaagtttttttttgtgtgttgtggtgaacagtggtgataattattgcagggtttttttttttatcttgtgggggtcgtgtccctgttgggacctcggatctgttcttgtttcgtggctaatttggattttatggcagaaggaagacgttttgtcacaatagattgagaacgctctctttttccttcccatggatggtcataatctgtgccttttggtgcttagcgttgtaatttgtgattagggtagcaatgcagattgtttcacatcatgttccaacccaaggcaatgcttctgagttacgaaatgtttgtaatatttatgaccttgctgtcttgccatgcttgatcgatcattgttgttaaattggatacccgcattacttccaattttttgcacttcttaggtagttaggggtataggatgatcattccatgtcgacgccttattgcaactgattgaatagtagcatcggtgtcaatattttgtcaatgcagcagcaacactctaccttatcaggcaatgttacctatagtgcatttttttttattctaggaggaagtgtatttgattgctgccaagaaggcagtgcttcattttgcacacatcagttttggtacttgcatcatgtggcctgtacatcattgtttgcaaagaagagaaagctgaagcgctataaatccttcaagcagttttttcggtctaaacccagccatatctgagtatgttagaatgattattatgtgcaaggtttctgtcggttttgattgtgatcctcagacataccttgtgacgcagatattcatgctgagttgattccttctagtcactttgcatgtacctatagtttgaacatgtgcacggaagtaatgatctttgactgtgttatatgtttctgacttaaatctgttatattagattggaccagctgtgatttggggagcttaaagttttgatcagagacatggaaaaagtgatcttctgggcacatctccttaaatgcaagctttttctttcaaaagaaactcttgattggtgtgttttagctcgtgggaacacccaccacttctctctggtgaactacacatagtggttttatgctcctttatgctcaagaacatttggctgattcaatctttttcctgaagccatatttcaagtctgccaaacatctacatgtaatgcacctacttcatagcttgttcttccttcattttgtgtcatatggactaatttagctaaccaccatctttttattctactagcacgtcatctctaaagaagcttcctttaagttgtagatgctgatcatataagctgggtatgcctctttttactgttcattgatgcatttattggcatttagagaaataaattcttgcaacttgaaatattctaaacaacttactccttcccttattttgtagggttaatacctttgctcatttgtttgtcatctgttgctccctagttaattaccactagtgttgcattgaggtcagggttcatccttgctatagtatgcaactatatactatggttgctgcttgatcttctgagtgaaccaagatccaagaaaacataaggtgctggggctactgttcaattgactggttgcatatatttgttcgtgctaatcgatagactagtcaattggaagtggtggcaaacacctgtctttgtgacttggctgtccaacaggaaaaggctagcacaaggctgacattgaccggcataatggacaggtaactttcatattgacttactatttttaggtcacctttttcttatcaagtatgttgtctttgcagattcaaaatgattaaggaagttggtgacgggactttcgggagtgtatggcgtgctataaataaacaaaatggtgaagttgtatgtatctgaagataaatccataggaggaaatatgcatttcatacttttgcaaaatattcccagtgaaataaataactgattgtaagcaaaatgtgcactgatctataggtggcagttaagaaaatgaagaggaaatattattcttttgaggaatgcatgagtctacgtgaagtaaaggtattttaactgaaagatgtaccctctttcctgctatgaaccttcaactgatatttctcctatattgaagtctttgcggcgcatgaatcaccctaacatcgtgaagctcaaggaggttataagggaaaatgacatattatacttcataatggaatacatggtacttaaggatgtcatataccgcaaaagtttaattagctctgtatcgcttttgttaagtctcccatgttcttccaggagtgcaatctctaccaacttatgaaggatagagtcaagcctttctcagaggcagaagtccggaattggtgctttcagatttttcaggctcttgcatacatgcaccagaggggttactttcatcgtgacctgaaacctggtaggttctcttgtttagtcaacatcttcacctatatttctgtggcaatcaaattatgaaactacggatgagtatcagatgtaggtatgcagaatcagggtattattgtattgagaatatgagacatttacctttatttttaccacatctactttgcaaactgaccgagatatactttctaataaatatatactttcatgtgggattgtattgtgcttatagctatggcactaatcactgtactaatgcagagaatctgttggttagcaaagatgtcataaagctggcggactttggtcttgcaagggaagttacatgcgtgccaccatacacagaatatgtgtcaactcgctggttagtagcactctactcgcacacgtggacacaaaatccttttctttgttaatgttgatccacatgtgtttgaacatatcaggtaccgagcacctgaagtattgctccagtcatctatctatgattctgcagttggcaaagtttctactatatactttgtattttggcacatatagtacatactaagtcatgattggatgatcccctttttgcaacttgcagatatgtgggctatgggtgccataatggccgagctgttgacactttattctctttttcctggcacaagggataatatgcatatatcatatgtatatgcattgttggtatgatttggagacacgtatctctctgtgtttgccatgtattttgggcatctgttattctgtctctcttattatatttcttctttgtggtggtcatatttgctcattgctgttctctttatccaactgtttagtgaggctgatgagattctgaagatttgcaatgttatcggtagcccagatgaacaatcatggccacaaggattgtctcttgcagagaccatgaagtttcagttccctcaggtcagtattcatcttccccttttccctttgcctatatatgttttcttttgggggtaagctctttgttgtgattatacttgtttctgaatgtgtcatgaatctttgatatgtgttgagcccattctgcaactgtttattttaatcccttggtcattctctgatgaattttgtccttgtgcctccctatctctctagacaatggtggaattatatcacttcgcatgccttacaatctttcatctccattagtccattgcctccttttcctcgcatattatcataggtttaaaagcgtagtgtcttgttctaacttgattcatgagtttgacatagattgtccataaatagtgggcttaacacttaactaatctcatgtggatcttatcaatgcaggtcagtggcaatcaactggcagaggtaatgacatcagtcagtagtgaggcagtcgacctgatttcagtaagttctacaattctgttgccccagatggcgtacttaaaatctttagattattttattatatttgtttctttctacatctgcagtcactgtgctcatgggacccttgcaagagaccaaaggctgcagaagttctccagcatactttctttcaggtaaaattactattcgaactccgttgctgttgtctgtacctctgttgcagaagataaatcaaatttatttttgccatccactagggctgtacatttgttccacctactgtccggtcaaaagctggagtgctccctaaaacgcctccatgtggttagtttccacactgttttgcctcacaaccttggtgttcctggtactcttggttatatctatgatctatttgtttcagttggagtaaaaggagtttcggagcacggcatgcctcgaagatactctacaggaactctatcaacaaccaaacctcatagtaatgcatctctgaaatcaagtggcttatctaagaccggtaatatgtttaatcttttttctcaattgcttgttagcttgcattgtaggctatatttttatttctctttccaccttccaggtgtacaaagaaaacttcaaatggatcgtcaggcgccacagaagattaaaaaacctactgagagtaataataaactaaccactaatcgagtacctgcaaggaatagcccaggcaagtttccatagttgctttatttgaattctacatcaatttgtggttgactttgaagatttacattccctttgtggcaattataggtcaccctgtattaaggcattcacgcagtttacctgaaactggccgggcaacaatgcacaaggtttcaacccttaccgagagattaactcatatgtctgttacctctcgaacgcgtactactcccaagcctgctgccccgttactgaaggctgggctcggcaagtctgacttactgggaaaaacagacgaaatacctcctgcaaagaggttgacaagaaaattagtaagctaacgtagcagcatccatacagtggaagctggttagctggtgcagagaggtgttataagctacagagcaaaatcccggtctgctgaaaatgatggcactgccggagtgtttgccaaatttgctgcatccaagtgccatagtagaataagtcgagcctgccgatccacgtggatctgcttttgccccaagtttgttccatgtttgaatagaacatgagtgtgctatatcgatttgaattgttgtcgaccagtgttcactcgcatatgcggtctgacaaatgatagacccgcgagcaggaggatgtttggcttttgcttgtacagtttatgagcttttgggtggcggtcaagtctttgtcgggtccttggcaaatgatacaatgcatagtctggttttgacttcgtctgtggctctattcaggtctttgtttgaagatgatgtctcatttctcatgaaccttcgaatgttggaaatgacctgattgtatcactatcgtctgctctactttggacgaacctgctagttgtgcatgaccggtgcacttaacaagcaatatatacaccattctaccgtcgaggatcacatgaaaccatgctaaaacaaacgaattaaacgaacaccctgtccataaaggttacaaacggaagaccaaagtggtcagttaacaagagtagcagcttgactgagcctgctgcttctcagaccacagcatccttccccctcatcctatattcaccctgtaaaaaaaacctagtagcactaaccgtagcagcggcaaagtagtagtatcatcacactcttaactattcttcccggcgacgcgttagcttctgtcacagtatcacttcactctcatcaacgatgggtctcgcgttagctcacagatactgcgcgtgtatccggtcccggttctgctcccaccacaccttggcccgctcctcgccaaatctctcgcggctgcaacgttgcgcacagagagaagtgttaaaaattccacgcgaacacgaggaaaatccagcgtgatctgccggtattggtgacgtgttagcgttttcgggatgtgtgtgtggactgtggagtggcttgcctgaaccggacgcggcggagctcgcgggtgccgtcgccgaactcgcggatggtgatggacaccccaggctcgtcctgctccacccactccgtggcctccaggtcgctcgcgttgctgatggacacggacgcctcgtcccgggacgacgtcgtgccgcgcgacgggtcgtacggcgccgctggtccggcggccgcggagttgaggaggttgaagtggtgcgcccacacgtggtcggacgggtccggcacggccgtggacgggtagaacggcggccgagccgccgccaccgacgacgacgacgacagctgcgccttgctcgacgctgtccggctgatcgggtgctccctgccagcacccgacgacggcagcggcggcggcggcggcatcatcatcgccgggctctccctcgtcgagccgacgcgggagtagaacgaatctctctgcaaacatcaaccatcatcagcaacggaatgtgcagagcttttgctaaccagtgatggaacggaagtgacctgcatggcttcgtcgacggaggacgtcggcgtcgagaagccctgctgccggctgaacgtctgcacgttgtagagctccaccacgcggtcgtagttctccccccaccaccgctgcgcctcccacttgttaaacatctcccggctgcatatgcatcgccacaatccgttagctcatgctcatcactcgagcaccacgtgctcgacgaaatgtcatgtcgcttgattggcacgaacctgaaacggatgcgcttcagatcgttgccggcgccgccggggatggagacgaaggtgatctgcacgccgggctccacctgcgccgtccactcccgcggcacgcggtcctcctccaggaggactgtctcctcgtcatcgtcgtcgtcgtcgtcgtcgtagtcttcctccccgatgctcggtaccccgctcgcgctcgggctcctgatcacgcgcggctggaagctgcggtggttcaccttgggcggcaagtcccacgtcgacggcgcggcccgggcgccggcgctcgccgtcgtcgtcctcatgtaagtataggcctcgccggccccgtccgacgtgaagcccgactcgtcgatgatgcccgggtacgcggcgaggcggctggagcggtggaagcggctggtcctcaacgacgggctcccgccggacttgtattggtgcctgccgctgccggagaacttgagcaccatgtccttcaactgaaaccacattaaatttgtgcagattaattaattatcctcctgaataagggatcaattgattttccattgtaaaaatatttattaaatatccattagtcaagttaacatcatccttttttttttttgaacgaatgccaagttgacatcatcatacaacagatgatattatatatctgaggtaacatttttgccttgcatattcagtaaatataatttcttgcaattggcaacagagtggctgcatataacttttaacatgccattgcctttccagtatataaaactgcgggagtttcgttcggggcatcaacattcaccactaacgcacacgcctcagcaatcaaatcctacgcgacagctcggtctctcaagtaaagcgccaatcatatccacagcagggttaatgatcaccgatcgattccatctccatcccgatgattagggctaacaaaagcaggacagggcgcacttccgacccccagattagtcgcgtagacgcctagcagaagggctcacacatcaccgaaaagcaccaacaaaaccatcacaatgtcctaaaacccaggacatcttttgcctgaactctcaagcaaggaacaaagcaaagacaaagcacacccacaccacaccactcaagtttctcaaagcaacatcgtggacagcgcccccccccccccaaatttttgggatcataataacaccagagagggaagggaatcgatccggtccattcacacacacacacacacatagccacacaggtgcatgtcatgtggtgcgtgcttatgctccaaatatgtgtagtactagtactgctactttaaaagacggcaaaggcgaaagcgtgcaggaagcaaaggacgagagtactcgagtcccagtgacgaggcgtgtcatcatggagtagttcagagatgggtcgcagcgagagcccatcttaagaaacaaaccagcccatcgcaaggaccacaagtgtgtgtttctgtgcatggcctacgggctggctacggcccagctttattcttctctgagtgtccaggaccgtcttgggggggggggggggggggtccctcttaagaaaagaaaagggaaaggaacatcttggactgaagagagtagctgcttgtttgataactcgaaggggattgggagtttacacgagggagttgatgatgagattaagatgggaatttgatttttaatcccaatatcttatttggtagaggtgatagaaattgatagggaatttagttggagattaggtcattaataaaaacggatggctgagatttggttaaacaaagtaaaggatgaattccctcctaattacctgcccctacccagttattgaaaaggagtgagttccttcctcaattccccatcctcatcccaccaaaattcccatgtctcccaaccaaacaaaaattttaatagcttcatccctctaaattcccaatccctactaaaaactccctccaaccaaacgggccgtaggagtaagacccaggggttaagatcaatcaaccagatagtgtctttccaggagggaaagatcacattagcagctactaggataggacagtcttttgttgggagcaagcaaagtgaatggatggatggatggatggagcaagtgaaaagggcaggggaatggtagtatgggggaacagaagtgaccatatcaaatcagtccaaaacccaaagcttgaggggatccatgcaagaaaaaagcaagagccttctctcccccaccaaactctagtcatattcccctgggccttgagtccttgaccaactttatcaaggaatgttttaaaatgtagttagagcactgtcattcaccttgtacttgtgattccatgcaggatattgccctgattagacacccggtgaggaagggaaaagaaaagagaaacggtgtatatcaccacaagtgtactagtattggttgtcctcctgtacgtagtggtactctgttccctttcaaaggccaagaacaaggtgacgacaagcaggctaggacaaaagaacaactacagtgtaatactttctcctccgtcccaaatgtaagcatttttgaggctgacacgggtattaagaaagtatatgagaatgattgaaaaatatgtgtgattggttgaaaagagaaaataggtgaaaaagaatggttgtgattggttgagaggaaaagataggtagaaaaatagcttcattttaaaataaagtactgtgctagaaatagctatattttggaacggatgtagtactagaagtactagcaccccactgctaaggagcagcagagggcattcaattgactggttaatgcaacagaagaaaatgtggcatcaggtctccgcccatgcgctagtgcacaacatgtgcgagtactacggatttttacttgtgtacggagtactggagtagtataagaatgcacatcagcacatgtacctgtgaagtcagagacttgccggagttgggcgtggcggtggcggaccggtgcccgccctccccgccgtccttggtcgaacacgcgatgcacgcaagcatttcctagcctctcgagtagtccagaaccgcgcaaatcctccttccctgctcagtcacaaacaaagtccatcgaagagccaagggaggagattgtcactcgttttccgcgcttttcaaactactaaacggtgcgttttttgtaaaaaaattttctatagaaaagttgctttaaaaaatcatattaatccatttttaaagtttaaaatagttaatatttaattaatcatgaactaatgactcacctcgttttgtgtatcttcccaatcttcccaatcctctctctctcaaacacaccctaagataagaatctggtcctggtgtatcaaaagaggaactgagccgtcacgcactcacacggctaaaatccaacatgtactagcaacgtagcagtgccattgatccagtgtgtgcaaggagtaaatacacggaacatttctagtagcagcaggtacatcagattacactgcagccactgccatggctgcagtgccagccggccggccggccggcatcaactccgagctgagtagccatagccagtgagtaaacgccgctctagctaatgcatgccatgccatggcctgcgccgcaggcttttgccttccttaaaatcgatacaccgacagcaacccctcgccagccgagtacgctgccaccatggggcgcacacgcccgcgcgtgtgtatatccatgcccttgggccttggcgcggccggcctgggcccgaacgcatgtttgcacgcgccggctcactgcagaccactgccatgtttgagctctggcttagctaggggtaggcgaggcatcgagcaagaaacggagtcaatgccccccaagctttggctgctttatggagtagtacgtagtatgagaggtacagggaggtagctgcggcaaagtatagcccgggtggtggattgattgattgatgcatgcacggattgatattactgcttaatgctgctgcaccggtgggctcagtgtgcaggcgtgcagctagtacgtcgtcgtaggtagagcattcattcactcaacaagcataggcttaattatgcttgctactgcagcaacaggcaacaggcaaccaaggcatgcatgccgataatacacgagggagcagagaaggttctgagaaaaactgtactagcaggagctcttttatctactcctacgtgaggacactgccactccgaatccaagtgcatcgtccagttccaagcgaaaggttggaagcttggagagcggccgatcgagctgagcaggaggcagatagatagacggatgatgcacatattgcacatttgcatggatagagagaagcccttttaggaccagggccctcatggaaattttatcagtggttgggagtggattggaggacccactgaaggaaatggaaaggcaaacagaagccttcttgcagtgtaacatcccaactaaaaaacagtcctacttgcacctacaaaattcgcgtgtattgtactattgtaatactaccgtttttagtttaagcttgttatactacaaagggtactaggagtaattaccaatggataagattgattatatagttaagtgtggatgacgacaagtgagaatactgcttaccagttagcaagccaccatcaggctattgctcatccaaagcaactcccgccaatcacagtctcgcagcaatgcttgtgaccacgcggacagtggtatctcgtcactgctccttctgacgcaaagatgatctgaacaacagcgacagggaagagaaggtgataaagattacgcaatgtacatgtggccgactagaaaagcataatgctcacttttatctgcaaaaatactgctaggacagatatttagccgattgttcgctgtccaaatcgacaagcctgactctataaagaaacaggccagtactcattgctgcaagaggctgtcgacgctacggaaaaaaaaggcaacagtgggaagcaatgggattgcctccccaaatggacccaatggaaggctggagatctcaatgatcgacaacgcaaacggacccagagatgaacccccctccgaaaacgaaagcgcagcaaatggacactagagcagagcacaggacacacggagctactccaaatatgcacaccataaaaaaagaaacagagaaagagatggcaaagatctcgttctccgattcaaggggaaaggaaacagcagtagtcactggtcagttaccttcttcctcctcttcttggacggcgggtggctcctctctcggtcgacagatcctcgccggcgcgcggcggcacaagagctcggaagcgacagaggagagcggctgagctatcaggcgatcgactgccgccttttgggtggtagctagcgaacgagctgccgagcagcgacgccaacagaaacaggacgaagaggagatcttttccactcccccttttccttttcttttctttttttttccgcgagggagagaagcagggagaaggaaggattgagaggaaacgggcggggagcagaggcaggaacagagcgggagggaggggggagatccccggattcgctcgcggccgtctgatccgcccccgaaatcgagcgaaagcactcgccgaccgagccgtcgacggctatttatacaagggagaaaagcgctcgcgatcacggccgtccgtatgtttcgctaggctgcgacggccaggatgcgtggcgcttggttgggggagtggggtgctttggcccacgtcccaggccttaccacgcgcaccgtaccacacctgctctgcgtacgcatttttaacgtggtgcagccgttggcagttggcttgtggctagcggccggcttcgccaccctcgcggtcgcggtggcatttggcaacccgccaacttgtgttgtcgggctcggaccatgcgcgtgcgcgcgggcgacgccaacgtcgcgcctgggaagaaggtcgcggcagcgtgggtgtcgggaacgtgtgtttccgccgagactggcagcgaggacggtggcggttttggtgttggaaggcgacatcccggcaatgtcggctgttccaaaattagtactacaacgcttgtttatggaacttgtcgacaggtgatacccgtagaccggatatagagggtattggggtacgttggtataaggatctacgtaatacgacatcaagtagacaaaagacgaggattatactggttcaggccccttggtaggtaatagccctaatccagttgatgtgggattatatggtggaaaacacaggttataaagggaacaatggaacttgagggatccggcgagatcatggtctagttggttcgactagatcctcggcgatttggctccttgcaggctccgacttcgtaggctgtgagggttatgttggctccgagattcgatgccccaggtcctcctcggggggtcccttttatatcgcaggtcaggcggtttccaagtagaacttagagataatagaccctatacaatacattgacgacccagtcttgtccgagtaggactctttccatctgtagactccgtgaagtatttccttagtgtacgcaggaagtatccgtatgcgcgtgggtataccctaccaatatataacatatatcgaagggtaaagggtatgcctaacccggaaccctgacagtagcccccgacttctgcttaaatgaactcgtgtaaccattcgcgacttcttgtgttgagactgttgtcgctcccggtgtgaggaccatagagtcaggacgtagtcgagaacaccgtgtgaagcccaacggtcacgagtgaatttaaactgaagtccaaaaaactgccgcgcgtaacggacccagaaatctccagcgggcatctctcccctttccttggaattcgcaccgtcggaagtgcgtctatttaagggaattttggggatccattttgaagtccgcctagtgtgaagaaaacatcccgcctgtaagcgctctttgtcttctccgctgccacaagaaaccctagttcatcgacttgagccctctcttcggcgatctccgatcagcgatggatctcggcaaatcatcctccaccagtgcgtcgctgaagaagcttcaggaagacggcgcccttcccggtcgcggaaccatggaaagagaagcaggaggtactaatccccagcccgtcttaggtcgtatggttgcgatcgaagactatattctctgcggttttctccctccgccttccgagtttcttctcttg

SEQ ID NO: 59179 - DNA, 1401 bp, Oryza sativa
aaggtcataacaaaggtggataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaacggcttttactctaataaactccctataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaaatcggatttattgcgtcagccgaggggaggggcgcgcggaccgggtccacgggagtggggcccacgcggcagcctcacggtccacggtggaccgggtgcacgcagcttgcgccggccggcgccgtgggtcccacgcgtcagccgcacccgagggcgcgggcggctgacggccgggccccacatggcagccgcggggcgcgcccgaaggcggcctcgccggcacagccgacgaaaggcgacgcgcccgcgccccgatggtcgccggcggcgacctccggcgcgacggagcggcgcccgagagaggggagggaagggggaagcgaaatggcggtcctcggctcaccccgggtcgacggcgacgacggaaacggcgaccgaagtggagagaggcggcggcgcggctcgggtcgacgaggacggcggcattccggcggtcggcgggcgaaacgaaggggtggacgaggtcggcgaggacgcggcgaagccgaaggaggcgatgccgaagcgggaggaggtccggggcgacggcggcggcggaccgaagctcggcggcgacggcggagagagaggacgacggcgcgagctcgattccgacggggagagagagcggcgagcggcggaaacggaggagggaggcacggggagcgtttatatagtgttgggagtgagagagggcggccggaggggaaggaaaccggcgcggctatctcggctccatcaatgacgccggcgaagtttgcgggaggatttccaaacgaatccgagagagagagagagagggaaaagtggggggggaaagagggagggaatcacggggagtgatttccccctctttattgcgcgcgggggcggcgggatgcggcggaatccgcggcggcggcggcgctagggcacgggcgaggcggcgggagcggcgggaggacagggatgacaggtgggccccacccgtcagcgaggtggcgggcgggcccgcccgt

SEQ ID NO: 59180 - DNA, 2587 bp, Oryza sativa
catgaataagaatcaacacaagtttgactgctcttttcgaaaagaaattaatcagatacgagaaaacgtacctgttaatgaacaatatatctttcaattaattttgttactctgtggctcacatgtagtcatgaaaagcaagatatatataatataatatgtacattatattcccgacgtcaataaagcaagagaatgtattgtacgacgaggatcttctgatggtcaaacatgccctgcatctgcaactcagattacattctgttagtacatctcagaagcatctctcctttgacaacttgcaataagcatgtccaggttcagtgtattatatagttactcagtacaattctacaacattcagctagaggttaacaaaatatctaataaagatatagagattaaaataatttctgcactaaacatggagctgaaaggtagatctagctagctagctagcaagcaagcttttttagtcggcattttcaggaatctttgcaagtcagttctattgtcatacagaatcaagaagatccaggtgagcgagacattcacggccgtgcgaatattccttctagatacaggttattagcaaccataagctaaaagaattaaagcaattaactggcgaataagagaggaaaaacgatgaaccttttctcctctctcacttgatcatctcgccgtcaccttttcccactgatggttaattaatttacttatgaaaagttgaaccctttttttcttctttggctttttagtaatctatttgaacaaacatatgcataggaatgtgctatatatatattaacttaatttgttttctttcatggatgttatataaagtgtttgggcaacaaaaaataagatcactgtgaaattttaagcgttggaaaacagcatccaattaatgtgatatttgggaaatttaagttggtaatgtaccattcatactacataaacgatttttctatacaagagcccctatagattgcagacagaccataaccaatggcgtctataaaaatcaagctccatttttgcatgcggctccttaagagatatgcgtgcgaaaaatatattttcgcaggcggatatgttaagggaacgcatgcaaaaagtgagcctatttttgcatgcggtcttcttaaaggaccacataccaaaatagattaccttcacagatgttttttctcctctcttttccctctcagacacatcaaaattttcacttctcccctcaatttattactttcacctctctctctcttcctctctctccctctcctctctctctcttcctctcctctcttcctccgatcggacggtaggcgggcggcggtggtggcggcggcggctccacctcctcccccgctgggcgactaaaccgccaagcaggcggaggcacgggctccaccccctccaccgcttagcgacctcggacggccccaacgctgacgaggaggcggccgagagcgggtgggcgggaggcgtggctatgggcgcgaggcatagcggctggcgcgtgccgtggcaggcgggctggaggcgcgacagctccacctcctcctccactgcccccttccgcgtggatctggccgccggtccaccccacgcgcacgaatttggcaacggcacgatggatctggcgcgggcgacagtgagagccgtggtggcggccggcggccatctcaacaccaccgccgacgaggaggtgcccaggagccagcggctccacatcctccatcgccaggcgactccaccgcctctctctcgcgtggatccaatggtggcatggcggatccagcaacggcgacgacgggaggcgcgacggcgggggccggcggggttagaggttgggttttttttggaaattttattttatttatcgcgatcttttatttttgcatacggtcgatataaccacccgtatgcgaaaataggacttccgcatgcgggtgcaccacctgcgcgcatggaaaaaacactatttttgctaaccttttggtgcaaacggctggcttaaccacatgaaaaaaaatatattttggccgcacggaaaaatggcttttgtagtagtgcatggccggaccagaaaggcatgtattgtttaccgacatttattatatgttgattcactagtgaataccggtgggtacactggaataccagagaactgatctttcgtcgaatggctcaaaacagaaatatctcggctcttataagaaccgatactaaagatgatttttactaccgggtaaatagttccgtcccgctgtagaatatttagtgctagttggtaacaccaatcagtactaaaattggtttttattactggttcactgttttcaaaccatgttaggtcccccggtcggcgcaagggatctttagtactggttggtgtcaccaattaatactaaagatctatactttattacaggttgtacttaaaaatgcccgtttttttgacaaattgacccttttcaaaaacttaattcgaaactaacccctgccaaaaacttcaaccaaaactaggccgtcggctcagcgccaagcgcattggcgctgaggttggccgtgtcagcgc

SEQ ID NO: 59181 - DNA, 585 bp, Oryza sativa
ctccctccttgccgccgactcattacctccgccgacggctccctcctctcccacgtgcgcgcgccgccggctatccctcctcgccgcttcacctcctcgccccctctgccgccggccacgacaggcgacgacgacggttcgcatccagccgccggctctcctcgttgacgcgacgatgacgccggcggcgccgacgacagtggacgaggggagccctagccggcggcggccgtggtgaggccggtggcggcgccccatgttttttttttatttttctgagatgattttcgcaggcgggccatgggtccgcctgcgaaaatagtctattttcacaggcgagatggtagcggcggtcctctcccccgcctacgaaaatggttttgggccacctgaaaaaatattatttctagtagtgaaaatccctaaacccttacccttgcacccttatacaacggtactgtagcccatgtgagaatgaccaacgacgccttagacctgtgctttggcatggaataggcgagagaatttttttaaccccagtctgaaattcgctccacggtagtcgaacccaggacccgaggagtg

SEQ ID NO: 59182 - DNA, 990 bp, Oryza sativa
cggtaggcaatgatggagagatcgccttggataatggagtggaactcatggtgaaggaagattgcacgtggttccttgttcacttgaaagaggtcggcgatggcgagccagagggcacgagccgtctgatccagctccatggcgaggtcgagggtgtcgtcggcgaccgagccaaacagccagctgcggatgcagaaatcagcttgctcccatgaggtgtcaggatctgcaggaggtgcggagtcgaggtggtcgaggagaccgaacttgccacacatcgagcggaataaggtcttccacttgttgaagttggggttgcgaagctcaagggagatcgggacatgagtcttgacggagatggtcgtgtatgggttgatgaagatagtcgcgatggcgttggtggaggccggcgctatagaggtgccggtcgcggtggaggtggcagaggacgtcgacatggcgatgaggagggcggcgaccagcagacgacggcactggtgtagcacacaaaggaaagttcagagatgcggaaggaaggaggagaacttggaattgataccatgtagagagaataggagggaacaccacactccccaatgaggggggtgaccatatattatagagatatttaaccatttaccacatttagatgtggcaaataactttttgccactgaacccacatgtcatagacacatgtggacccacatgtcattgagataggggtggcaaatagttatttgccaaatctaaaagtggcaaatagttaaaagcccctatattatagcctttccaatatacaagatcctcaattagaggagtatacaatgaatctaaggatacaaaagaatcctatacatatatggccgttttattgacaaattgacccttttggaaaacttatttcgaaactaacccctgccaaaaacttcaaccaaaaataggccgtcgcctcagcgccaaacacattggcgctgacgttggccgtgtc

SEQ ID NO: 59183 - DNA, 1853 bp, Oryza sativa
cttttaagctagcctctatgcagctgaccatcactagtttaaaattatcatcatgtgatcgaatacctatatatgtattaaggctagttacaattaattattacgaacaagcatgcaataaacaactccctccatgacaaaccaaacactagagacaacacattgtattatggtaaatgctgaccttgattgtgctatttgcaactgagaaattgtagaagagaacagttatttttccgtgtcctttctgtgttgcatgccattggattcatatggagttcatgtcatcagaacaccctcgcactcacttgatcactgataaacctttagtctgaagattcccagacgatgaacagtgatctgacgaaactgaaaatctgaagaaagaacagagagcgagctagagcaagtttgttcgttccttaatgccttgcagtttttcaggtttacttctccttttcacctcccatccaggtgtttgacatatatagatcttgaatgaacggaacactggatcgagtgatcctgccatcccacaatatttcttccagcctggccactacttataactgagaaaaactgaaatactccctccgtttcaaaatatttgacaccgttgactttttagtatgtgtttgaccattcgtcttattcaaaaaatttaaataattatttattcttttcatatcatttgattcattgttaaatatactttcatgtatacatatagttttatatatttcataattttttttaataagacgaacggtcaaacatatgctaaaaagttaacggtgtcaaacattttgaaacggagggagtaatagctagtgaggctgaccgaatcctagactaactcagttagcctttttcgatcaccaacacctaatgggatgaacgaggccaaactcagctggaagcaacccaagccgagcagagcaagcattgtagagcgtattcacatcactaaatccataaaaaaaaacataaaatcacaatcactaagacatggtgaagagattcaccatccaacaatattcaggaatcaaaatcgaccaaaaaatttactaaatcacaatcactaaaaaaatcacggttcatgccatgttgtcctcttcgattccatccccaccggatcccgcacctgcacaaacaacaagaagagaagggtaagaagaaaggaaagtgaagaattgggcaaatccaaaatgcaagtgaagaatcccaagttagcaaatccaaatcaaaccgggcaatgccggcggtggaatgagcgcggaatgcgtccatctccacgtacagtagcaccaccctgacctcgatgcccccgccgtccctgtcaccataacggccgctctccgccagtgccagcgcgcccgtccactccacctacaccccatggagtgttgacatctgctctttgccagtgccgacttatttgcagcggctgatacacccacccccgtgctcacggcggcgtatgtggccacccccaggcgcgcagcagcaggtccacacgccccgatgctcgcggtggtggatccagacccgtggtcgtggcaatgttagtcggggcaacggaggaggaggagacggtgacaaggtggaggacgtggaggacgagaagaatgggaggaggaggaggaagaaggggctcagatggggctcgactaaataatgtcggctggctcggttggccgatttttattttttattttttaattataggtgtgagtttttttaagaaccagcacctataaaattagtataggtgtcggtttgtctggaaaaactgaataccggtttttacgtagaaccggtacctataggttgttacagatgccgattttttt

SEQ ID NO: 59184 - DNA, 1074 bp, Oryza sativa
taatgcggggcaacaagtatcagtttcccaactcaaatacatgtgtaccaggtcaaaaaaaattacacatgtgccactgtgccaacattataaccacaactcacttatgcatttctttaattgaaagaacattttttacgtataaataattacctccattgtatcaccaatttcatccactttgtgcaacatatcaacataggtatgaagataagctataaattcttcttcaatctgattggagaatatatatatatatatatatatatattggtcaagtaaggaaaaaattcattcaaaatcatgagcatcaaggtagaaaaccaaaaatagaagaacaagaagaaatacctcccagatccacaccatgtcttgaagttcatcagaagatgtgtatttataacgagccactatcatttgctttgacagccaatcttcaaatatttctgcagtgtttccattgcgttcaccttcctgtgctgatccctaaaataaaaaaaaatgcttgagttgagtaaatgagttccttggcctaaaagaacaaatgtgccaatataagcactataaatattgcccaatactaataattatattaatatgacattgcttacaaaaggcatagaactcacatatatcaacccagataacaaataatggcagctgccaaaatggagggagtacaagaattgcatgctaatgaattacctggctctgcatacaatggtatgcatcttcacaaagaagataaagagcattgttatctgacttcggctcgagggttaagcattgtacaatctttggaagtatatcatcttgaacaaaatatagaagttcatcattgtgcgtagcaatagcaagttggatcaaactatgacaaaatggtgcagctataatccttgcttcaccatccttccaatagccaaagatataattgattaaccttagtattgaagatctaatgttatcatggcataaaagatacctacatgtgaaataattcaagtgttatttatattctaaaatacaataaaataactgcacaaaatctcaaaatatactattgtcgttgtaagc

SEQ ID NO: 59185 - DNA, 6280 bp, Oryza sativa
gcggccggtctggcgacggtttttttttttggcgatttggtgaagagaaggattgagaagcgctaatcgcagtgttaatcccaccaaacaactcgtgccttttatattagtctagatatacaccattttaagtgtttaagaattattcttttttgggaaaaaaaacaaggagttcaagtttaaatatgagtactgtctggtgccatttataattgaatagagggaatatttttctgtgatggcaaagtccaagcaaaccctaaaaatgaaagaagtaagagaaaacatcattgcaatgtctgttgcttgcacttttttgcaagttgtgggtgtgtctgtttctgtcaaaatgtagcctggtaccatgatgaaaattaggatatatacatgtgtgcaagtgtgtttgtggtacaggtggacttgattaatcaaaagcattcaggtctgcttaattccaggtgatcacaaaacttggtgtgcgaaactggaaccatggtagtttggttgataactttcattaattttgacaatttgaccctttacaaaaactaattttacaaatgaaccgccgccaaacttatttcaaaagtgaccctttttctcagcgccaagtcgtgtagtgctgaacttagacacctcagcgccacatcacctggcgctgaataccgtgccaccatggaaggctgagtcagtgtgccaacgcacactcagcaccgagctatttggcgctgaggtgtctaaattcagcgtcacaggatttggcgctgaacaaaaaggttatttttgaaataagttttgatgatggttcatttgtaaaattagtttttgcaaagggtcaaattgtcaaaattaatggataactttgtatgcctactattgtcgccctagaggcctagaagattgacagacaggtactccttgatttcgtgttgcagcagtcttgagccaagtctagttcatcccggcagtgaattccccgttgccatctataatccttctacgacacgaaaacaaggggaaaatataatataaataaatcaaagacttggcatacgaatatatcatgtctatataatagattgtttggttagctcaatagaaaagagcagaacctgaatcaagatgtacatggaaatcagcaagttattacagatggatcggcagtctttattatacaaatgctgtgtttagttcacgctaaaattggaagtttggttgaaattggaacgatgtgacggaaaagttggaagtttatgtgtgtaggaaagttttgatgtgatggaaaagttggaagtttgaagaaatattttggaactaaacacagcgaaaagtaacaataataaagaaggaaaataataaatcacaaactaccttgtagtgtgtccaactgtcatctcatcacctgtagtcctccatatctaattgcaaagaatgtgacgtgatgttaggatacacatgtatgtatttaagctagattaaaggtcaatgacatgtcaagcaggaaggatttgcacagcgaaggcacatttcaataccatatcacgctctgcctaacatctagcccaacaaaggtaggagtatgaaacactatgtatgactttactgcagagtaatattatagcatctatatgtgaatcaaaactagtagcatatattcattggcagcatttctgaacagtgaggagtccgtttccaaatataagcatttctagattgtttagcaggaataaaggtttgagaaatgcttatattgcatacaaaatatgaattctagaatgcttatatttgggaatgtaacgattagctagtaggaatctaggcagggatcggaattttagatgaaaataaaatgagaactgagcaggaaagtgtatatgccttgtttcctggtagaccatgctacatgatttcttagtttcgtttaactttttgtatgtcttttttttctctagaatttggatgtttccttagcatgaaaataagaagttcattgacaaagcaattagattgaccaaaacctgccagtatttagaatggtgtctccaggttctctggagcaaggaagagaatggagctaatatgcatcaataccagagtaagtttactaaccatttttactggctcttgaatgatgtcgtagtaacaatggctatagtatcttgtctccatccaaaactgacaaaatgaacgaacatgaataaaacataaataaatataatagaaccaataggcaaattgtgagaagtgcgcatttcaataccagatcacgatcttccatccatctacagaatgctccatcaacaacctgaaacaaaccaataaatgacaatataaggacttgtttcacaaggaaaatctactagttcaaggagatgacttatcctaccacagagaaagcatcatcccaagtgctatccttcatatttaacatttcccgataatcctgatatttaacacattgaatcaggtttcactattttagttaacagacaaacgatggtgaggcatgagaaaagatcagaccataattccacgaataacataatattttggaaggtgaatcccagcaaagacatgctcattgaattcgtccacaagttctgaaaagtgttcgttttcctataaatgcaagcacacaaaaaataaaacatagaattaggtaaagcatttattgattttgcatgcactataaagcaaaagtaaaacactatttagtgccataagtacccattcaatagaatcatcatccacactgaagaaaccttctgcctcaagctcacatatcaaactttcaagtctatctctatgctgaaaatttatacaatcacaattagctagtaatgagaccatatccaagcttatatatttgccacttcagatagggtgctatagcatgttaaatacatatagtgatacaaattaccttcactccgtgattaagtaacatcaagaatgtagtaatttgagggaaaaaaaacttgagataattttagtgaacattaaggacaagcaagacagaacagatagatcacatacctgtaaatttatgacagcacttttcatgtgtttgcaatataagcataattgatcttgcttactgagaagtttagctcgtcgctgtaagagggcactaacatgtaagggacagttctcatgaaaatacttttgaaataatttgtgaaaaatgaaaatacgtcaagaaaatagtacctcatatgacaatttcaggagatcgtaatccagatctgtaaactgactacgcaaaatatcatcatcaagaataatcttaatgaaatcatcctgaaaatcattggtacaacaaataacaaacagttgagcagaatgtgtagtcctgtttttgcacgtacagtaagtttatgatatttccctacctttgaagaactagtccgacggacaaaatcatctaatgcaccagaagccaaatgtatatcaaatgcttcatgcaacctagtttgttcttttaccctgtcatactggtggagaaacaacactttcaggacaagaacggtggccaaactgaaacatcaagagcaagactaaactagtggctcattatttcaactttacatactatattttaataaagtatgttcttacaaaaccatggtcataccaaaagtaaattgaagaatcaatccaatggtttcggctaaaaaactaacatgtttgaatactgaaacatgtttgggtcttatataactgaagagggtatgttgtttgtaaaatggtaacaagggcatgcaaccaccaaattttgaaaaatttcaatgctttgaagtggggagttaacaagaatatacagtgaggagtcaaaccacttgcaaatgccttaatgctaacaaagaatatcaaatatgttcagatatctgccatgtaaagtgaggagttaacctagcgtctggttcaaattccatttgaaccattgtgtttcatacaagtttaacaaaacaagtcgtgaatgttttagagacatgataaagttctgtttattagctagcaaccacaaagatcagtatgcagctattaccaaattaggtaaaggcaacaatatcttacttgctagcagctccatttttttttagcaattgtacatatgactcagctacaaagtacaaaccttatgttgtgcattgctatctaacaaatccatacatgatttgctacttgctaagtaaacaagaactgaacatgctacttgaccatatggtgatttatggtgattttaaattatttgctacaaactatttcatagcaaataacatcgaagctactgctatgatcgtcttaatgcttctagagaagccagcaacaacaacaataaaatgcctagcagctaggagctagtagcataacaatatatgcaagggagtgaatagcatctaggcagaattgttaattttgcgatgaaaagcacaaatatgcttgacattagtattaataggattgtatagcataccccagaccttgcgttcttgacctcaatgtaattctgtgcataaggttgtagatgcagcaaaaagtcgcttgagacaggctggaaggactgcagagaagaacactagtttcaatgagtactcaagaacatgataactcaaaggtgaagcatagctgcacgaaatgaatatattcctgagaagatgaaaactgtaaagtatacctgaacatgatgaatatcttcccgagaagttaataggcaagctatttcacgtagcatttccttgtcatcctgcataatgagctcacatttaatttattaatttaaggaatatagaaaaaaacatgtaattttttgtaagttacctgacgtatcagaggatggaactgaggctcccaggaatctaatattctacagaagagctgaaagaggagtaatttggccaatattcaaaagagtgcatttaagcattagcatacatgttaaaatcctacctcaagtgtctcctgcctacaaaatccaggaagtgcagaccaaacctctgaatcgtcctccacaagttcttgcacgctctcatcataaccagaacactgcacaacatccaaatacatacacatcatggtgtttctgctaggtgtagtaccatcttaacttgctaagggtacaggacaatacacgtaccttaatatagggtttaaatgtgataagtttacaaaaaaacttgtatttttgttcagtctctctcttgcaatacactgaagttactttacgcttcagaaagagccaaaataaataatcagaatgtgcacgcatatactcacacacccacccacagatatacttgcaagcacatcaatatacttactgacagcatagttgacatggcccatgcatgagaaattgcacaacaatcagtatcatgcttggacacaaatttaataggagaactaagataacaatcctgcaaacaggtaaaaagattattaaattaaaaaaaggtaaacaaactatcatattgtacttcaatactctctttgtcagtaacacatacagagcaagtactaaacatatctcacaaaaataaaaatgtatatatatttacttcagacatatgcaactttcagattttacataataaatttctaatgcggaagtgaactatgattagtttattttcagacagagaaaacatgtgcataaattaaatttctaatgcggaagtgaactatgattagtttattttcagacatagagaaaacatgtgcataaattaaatttctaatgcgcaagtgaactatgattagtttattttcaaaattagtgcaatgcagtggcttttgtgcaacacagtggtttgaacattaagaaaatgaataattcaaaccattggagtatcttattttctgatgctagcatcttttatcacagtacgcagtgccgtatattgacaggtgcaacctgtgcatatgttcaggccccccaaaaaaaataggacccccaaatccacaattagtattatttatctatgcctaattagcaacaaattacagggaaacagataaaaaaataagccccaaaagaatacaaggcctaatcccatccctaatgcttatactatttgatactttgttttgttatcagctacaactttgccaactcctctttttttcctaataacaattactgatttctaaagtgtgaagttcgtccactctccgttgttcgcagaagcaacatggcagcaacactataatcaatcagcaatttcatatagtagcaatttcgtaataaaagagttataaaatctcgcagcaagcgtgcaag

SEQ ID NO: 59186 - DNA, 3240 bp, Oryza sativa
ttcgggcgcaccgagcggctgccgcgtggggcccggccgtcagccgcccgcgccctcgggtgcggctgacgcgtggggcccacggcaccggccggtgtgagcccgggtgcacccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaataaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtgggcactctactcatggtactactagtatgattttagttagatgcttcgccgcttaattaggcaacattaggtggttttacaactctagactttgggatattcatatcacctggacactatagaattgtcggattattgtggaattggattcacacctccccctctcttcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaataaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatatggtatagctctggaatcgtgtttacaaaatagctttgagcaactaagtgtcttttaatgctgtttacttcaaaccctaaccctttatattataacccccttgtactcccttgcatttatcttgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttacctcctggaacaaggaataatacacgcacgtaaggaacgcctgttgggttaattccggtcgtgacaaattttgacattataaatttttagcttgtcaataaagttaagcatggctacaatccaggtccatacttgagtagtacactacagtatcgtcacgactgaatttctagaaataaaatatacttcaacctcttgtggggcatctagaaagttcattaatgtcgccttccctccatgagaacacaccattccttgtatttatataggttccatgtattcttgatttggtttctggttagacttaaaaacgtttgtgttatcagttatcctcatcaaactaagcagtggcattgcttcattgtatccggagatatactgctaaaaatatgctagtagattggagaatacttcggattgaacgcctgatctgaatgaaaagatatcaggcgccctcccccacactcccggctgctacgggtgacctagatgctttgtatagtgctaatgcatgatgctcgatatattaacaatgtacatatgtactaattaatcatttttttatcttaaatcgtttatcctatcaacgatccgattacactagtgtattcctcacaattaaacatttacaacaagatctcacacgtttatattttgatgaaaaaaattgaacgttgtttcaccacatatagaaaataattgatcacttggtcaggtttttcaattcactgtataaaatatatcagagagatgcaacatttctcaaatactaactgcaacaccagcaaacattgtatgaaacattaagtttcaacgagtaaacacatggaaaaaacatataaaagatacaatatatcccaaaaactttatattgttaaaacatttttatatcatgttcgaaacattaagttttaaaatacttactgaaagattcctagtataccacatgtaacatttgcaaaataattagtgtagcatcatataaatattagttgaaacttttaacaaaaaccatgtgtatatttaaaaatatgcataaaaagctaaacaaaaacattgaaataaaaccatgtgtggtctgattgtaaagatttaattacaataaatttaatggtacaattggattattagttggagaagtaatttaagagaaaaagtagtttgaaatttgctaaaaaaaagacttaaaccaacttgtaactatcacggtttattcttgtacgttatgcgtgcatgtagactttgattatcagctgcatgcagcttacctagtcagctgcatgt

SEQ ID NO: 59187 - DNA, 7294 bp, Oryza sativa
ttagctgccttgttttcagtgaaccatgtcatataggagcactgccctgattgtgatttttaaaggcagcgccaccattcaagtaacatggcaacaacaacattctaaaaattcacatgagatgcacccgcgacaggttcccagtggatgcatgatgtattcgagagatgcactcacgacaggctctagtggatttatgatgtactcgttagcctgattctagttggaatagtgatgaatcaacggggctatttggtacagctccaactcctaaatattacttcaggagttgagtctggagtggagttgttgagctatctaaacccagctccacaactctagtatattttgtgagatagctccatccaactccactcccaattttggtggagctaaaactgtttggctgagctccagctccaggaggggtggagctggagctgtagctgtgccaaacaggcccaacatattaatccctagtatataatagcgcaataaatataaaagtgaagaatatactacaacctacttgtctatctgatcttcttttcctctctctccacacccttattttaattaactaactgatgccatgtgatgtcatgtaagtaaaaaagcactcctcatttaagctcgggaattaaatatatatggatggtaaccaattgtaactagtttatatttttgttttgttgcgggtaaccagtttttatagttagtggactaaaatcgaaggaccatagtcgacggatcaaatatgtacttttccaaaaaaaaaaatgtccggagaactgttaattgctgagatgcggaatattgcatcttgcttccttaatgatgtactgatacaagcaacttgatcatatgttagacatgaaaaattctagcaagtttcaaatatgataagcacaagttgagtggaaccaatacaatggagggctttttctcagaggatatgcatggataggaaggagatcctctggcgtagaggcttatatgttagagggacgtccaactttggatcgccgtttgtagcgcattcgactgcccataagtgcaacaaacagctacagcatgctcggtttctacccattcacagccgccgctcgtcatgttttcatctctcgctggtggaggacaatgtaagggtgaaaacgatcggaaacggtcggaatcgatagcatccctatggaaacgatcctcgatcggccggtaattgatcatatttatcattaaactcctcagtatcgacattaatatgatgaaaaaaattagaaaaaacaaaataaaaaatagctaaaaacggtacgatcggaaacggtaccctttaaatgaaaagggcgcccagtcgatggggaatcgccgaaggcacgggccgatcgacgggcggcatgcatgcgtttgccacccgctggcgcgtcgaacgctgttgttgatccgtgcggcgctcgctcactcgatcgggcgccggaatagacgggagggcacgtacggcagatcctagccgcccaatgcgatcggatttggtcattgccgcgtcatacgggccctataatcgagtggcgcatgacaaccaattaagatggcaagatgcaccccctttcatcactcttaacaatcaccattcaagtggcatatgttcaatcttattgagtttaacaaaaaagacacgctttgacgactatgcctggctagatgacccccataagataaaataacgacgactatccaaaataactgccacaaatccaaacagttgacatccacgtcaaaccggtgctgccctccctactactgtttgaaccataatcatctatacttaccatattttttttaagttcgcacatttagaagtttgaagaaacgtgtgcatgaaaatcgatagagtaaaagttaagaagatagtatagatcacaccctaaaagattatgtaccatgtaaactagcgaattaattttcgaactcaattttacatggagctagatttttttttgacattaacatatataatctttagattatacgcgcgcgcacacacaagtagttcttataaaacatatcttcaaagtataaatgaaattggtatatatatcttaattttctttcttcataaatagaatcatattattctttttttacccgttgcaacgcacgggtatttttctagtagagataaaaatttggaagcaatccaaacaaagcacctttgcaaaatttttggtaacatctaaatctcgctaataactgcacaaaataggcaaggcaaacaatattggcataaaaccaaacaaactgaatttgctgatctgcagccacaagcccaaacatcgcccactgcgcacgttactgcgacaacccgcatgctctccatgagatactgaacttccattacttgctcttgttcaaccgtgtggtattttgccatcatttgctttcagcgcctctccgctaactagcgggaccaacgattctatggctcgtctcctagcacgcgccatcgtgaaaagagcaagaggtgccgggttgtattatgaaacggtgctttcagtttcagctcccaataccttccatccctatactatttgtatgcatatcgccattgtgatcagggcgcctgtaatactctaacatatcggattgattgtcgatcaagatgctccatttcctcgtctatctctctctagtttctatatatgatcagctgtttgcgcgggtctctgagttctaattacacgaaggagagagatgcctatacatcgtttggctcgttgcttattaaggccattatgtgttctagtactaccgcttgcagtggtgtaaatatttatgcaacattcaagggtagctagctagctgggccgggcttccctccgccctatacaaaaagttaaactagaacatgatgtgatgatttctagcacgatgaatctgaatcgtagaaaacatcacatctgttctaggttggttttttatgggacggagagaatattttgcaacaatcgtgcatataaccgaatatctttctttatgtgaacagataagcatatatatggttcttctgttgtgtactaattcttttactatatatatatatagtgaatttctatgcaaaaatcatttttaaaaaacagagagaccaacatttaagacagggacaattttgtatttttcaagaaacatgccattccaaaggttgttgtgtaatgccagatatatatttaagagtagtgagcgtgtgggagctgatgatggaaatagcaaagcaaacccaatatatgtggcataaacttaaagtgacaaaatgtgatttacaatacgtctttcggagttgacaccaatatgacgcaaaattcataatggcaataacatcctactgttgaatgggctttacttcaagcttgggcatgatcgccaaactatttagctttgtcaaacagcttttttgcacatgttagatacacaaagtaaccagctggtcctggttcaatctagctagtcactgctacgaagaaaggtttttcgtggtgactaaaatcagtcctttctagtagttagactaaccgtctgcaactaacggtcaatgaaaatctaaggtcttcacaagcgagacttcaaccgctagtgacaattgattttcactggcggttgtgtcacgcgagccaccagtgataattcatttttcatatggctgtgttaagctggccgtcagggataatcgatttcacggcaaaaaaatattgaaaataccccatgcagctgccctctagctgcgagcaaaaatgaaaatgcctacataatgttgcccagcattcccaaatccatatccccaaatcccaaattcacatcaacgagcacaagttccacaaaaatggtttgattatgatcatagagcatggagcacaaatattccactaattcacatcacagtatacaaattccacatcatagattgatcacaaaactttcacatcacatcatagagcacgaggtcaggatggattcgtgctcccgaaggaggcgtggatggccggtgctggatctgatccccgcgccgctgccgcccccttcgccgcgtcgctcccgaggcccgcgggggtagatccactttcccgaggctcgtcagcaccggatccgctccttgtcaccccctttcccgtgcagctcacaaggcccgctggcgccggatccccacctcgctgccccgtgtcctgcggctctaccgtcaagaaccatcgatgcccctttccctgctttgttgccgctgcctccttccttgcgccgctgagccctttccgcgctgccgctctctcccttcccacccgcgagctgcagtagtagcgccctccccactcgtgagattcggcggtgtcctccccatccgcgagcatcaacggtgctggcgctggcaccatatataaccatatccaatgggctcgagctcaaggactgcatccggcaccacgctcgtcgccggagaagctccatccctcctctttctctgtattcactgtgttgttggatgttgatacatgaatgttaaaatgtgttcttggatgttaaatcaaaataaggggcaatggggtgatggaatctggtcggggtgaaggggagctactcgattcatcggctcgacttgagctgaccattctttttttctattactgatattttaaatgtgttggttcctaaacgggtatctttgagcccttctcaaaggggccgcttgctaggtgtcagttagaaaaatccggctcctatgtccgattaccaaccggcaacactcaacttttgtagtagtgcaaagaggtgtggtaaattgtggctcgctgcctatggaaaccacagaacacatttgaaaaaaacatactggtggcctggtgcaaagcttgcctctagatagacacggcaccgccacggatgcgtagagacacagcgatgagatgatactcacgtgtgacaatagatcgatcgatcaagagttcgccttgcaattacgtcaaaatccgcgctagctagaggccgtgtttagttccaaagttttttttcaaacttccagctttttcatcacatcaaaacttttctacacataaacttccaacttttccgtcacatcgttccaatttcaaccaaacattcaattttggtgtgaactaaacacagccagagctaaccagctgccccgattgccgcgatctcatcagggaacagcgccttgtcgctctcttgtatgttgtgtgatcaactcctataattggcagtgcatgtcggtgcaatcactctacctcctctattcaacgtgcaccgtgttcacgcgctcagtttacttatagcctcgctgcatcggtgctgcattctcctgattactcaatcctagctacatttatatataccggagtcgtggacacaaccgttactccaattagtacgcactcattcattttgcctctgatcaccttgttcgattatatttgtcgctgcagtttaacaagctagcccggcatgcccatgatggcacgattttgctgttgcttttaattaacaccaaaatagtctttgcttccactggcttcatcacctttaacaaagactccactgttttgtgattgaaccaacttgtctcggtccctggtgttaaatctccatccattaatcatataacttgtgtaatgggttactcgagcatcaggacctcttgctagagcaaacaactcttctgatgtatctggagatcctttggaatgtttctcaaatatctggaagaatgtttatacaggttacaaatagttgtaaaatctaaaaaaaaatacttttattatggcgtgtacatacatgattcttgaaccatacaaaaaattctttgtcatggcacttttccacacctttactgttctggatgctaagttggtctttgtgaatgctgcaagacatgtacatgtatgttaaattttgacagcatttacatattagaaaatgagagtaagtagtagttgtttactctgcgtattctgatatttcttcacaattctttagaacatatatccgagctttctccaactcattcatatccatctggcagtatttgttaccaaggagtggcctgccaatagtaccaaatatctgaaattttgtactgctgttgtcactctgcacgtcctcgtttcgacttggttgattgattcttgtttcaactccttgcaggtacatagaacaaaaatttacacattcttgcaaaatatatgcctcagctatcgatccttcagggcgagctttgttttttacaaaagacttcaaccttcgcaaaaacctttcaatgggatacatccaccgatactggacaggtccaccagtaatagcttcctgggctaaatggattggtagatgcaacattacatcaaagaatgaaggggggaaaatcatctctaacttacagagggtaacagcaattgatgatgcaagcttcttgagaatttcagtatctaatttcttggaacaaatttctctaaaaaagctacatagctcaattatagcctcacaaacatcagcaggcagaactccacgaatagaaagtggaaggtatctgtgtaaaaatacatgacaatcatgacactacatccctgatattttagcttttgttgcatccacatagtgtgaaatttttgaagagtatccatctggcacttttatttctctaaggaactcacaaaatgctttcttctcagctagtgtcattgtatagcatgcaggatgaaataagaacttcccatcaccagttggaggtgcatgaagttcaggctgtattttcatgagttccaaatcaaaccgggatttaatattgtcctttgtcttcccatctagatttaacaaggtacccacaatactatcgcaaacattcttttcaatgtgcatgacatctagattatgtcttatcgataacgtactccaatatggcagctggaaaaatatactttttttcttccaaactccatacaatgtgcttgagcgttttctcttattgttatgtttcccaaatttaacctgaatgcataaagtgatgtcaacaataatatactactcatattcttatactctataatgtaataccaaataaggcatagaatagcaaatagtataataatttactttcagatataccagataggatacaagcataaatatatcataattagtagagtacctgattgaaattttgatattgacgcataatgtcatctcctgacaacgcttttggggcgctacgtctttccttttggccatcagaagattttgcattgct

SEQ ID NO: 59188 - DNA, 5619 bp, Oryza sativa
gtcttcattagagttcacatgaaaaaattatgaattatttttaaatataaagtctttagaccgttctatttgacccagatgatattcaaatccaagtttagagaccggggtgacacaactgaacaagttggaggacctaaacgagtgatctgtaagtttagggaccgggatgacacaattgaacaagtttgaggacctgaacggtcaatttgcgagtttagggaccgcgatgacacaacagtacaagtttagggaccggtgatggactttactctatttttaatttcttctaggataatcggtttagtagtacacccccgtcccaaaatatagatattttcagcatagtgacttatctaaatttctacatatatcacctcttatcaaccaatcataaccattcttcattttttttttcatctactttcttttctcagtcagtcataatatttctacaaccattttactttcttaatacacgtgtccaccaaatactagcattttgggatggagaaagtaatatcgagtgatgtcggtcaacgccttgctgatgttcgctccaagcagaagaggaggaaaagtatatcatttttctcgcgcatgctttctaaaccggtaaatggtgtgttttctaaaaaaattctatagaaaaattgctttaaaaatcatataaattaactgtttaaatttaaaataattaatactcgattaatcgtacgctaatggtttacctcgttccatagccttggccactcttaaggttgagtttgattctacgttttctcaatttctactctctcggattctacatgtacatttctcaaactaaattgtatgcattttgcaaacaagttctatacaaaagttgttttgaacaataatactattccaattttaagtgttttttctaatacttaattaattatgtgttaataaatcgctcccttttacatgcatagatgattggaaaccacacatttattgaacacagcctctaagttgttgtttcaagggatagggtaggaaaaaattttcgtggcaactcctatgctaacaatcggactctgagctctataattttcatgtactaaaaatttcacatttaatatttttctaagaaatcaaaatgaggtgtgataaattcaatagcaacttacctagctctaattcggtggtaggcaatgcttaaagccatacttgtgtatgtcaaaggtccaacgagcactattgtacatggctgtatgagttatcaaacgttagcacataattattagcacatgcttaggttttttttttctttccgagcgactaggaattgggcgcttggtagattttaaaaaatagacactccactcctacccactttccctactaggtatgcatagctctaacatattagtctccctacgtcacgcatctgcacattgcatgcatgcaccaaagtatctctccctatctcttcctaattaaacattcttttataagctttaaactatttttctcttaaaccattgaacataccataaattaattattacactattataattattataattaaatatttatatctcacatgattatattttggatgaaaaaatatgtctaaataattaggcgttgtttaactacgattagaaagttgttccatcacttgataaaaatattttatttcactttacaaaatattttagagagatgcagcatttcaaatattgactgcaagaccaataactactatatgaaacatttagccactatataaaacattaaacattgagtcccaacaatgaaacaatcggaaaaataatatctaaaacatacaatatatttgtaacacttgataatatagtgaaacatttttacatcatgtatgaaaacattagattctaactattgaaacaccataaaatacttgctgaaacatccaaataaaaccatatgcaacacttaaaataatacattaagaaaagctaaatatttttttatcaaaatataaccatgtgtggtcttgtttcaaagatttaattacaacaaatttaatggaccaaacggatcttagattatagaagtaagttaagagaaaaaatagtttgaaatttatcaaaaaggtggttatatatatatggggggaatatgaagggagagaaggaatattgggagagcttacggctcggacgtccggcatcacaccaaaaatcgaacgtctagccaggcaacgagcgcatgtgagaacgaaccctgtcactgtaacgtatgtgcctagctgtttcttttcattctttcctcctctctttaaatatttttttctcttaaattacttatccgatctacgatccgataacaccgttgtattcgttgaaattaaatctttacaataagataccacatgattatattacgtcaaaagaaaaacatgtgtttcaaaccgttagaataaaatgtttcatacgtgatagtgatatgtttcaatatgtgtcttcggtgtgtttcacaaaaatcctgaaactacctgctactactctctctccacctcatgcatgcatacatgcatgtattttagcaagcttcaaaatgatttttcttttaaattacttattcgatcaatgatccgaccacaccattgtattcgttgtaattaaatctttacaacaagatatcgcatgattatattttgataaaagaaaaatatatgttttaatccgttaatacttgttgttttatatgtgacagcgacatgtttcaacgtgtatcttcaccatgtttcataaaatatttaaatgtttcaattgctgattttttttcaccatatataacttaatgtttcacttattggtcaacgctcgcccccgcactgccgctcgcccacgttgctcccgtgccgcgttgcttgcctgcactgcatgtgttgcttgcgctgctgcttgcatactctctctccctctccctcctaatacacgtgcctaatttttcctcaaattttaaatatttttctccaaaattatatatctgatctaaatttcaattataccattaaatttttgcacaaatacttaattatgttgaaatatttttaaatcggacgctacaaatcgtacgtacaatatttttttcaaatatcgaagctgctcctcgtctgtatgcagggacgcgttggagaagcgaggttgtcgcacgcatgcatgcaggagtagagctggttgccaaggtggcctgaggcaccattactttctctctctcttaatcaaactttaaacaaaattttaatctaaaatatatatccaatctataatttataacaagatctcacatgaatatattttgataaaaatatatatgtgctctagaaaaaacaaacttatgttgaactatttaaaaataattctttcatcacttgtggagatgtttcaacccacttcacaaattattccaaagaggtacaacatataaaaagtattgactgcaacaataatcattattacttgaaatattaagtcccgactagtgaaacatttttttatatttagattgaaacatcgaattataattattgttgaaacataaaaaatgtatttgctgaaacatataaaaaaagatagcatgaaatattgctaatgcattagtgaaatatcaacaaagtcttgttggaacatttcagtaacaatgtgtgcaacatttaaaaagtaaaataaaaagtcatcggaatgtagtcatgtgatatcttgttataaagatttaattgtaacgaatccaatgatataattagtttgaaattcggataaatagtttaagagaaaaaatcatttaaattttgaaacatgtttgcatgcatgctccgttggcttgtcagtacacctaaccaattatttcaccatgcacctacactgttgttcttttagattgagacgtccgattttttattcctagccgaacggccaatggtaagtatttccgggaatattgcacactgtacaattgtagtgctagggggcaacatgcagagaatgtatgcagcagtaattataacgaatacaacggcataattatatcataaatcgaataagtagtttaggtaaaatattattttgaaaattggaacaaagtttttttatcacttgggagagagtaagcattcctaacatgtattgatgcttgctgtattgggcattcggatttttttacctcaagctggaggtctgaggagaagacttctccgctatacagtatacactactgcaattttcttttgtctttgacaagaaactagactagcaacacgttgagtgattccctttgagagaaataagattacgaactttctagatggcaaagatattagaactcctcgttatggtattatctttccatcgagaaacttcgtggcggcgctgccgctcatgttcagatggcttttaactactgcagcatgatactaccctctaaaaagcaatggttgtcgtatatcagaaggatatatatatagggggtgtttggttcaatacctaaaacaatcataaaaatgtttggtttattgcatggaaaaacaaaatattttggcgagactagacaaaaattaacttggccaaaatcttaatatcaaaccaaacgacaaactttgctaaaattttcacattataaaatttttaacttgccaataaagttaagaatggctacaatctaggtccatactcgagtagtacactgcactgtcgtcacgactgaatttctagaaagaaaatataaatcaaccacctcttgtggagcatccagaaagttcattgctgtcatcttcctcgatgagaacacaccattccttgtatttattataggttccacgtattattggtttggttttttttgttagatgtaaagacgtttgtgttattggttatcctcacaaactaagcagtagcaattcttcattgtatctggacatatataggcacatttttttaaggatcacccgatcaagatatattgctaaaaatatgctagtatattggagaatacttctgatggaacgtccgatccgaacgaaaagatattgggtgctctcccccacactcccagctgctacgggtgacctggccgctttgtatagtgctaatgtatgatgctcggtatattaacaatgtacgtatgtactaattaatcatttttctatattaaatcatttatcctatcaacgatccgattacaccagtgtattccttacaattaaacatttaattttaaattgtttatatgtgactggccaaaatcttaatatcaaaccaaacaacaaactttgctaaaattttcacattataaaatttttaacttgccaataaagttaagaatggctacaatctaggtccatactcgagcagtacactgcagtgtcgtcacgactgaatttctagaaagaaaatatacatcaacaacctcttgtgaaacatccagaaagttcattactgtcgtcttcctcgatgacaacacactattccttgtatttattataggttccacgtattcttggtttggttttttgttagatgtaaagacgtttgtgttatcggttatcctcatcaaactaagcagtagcaatgcttgattgtatctggacatatatatgcacat

SEQ ID NO: 59189 - DNA, 1426 bp, Oryza sativa
atcttagggaattttgcctacagaatgatagtagatcatacgaacaaacaatgtacaaaatcatgacagcaaaaagaaaacaaaaatgtacaaatgaaatatactccaaccagatgacataccttcaataaattccaaattgatgacatggttccaggaaaagctttttcaatgactttccacttcttcaccttaagggggacctcttgtcgcacacagacagtgacctcacttttaaagacacttgtgtgcctaccacagacttttccaaactgtgcagcaaattgaatgtctagcggcacaccccttgctctcagttttgcaagtgttccattaatggtgagacccctacctttcctacgtttgagacctaattgaaggaagaacttttaatttatttgcttgtgaaggaatagattaatgaagtgaaggtaaatatgttaaatacctgtgtttccggttggtcccatccgtccctcattcctagtattgggtatgacttgtcgagtagcatcatccgaagtctccatctggttcacggacggacgaacttgggaaaccattttgacctacaaaataagaaatgagtacaaacagatctactacaagattacaaaccaaattgactaagatagaaatccccacaaaacaccgatatactattagattgagaaccaaattaactaagaaagagaatcccaattaaaaatggatattaagttgcatctaattaggaaattaacacaaatcataaatgcggaaaaacaagacggagagagtggacgccagaaggggcaggtcatatccctgcgacgccacgctatcatcaataggactgcagtgatttggagatgatggttgtgtgattgtgtcctggcagtggtgggtgtaatctctcaaagatggatgtactctagggctatgcagtgaataaaaattggggaatgccgaatggatcctataggattgcgaggatagcaaagagccatagtatatttgtttctttacctttgactgcaagtgtgtgcagggatcgagaactctagatgcgaatggattgtactatatgggcagccttatatagcgaggtaactctgtcaatttggcgggagtaaaattttgctggcaattactttttgagggaaagtatgttttgctggccgatttatgcgtgcgtgcataacaaattagtttgtttgtgctgatccaaaatatttgttcaccagcatttgttaacaacctctcataaacaaatatggcaattgtttaatgaatcaataacctgtggagtgaaaaaaaatgatacacacatgcacattaattgttgatgtgggttggcaccagccacgtgtacctagagatggacacgtttagtgttgcacacatgctcagctgtaatttatccctttcataatccaggcttcag

SEQ ID NO: 59190 - DNA, 7147 bp, Oryza sativa
agcttcacccaactccactcccagttttggtggagctgaaactgtttggctgactccagctccaggaggggtggagctggagctgtgccaaacaggccctaaacgggctcttagtgatggagaatcgaaattgtgccacggggtacttacaggcgcacaacggtagcccccattccgcacactgttttttactatatatatatacattaaagttatgttaatttatagagaattgacatatatattatatactacctccgttttttaatagatgacgccgttgactttttctcacatgtttgaccattcgtcttattcaaaaattttacgtaattataatttattttggtatgatttgttttatcattcatagtattttaagggggaattaatttcctatcctttggcttaaaattttggattaaaacaaatggtcaaacattggaaaaaaagcaccggcgtcatctattaaaaaacggagggagtatattatagttataatgtaattacattgtatacaatcgtattgtagttacgttcaaaagtttaaagagagttttttttaactgtatagctagtctccaattagggaaccacgttagacgatttgccaggatcagacagtattgtaccttacaattgagatcaaacaagttgcacatatattatgcacatccctgattatattaattacttgctgataccaaacaaatagacacacacacacaaattaaacttgtgagtaaaagctaatgcatcaaagaaaaccattattctgcagacaaactgacatgacaggaaatcatatgcaacaacaccaaacgtactaaccaaacgaaccatgcatgcatgcaaacttccattgcttaattcgccggagggctagggttgtggtactctggcgcaggctgcggcttgggctcgggcttaggctcaggcttgggtggcacgggcttcttgtggaagtggtcgaagaagtgcttctccttcttgtggatgtggtcgaggaatgggtgctccggctcaggcttgggcttgggtggctccggctttggctccggcttgggtggcaccggcttcttgtggaagtggtctatgatcttcttcttgattgggccgcagatggtcacggacgcgcacaacgccgatcggtagtgggtcttgccggcgacggcagcaaaggtgccctccgacattggcacgatcttggatggctcctggccggggcatggctcgttggtggcgctgtggagctgagcgatgcagtcggagctgtggaggtcggcgtcaagggggacgctgaaggcaccggtgccgtcgagctttccagtggccttgctctcgtactcgccgttgccgttcttgcacttaatcgccacctggaggtctgcacaaaagaattccaaataatattgtcaatcacttgtaatcaactgtatcttcctctcgatcgacgatgtaaatcagctcaatgatcaattccaaataaattgttacgtactcttgaaagcatcctcagctttcatgttcttccgggtgcagtcggcgcacttggccgtgccgacgaccaccgacgccgcctctccgccgacggcgaccgccatcaagacggcacaaacgccgaggagaactagtcctcgaggagcacctgccattgctgatcagctaatcctagatagctctgtgtagctaaatattgctgatgtgtagagatggatgaagtgaaaggtgaggcaacgcgtggtttatataggcatcgatgaatacaaacacagcttgcttgcattattgatacatcaatcgatggatcgaccagctagctatgagcaatgcaaaaagggccaatttggcgccgaatttgcagatgggcgaattaaggccgtccaaactgaatgatttgatcacgtacgtccaatatagtcgcctctgcagctttacctacgacatcataataatctatcgatcggttggtacgtatacgtaggatctacgcaccgctttatgcatgaatgaatcataacaataattaagtacaataatcgaactgggtcttaactccttgtaaactgcggttgacctctgtttcagcagtgagttacagtgatcggctacttattgcaacactttccaaatgtactgcattcatatcgtgctacattcgtccaaaagacaatatatatataagcaaattgtccctatatataatcatagcattcaaattttgttctgaaaagaatgtaattctaaattactactaccactactacaaagatagattctcctggacaccgcccccttttgttttcatgcggtctgtaagtggaaccgcacggaaaaatagggggaccggcgccgggttctcgcccgcatggaaaaatgcattttcccgtgcgggcgtcttaatccgaacgcacgggataattgtcattatcccgtgtggtcgacttaagatgaccgtatagaaaaatcgattttcgcatgcgggctttttaagtggaccacacaggaaaatacctcccacctttccctcccacccacttcaaatttttcacatcctctcccttcctttttcccttttattctccatcaaccacccccctctctctctaccttatctcctttctcagccttcccggcttcccacctcctccccaccttcccggcttcccctcctcctccccctcccctcctccgtcaacagcgggcgtcggtggcggccccttccactcgtcctccccctcccctactccccttcccctctgtcaggccgacgatggcggtggccgggtgaggcggcgaccgagcgaggtcctgagcagcgaggcggaggcgtcgtcgtccgttcgtctattcctccgtccaaagataaccatggtgggaccctcctcctggtcgtcatcctcgtcgtgcacgttgtcgctcgggtccctcgacgacgatgccgtcgtcacgtgcgtcatcaaggcagcggcggagagcaggtggcggcgagcgggtggcccctttccacggtcgtcgtcctcgtcgtgcctccctttccacggtacaccagcgaagcagcggtgagcgggcggcccctgcccggatttggcgcgactgtggcggcggcgggtgggctcgacggcgatgacggtggcgggctcggcgacggccgggtgcgtgcggtccggcgggcggcggcgattttcgctttttttaaaaaaaattttggttttttcggttctgtgcaggcggtataatttgaccacacgggataatcgattatctcgtgcggtccacttaacacgaccgcacgggaaattgattatcccgtgcggtagagctgcccgcacgcgaaaatattgatttttcaagacacttgggtgcagacgggcaaatcctctgcacgggaaaatcatttcgaccgcatggaaaaatgttttttgtagtagtgtacatccgtcccaaaatataaaggtggaattaaagtgagaagatttgaatggtgaaaaatcatgattgaagcagggtaaagtggaattaaagatgaaggatgcaatacatttagaaagtacaacatgccaatattgcaatacatttagaaagcacaaccacactattattacaaccacatgcaaaaaattacaaaatgataaaagggacctaacaaagctagaataactcaaacactaaacatcctattattggacggccaacaattatttaagataaaaaaagtgcacctttatgatggttgtattaccactatcagtattatcactagtagatcgaagtgagatctcaaaccttgatttatcattactacaattaataaaaaaattctagtaccaatagtggcagtagtataaatagatacgagaaccattaaattaaaaaagatgaaaggcctatattgatctgtactaagagtaagactattgtaaaacatctcgctgtctagcttcaaggctcacaccaattatcatatgctgcaactttctcaagctgaagaataacgttttcctcacaccaattatcatatgctgcaactttctcaagccgaagaacaacgttttcctttgggagggcataaaatcgttttctttttgttgggaggacgaacatgcggataattcaatttagggccaagagcctacatatatgtactgagatgggccaaggaagaaaaagagcctactattcgttaattgaaattttctttgctcggtacgtccacttgtatttcgctgatggtttttggctgtcaaggctagttgagttcatggtagtgcaagtcacgcgcactttacaaggacgaaaaaaagatgctatcacattactcctaattaatcacaatgcattcatgtggacaccgcatagaaaggtgtatgcatcctgcgtataggtaccaaccggctgaagaaccgcgtcgtacctaggcaacgtcgtgatcgaatgtgacaaggatccagattggacgtacgtgatcaaaatcattcagtttggacggccttaattcgtagcatctgcaaattcggcgccaacttacagccgctttgctgatcatcgaccgatcgatcggtcgagctgtattcaactattgatcgatcatcgatgatgatcgatgagcacgagaggctaagcctatataaatcgcgcgttacctgtctttctcttcatccattcagagttagcaagctcttctaattcatatatagaactcagaatggcaggtgctcctcgaggactagttctcctcggcgtttgcgccgtcctgatggtgctcgccgtcagtggcgaagcggcgtcggtcgtcatcggcacggccaagtgcgccgactgcacccggaagaacatgaaagccgaggatgctttcaagagtatgtagcagtttaccttacatgcagcttagctacgttatacttcctccgttcccaaataattttatttttcacacgttccacacataccaatgcaaaacaaaagaaaactagaattctaaaatcatttgtggatttctttgtgcagatctccaggtggcgatcaagtgcaagaacggcaatggcgagtacgagagcaaggccgctggaaagcttgacggctccggcgctttcagcgtccctctcgacaccgaccttcacagctctgactgcattgcccagctccacagcgcaaccaacgagccatgccccgggcaagagccatccaagatcgtgccattgtcggagggcacctttgtcaccgtcgctggcaagaccagctatccgtcggctttgtgtgcgtcggcgaccatctgcggccccatcaagaagaagatcatcgaccacttccataagaagccggtgccaccgaagccggatcccaagccagagccgcccaagccgaagccagagccagagcaccccatcctcgaccacttccacaagaaggagaaggacttctttgaccacttccacaagaagcccgtaccacccaagcctgagccaaagtcggaacccaagccacagcccaagccacagccagcgcctgagtaccacaaccctagcccaccagcgaagcactaaacattatctacgtttggtcttgtatgatttcgtgccatatcagtgtgtccgcagaataacgctttctacccccgtgtgagattatacattgaaatataatgtacttgctagctttcatccgcaggagttttttttttaaagtgtgaccgggttcatttattggatatcgcatgcatattagcagggcacgatgtgtactgtaatatctgcctgttgtttttatttctctacctaaatgaagttaaccacaaaggacaaacataaattcacatgaaatattgactctggattcgctgtgcacgtttatgaatttattggccatctagcgagaataagcagtgcgagtgtgctgtccttgatctccagccttaaatggggaaagcattgattcaaacgtactagcctacctgtaaattaaagtggcgtgcatggaatttaaatatattttaaattaattatatgctcatgcattaattatagctagaaaaatgggccaaaatcaattgttaataagtgaaaattattgcagttcgatcgggaaaaaatttaaaaactgggtgatttgatgatttttcactcttttgattgggaatttgaagatcgatttaccataacacatcattgactcaaagggtcatatgtgccatcaaatttgccgaaacagttctctcatatgatgggggatcactatcatacatactagacgacattctatgttttactacacgatatatagatgaataccaaatgaatatatgttaaatattataaaaatgataaatagatttggtttgagttgaaataatgggagaaatgataatttagcgagcttgtatatatgctgaggtttagaatgtaatgaattttagcatacttgcaagttgagttttatgtgtttaatgggacactatggtatgcttagtatgcttccttgttaagctttagttgctttcttgcttagtgggttgtaactatatacagaaggtatatatgtctgtgaagttgaaggcacacttcgatttcaattggaagatgacacattgacaaacaggcaacattacagtgcagaaaaaaaaatcaaattaacttcaatatgtgaattttgcaatttatgaatgtcttatcttccaaacgaaaaataaagtacatatgtattgaatttacttctttagttgtatgataggatctcgtctacacctgggaatttttgtgaatcgtttcaaaaggctgcccagagtctatgaagtagctaattaatttccacgatttcacacaaccagtggtttaattcacctgatattgcccaaattaataacatcaattaggatccttcaaattaaaataaatatatatacctgctgtcaaggaaagcctattcattaattcttttggtttaaatatttagtatatgttggaaattttctatcttttaagaactaagactagataacaagaattaaaaaaaggcaaaattggttatatagtatcgaaagttcacgtttttggttttatagcactgaaagataccggttcactttaatagcacctaaagttcaccctgttcctatttttaacactttcgtcaatcctcgatcgttttccgt

SEQ ID NO: 59191 - DNA, 1097 bp, Oryza sativa
tgccccagccgcgccgcctcgtggccgtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccattttctttgtaaaaataaataataattgcgcaataattcgataataattatagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcgcacatttccccttgagcatgttgatcctaatttataaatgttttaccgtttgcaaataaatatgcatgttttgctaattacatgggatcagggtttacctatctgctcgcttgtgccatgtttacttgatatctgtcctttgtcaaccttgggtgataaatcgactagcttgtgttacttatgtgacctagctagaactttatgcttagccatgcttaattaccactagctcagtcgatgggataattgcagtattagacattctagtatcttgttgagctgcgtgctcgagacatctggccatgttacatggtcataattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggg

SEQ ID NO: 59192 - DNA, 24438 bp, Oryza sativa
tgaccatcatccgtgacgtgcaccaacttgaggcccgtttgagataacaactaggcccgtcacaaggcccgtcacagatgactcattagtgacgggctatatacttaatctctatcgggcattaactaaagcccgtcaccgatgactatttttctatttttcatatgaaatgtttatatttgtaagttgactatagcaaaataattaagtgtagtataataattcattttatgagtcaaaataattttacgggtagtaaatgatttcaaatggaaaaaatttcaacaacaaagttatataacttatcaagatttacaacttttagtttggtcatttttcaatataatattttttttgaacagtttgaatttgaatttaaaaatatgacaacttcaaacaacattttcaaatactaaatgatttcaattgaaaaagtcatcaacaacaaagttgaataactcatcaatacctaaaacttttatttttgttatttcttcatccgacaaaatgttagtaatattattcacaaattttacatatatgtgttatagtttataaaagaatcagataagagatatgtcaattttgtgaacaatgttactatcactttgttgtatgaagaaatgaccaaaataaaagttttagatcctgatgagttattcaactttgttgttgatgactttttaagttgatatcatatagtatttgaaaatgctgtttgaagttgtcatattttcaaattcaaattcaaatggttcaaaaaatgttatatagaaaaatgaccaaaataaaagttatagattttgatgagttatacacctttgttgttgatggctttttcagttgaagtcgttcactgatctaaaattctatttgaacttttcaaactttgaatttcaaatttcaaattgtttaaatagagtcagatggagaaatgaccaaaataaaaattttgcacctcgatgagttttacaactttggttttggtgacttttccatttgaaatcatttaataaccccaatttgatatcctggcatagggcttaataggattaatagaatactcataccaataagttacaactacttttccggaagccaatctccaaagaactttgatgttaagcttgcttgaactttgatgttaagcttgcttggtctggaacaatttggggatgggtgaccgacctttgatgttaagcgtgcttagtctagagcaatttcgggatgggtgaccgaccgagaagtttgcacttcccacgagtgagggctagccaaaaataaaatgtatttatttttggattatactcatctgtaacgggcattaactatcatctgtgatgggctataattagtgcccgtcatagataagggtcatctgtgatgggcgctagttgtggcccgattgagataggtcatctgtgacgggctatagtttgactggtcgtctgggtcaaagctatcggtgacgggctttacttaggtcccgattgagatagattcatccgtaacggccgtttgcccgattgagataactcttcacatcagtgacttctagcctgtgacggacgtcatgcccgattgagaaggggcttaccgcccgattgagatgagggtatccgttctagtgaatgttgatgtattgaagtatgaattattatatgtaattgtgctcgatgaaaaatgatggacatgtgccctttctgctttgcagttttactagttatgctaaatgttgatgtattgaagtatggattattataatgaacctatgtactttaattacaacctattgttgatcagttcgaagttggaatataggttgatcagttcgaagttggaaacctggaacctgtgtggttgtgttcaatcatggacttttggtaaattatttatccaaatgatgtgtaacaactgtctctacagaaccacgcagtctaggccatccgatggatggacgacccacttacacataccacctcacttacggttccgttattgtttcgtgtaaaggggtaaacccgagagtgatatggctagagcgacaaacccttataagttggttttacccttactaaactagtaatgtggtagtaatgtggtagtaaacatacacatagctctcatggataacatagggtatatcctaattggccctgtatgtcacatacttctcccctcagaggacccgatgtccccatcaatccaacctacctatgtgaatttaggtgcagttttttaaataattatatacaagttatatgaaagttataatgtagttatagtattgttacggtgtaattgtatgtaaccacaatgtaactatatcctaactattgtataattgtaatgtagttacactatacctggtaaaaaaaatgtagttacactataactatgaatctctatataattaacttgtatgtgaatttacatgtttttttaatacttatagacaagttatatgaaagttataatatagttatagtattgttatggtgtaactgtgtttcaattatatgttatagatacatttgaaactttttcacttaaaaaacttgtgtcccttctttcaacaaccacttagatacggctggtttttgccataattcttttatttattagtataattttgatctcataatttacaagatcattattatactaataaatagaaacatatggttaaaggcgtatctcttaaagagatattaaatatctataacataattttttttgtttgtagaaaacaaactagcctaacatcacatctatatgtacagacaaaacctggtaatatatataataatggtccaaaagccaaatgaaaacaaacagattaagaacaattcaatcatgcagtactttggctgtgcaggcagcaagctattactatttccctttttcataaaaacaaactagtactacagtactagctttgcattcacctaactagagacaggcgagtacttaattaaagctttacctttgcttgctaaacaccaccaatgggaagcattacgtacacagtgcccgtgtgcatgcatgctactcttcttaatcgatcgatgcagctaagctggttcctgatcaaaatcatcaaataatgtacggcgttaattaattcattttaaaccagcaaattcggcgccaaatgctaattgtgtactagtatccagcttctgctcgatcgatcttcgtctgcatgatcatatataaacgcatggttgatctgcttcttgctcatccactgatcagcaacgagtagaagcggtagagtttgctaggatcgattcagcaatggcagcggtagcacgagcactagtcctcggcgccgtcgtcgtctgcgccgccgtcgtgatggctgtcaccgccgcggcggacggcgaggcggcggcggcggtcgtcgtcggcttggccaagtgcggtggctgctccaggaagaacatgaaggcgcaggatgctttcaagggtatatatatcataatgatgatgataaattgataatatgttcatcgataattaattgcgatcgatatatcaccgtcgtcgattaattgtttggtgatgttcaggtctccaggtggcgatcaagtgcaggaacggcgacggcgagtacgagagcaaggccgtcggcgacctcgacggcgacggcgccttcagcgtgcccctcgccgccgacgacctccacggcgccgccgactgctttgcgcagctgcacagcgcggagagcagcacgccgtgccccgggcaggagccgtccaagatcgtgccgctgtcgtcaacaacggacaacggcggtgataaggctaacaccttcgtcgccgtcgccggcaagaggatgcgctactcgtcgtcggcggagtgcaactcggcgttcctgtgccccttcttcgactacttccacaagagaccccaaggccccaagccgacgccgttgccgaagccgacgccggcgaacggtggtggcgcggcgaacggtggcggagctgcggcgccgtctcccagccctccggccggcatatcacagctgaattaattaattcgtccattccatcaatatcgacacttgcttttttgtttgatttcatggcatggttaattcttttggttcttgcatggttgatttcccaggtcagcttgttggtgcagaataaatgaaagttgtgagatgtgagaggagtactgtgactgtgtgagagatcgatcgatggatttatgtgagaacgatgtatgtgttgtatctctattgtttggcatatctaatgtgttattcgttgtatgcatgtaagctattgactgtgctttcgtccacttcgcacatacaaaaagttgaaattaaactcggtattgctagtcaatgggcatctatccttataaactactactccagctagtttggtgaggtggcgtattattgcttgctacagtgctgctaattgctttgctcgatgtactgctgctgctcactaattggcccaagctagcccaaagcctggctactctatttgttagggagtaaagtacactttgactccctcaagtataggtaatccgatttgtattcctaaaacacaatagcagacgtcttgactctttacctattaaaactagtgtaatttaactccctcgataattttgagagccgttattgctgacgtggcatgttgacctagtccaacaaattaagttagcatgtggggcccacatgtcagtgacccttctatttcttctcttcctttaccactcctctccctctccaatatttcctctcggtggcagaatgccaacagtgcagtggtgggatgtagtagggcgacggaaggtggtagatgagcggtagtactccaagcaccactccccgacgagccactactaccaactctaccaccagagctcgccgccagcaaggttgcgccgtcatggagctcgacgctgaggcacctacggcggtcgaggacatggagcgggaggcgaaaggaaggaggggtgatacaggtgcttctcatccacctactagtgagtcccgactctcttccttgacccatcctcaatcctcatcaccggcgttgttcatctccgcttagctagcatgagcaccgtcagccctgccgcatcttcactgtgctctcccctttcttttccgccaccgttcctataagcactactagaaaaatgatttttcatgcggttggcatattattttagccggcggccatacgcgaaaaccgacagcaaaaatatatcgaggagtggggagccatggaccgccagcgaaaaccgactttcgttggcggccacgctaagaggtccgccataaaaaaaactctatttttcgaggcggacctcttaggtgtccgccagcgaaaacgtgattttcggcaggtagcgaagaccgcttcaaaaaaaattgaggccaataaaaatccaccgcccgcgctgagtactccgtccttatccttctcctcccccttctcctccctcccttctcccttctcctccctccctaccgccggctcccgtcgccacagctccgccgcctcactgctcaacggggagggcctcgggagcggcggcggggcacggcctccacctctccgccgcgggccacgcgacgacgagggaggccggatccggccgccgcgacgacgggggaggccggatcagcctcctcgacgacggggcaggccggcgggcgacgacgacgaaggggcctgacggcggcggttgggggaggccggatccgcctcctcgacgacgggggaggccggcgggcgacgacgacgaaggggcctggaggtggcggctgggggaggcctgatccgtagctgccacgacaggggaggccggatccggccgccgcgacgacgggggtggccggatctgctgccgacaccgacacggcggcgggggagggggcggcggggagcggatccggcgcctcctccctccccacggcggcagtgaggtggcgacgacaagagaccggcgacggcacgaattttttttttttgcatgtttcctgatgaatgttgtgatgtttgatttgtgtacatttgttctgtgcatgttgtgatgtttgatctgtgtacatttgtgctaatgataattttgtattgtgtttgaatttggaaatgagtagccaaatggatttttgctggcctttgctttgtgacgactgcaaattccgccagcgaaaatccaaaatggccgccactaaaaagttttcgtagtagtgtagtaaagtcatagcaatgacgaggagcgtggccactccatgacgctctctatcttttccttcccgagccacgtgggcgcccggtggcaaattaaagcttggcccaagcggtgaggcggtgcgtgcagaggaggcacttggcgatgtctgccatccatctccttcattgatgtcgccttgcttttgctagctgccatctgttgaaaagacggtggggaatcctatcggcttctcctaactgccgcataagggaggagtggagaaataaacagagaagagcgaaggaggaaaaggaagggacaactggcgggcctcacatgcggacttagtcggttagactaggttaatgtgccacatgagaaaaactactctcaaaaccaagtgaaattacaccaattttaatagttggggtgttaagatatctaatattacattttaaggatacaaattagattggacctatatttagggagtcaaagtggacttgtttcattcgctgccctacaactgctactgcatgcacgttagctagcttctcaacacaaagcaacccaagacccgattatcttaacgtggcccaactcctgctcttcttccttttcttttctcaattatttcagggtcacatagtacctctccatttaaaaaaaccacccctcccaacatcagtgttttttttagcgaaaatcggtccactaggaaaagccgaataatttctatactgatactagtataataggagtcatatcctcctctttccctcaccatagtatatacctcctcctagtgtacgaactcggcgattaggagcgatggccgctttgatttgtggagaaggagatttaaggagaggagaatgagtgattttttttggaagagtttggggcttctgtttgggaccaaaagctcaacatgcattgagacacatcaccctttaaaacttaaccattggatcatttttgaaacgcacatgtagttcatgacatccgttggattgtttagaacagaaatgactatctcttcctgtaactgagaaattaaagtctttacttatttctattcatgactttaatatgttagcttttcatgcatgtgtcaatttatttgataaccatagtccacaaaggttaagacattcattacaaatgtatcatactattgttataggttcaatttgaattggtaaaatatattattgtgattagaatggcaccaacaatatttaacaatgttctcataatattaaagcgttagcgtaactatttatataggattggaagtagtacgggacaactgttgggctataatttcccttttttttaaaatatatcagggagtaattatatttatggcgcccataaatatatatataggctaatgttacaaacaaattcccattttttcccctcagctttgggctgaattccaccgaggcagcccagcccactccagaacgccagccagcctgcctgccacatggggcccatttctcagatcacctcgtccacctcgcgcctctccaacgccgccgccgccgccaccgccaaccgccgcacaccatggccctcgcgtgtgcgtctcatttgcgccgcctcggagccggagctccggcgagatccttccacgcgcatccgtaccaaggtgggtataccccctccccgattttcttccgtgctttcttttcttggtgattgaattggatttggagcgtgattcctgcgcggcagccaaggtcggcgtggtggagttcctgaacggggtcgggaagggggtggagacgcacgccgccaaggtggaggaggcggtcggcggcgacctccagagcctcctccacgcccgcactctgcggctcaagaagctcggcatcccctgcaagcaggtaatctccttcagtcgagcctcttggttcatctctgtatgtgcagattgagcaacggattgtgattatgctagtttcctctgctattcagcatttcggaatgtgattatatgttttggttagatttcgttgtatgatgctgccgttattagatgtcgtcgttatttttgtttcatagaagcgaactgatccatatgtgtgcttataacaatggctcgttgtattatgcctacatttttgtttgagaaattgttggatgcatgattaaattttgagcaaatttcacagaatcatatgctttgtgttccaagttgcacaaaaaccacaggggtttcggcactcggcacttaacaactataagtgtcgctttctcaggaatgtttttgttatttcatctgagtggatttcaacttatttttagttaacagattagctaatgctatgtaattcggcatgctttgaggttaacgttttctgatggtaattttgtctgtgtgttatctaactcttggctttgaacgaatcagtattgtactaggttgcttatttctctctagactgctctggataagcatttgaccatggaaacccttatgttttaaaactaaacttttttcttttgattaataagctatgtcagtgttaatgttttttctaaaggaatatagataagtgttatgtggataattttcttttgtttggtcaagtttcagcatccaagtagtgaaagttaagtaattctggcatagtctcatactttgaacttgaagggaacttacctctctgatctgagatgttgatatattacccttttgttattgggaatgacttcaagtgaattactcaacagcgagatgtggtattccgaaccatgtttttcgtagagcgatacatttttacttaattaagctatgaaattaatcaattttttaatgcttttttagatgccttagtgaatttgacaatgctaaggtgtctagaatttgatgtgcaaaataacacaaattttccttcaagacaattgtaatatttggatgccaagaaagttccatggttttgcattgtacttaggctggattcttggttgtgaaatatacaatttgagttttacatgatattctgaagtgaacacacatgtggcttatgacctgcatgctgaaggaaatattcagttccttttgttaagtaatgggaacctgatcccattttgcagacaatgtgaagacattggctaactagtaactgtatacaaatttggagatgagttagacatctccttgccatgtttgtctccctcccgatctctgtttttaccgtttcttattcttcctttcttccttgagtttcttctctctccaatttgtatttgtccagttaaggatgatcttggctgtctgctgttaatgcattgtttggaaacttactatgtttcctttagaaagcagtcaaatcaaatatagtacgtccctttttttaataccttaagccaatccctttgaattatttgctgccagcatattgagactggaatcttcattagcatgtcatgatgttttctaggaaatagaacacctttgtaggtttgtcggtaatattgcttctcctaacctacagcacaagcatatttttttattatttaaatctcaagtaaaactctgaacattgctactaatattgaggttgatcacccgcccaggaacttaaaaggtagggtgctcacctaagctagtcgatacttgtaacatggttgtggattaggctggtggaatcatcttgataacagtatctttatttatcaactattttttatctgttctgagttccttgttgaggtatgtgaaaataatttttaggggatctattaagttctcttatttctcttttatacttgtgatgcagaggaaattaattttgagtttcgctcacaagtatcgtcttggtctttggaagccccaagcagaatccaagaaaacacagtgaagttgatttgtattgaagtggaccactttgaaaactgtttgctatcattatacttacctgggaaaatgcaacgaaagttagtttctaatttcccctagaattattggtagtgctggacttgagaatttgtcagatattgagttgtagtgtaatagtagtttctattcagccgtctgaaaatgtgcctatgctttatagcaacccttgcatggaatctgaaagttccaatcttatgcctttttagtactttgttttaatgtttttcacttgtgcgaaaataataaagtttaagctagcaatatgtcctaccaatagtagatgctttttactgttaggttaaactattattatttgtgttaaggtatttcgtttcttgtttgtacatctcagtttgtcgggttgtaaaataccatgtggagtatggagagaaacattcaggctatatgatttttcccctcttcaacatgttttatgccgaagtgatagactttttctttttcctgttataagcggtgcacatttgcacatatgagcacagcccaataggattggcccaagggtttgaactgggctacggttgggttgggttgagtggtgggctggttagctacgctattacaccctctacctctgtaaggctcaggggagaatagctaatatggtccctaaagtttcgctcctaggtcattttagtccttaatctttcatattgtctaaacaagtcctttaaatttgtcatgtgagctaatatagtccttggtcccaccaaaatcgccacatggacatgccatgtcaccttcctatgcaaaatctttatgatttgtccaatttacccttatgcataggaaaataaaaaacaaaaggaaaaagttaaaaaaaatatatggtatatgtaagagtaaaaatatacctcaaaagggtgaaaaaagaagtattttttttcctatggttatgtctaattcacccttatatttatttttctatgatatatgtaaggctaaattagacaattcatcatagattttgtatgaataatgacatggcatatccataggatgattttggtggatccaaggactattctaggccttatgacaaaggttaaggatttctttgaaccatttaaaaagttagagactaaactgatcctacagagaaagtttagtgataaagtagctattctccctaaggctcagcaagaaacaagaaacagcttagaacaatcctcatgtacagtataatcaggaaatatctaaacttttgggtttactagtaagtccttgtaggaagtgcatctagcaaaaatatcttgaatatgtattaatttagtggaaatttgttcaagttgaccttaaatcagctggattagaaaatttcatggaaattacgatttccccttttcgtcccaggaattgtacctcttatgcaattctggaagttaatagggccaagttgagtctttgtatagcaacgtacgaccatagtaattaaacacatcctagtgcataatattagaatgtctttaattcggttctagattgggtgaatactaatttatgggatcttattacgaagtggaaagaacacaaatacacaaataaatatcatattaattaaattaattccaacaaacaagcaaacgaatcctgagacaaatctacctgatactaacacacctgtattgactcaaacctcacaaatcaacctgaaaccttattcgatcgacccaagaaactcaaaatcaactaacacaaagctgtctgcgctactccaaccttgacaacaatatatcataatggcattaagctaacgcagagcagaaatttaaaaagaatcataataatgtgtgagctcgatcgacggctcaattagttcctcgccggcgggtggtacgggctcggtgttccgtacgtcggcgtcggcttagggtgcggcggctggtcggggtgcggcttgggcgctggcttggtcgacggtgcggcgggcgccggcttgttgtggtggaagtggtcgaagaagtgcttcttgatgggctcgcagatggtcgccgacgcgcacaccggcgacacatagtgggtcttgccggcgacggcgacgaaggtgcgctccgacagctgcatgaccctcgacggctcctgccccgggcacgccgcgttgttatgcgccgcgctgtggagttgcgccacgcagtcggccccgcggaggtcggcggcgagcggcacacggaaagcgccggcgccgtcgagcttcccggctgccttcgtctcgtactcgccgtcggcgccgttcttgcacttgatcgccacacggagacctgcgcgcaaatatatatataaatctcacttaatgtacagtttactcctctattcaatgaaattggcagcttgccttttctaaaaaaaaaaacaatggcaaatcaaataagataggtaggctgtattgatttaataatcctaagctgaatttaataaactaacaatagaacaaacaaataatcctaagctgaatcaaacagggccttaataagctaacaattgaacaatgatagaagatgcattgcttagcgggacaaattgatattatatattattatttgaaaatgtttagaatactaagaaaatagtgataatcaaacagggccttaataagctaacaatagaacaatgatagaagatgcattgattagagggacaaattgatattatatattattatttgaaaatgtttggaatactaagaaaatagtgagaaaacctgcgttcaaatggattcgaaccagcacgcttctcctggcagctccctgccagctgagatatgtgctgtcctcgatattatatattatatattattataaatgtactttcttcttccttaacgtagtgtagttttgatataagaatttgtccataaaagagtataatattacattggtccactagatctttttaatactattatatatatttttctcttttttaaccattgacccaataaaactccctcctaattattttctcaccccttctcgttttttccctgtattaataaaaggacataataatcttataacttttccttaagatgtgtgtgtttgactagttaaaattatacttatctagacatggagtgagtaataaataatttagaataagttacctaggtaatgctaagtaatgctgatgtataattttttcaaaagaaattacaattttaaaaacatggcacgaataattcgtacataaaaaataatccgaaaaagaacggggacacgatctaatcatcacgcacccttgaaggcggccttggccttcatgttcttcctggtgcagtcgccgcacttggcgaggccgacgacgaccgacgccgcctcgccatgggcggcgaccgccatgaggactgcgaggagagctagcactctacctgctgcagccattgctggactgtgtggagagatggaaagagtagctatctgatcgagctaggtgagtgaggtgatggatgaagaagatggtttggagatgcatgggtttatataggcttcatcgatcgatcgatcgatcgcctgctagctgcaactgtgtgcatggatgttgataaattgaattgatgatacagctcacttgatctgcgggcggtgaaaggtacagagtacgtagatctgtagatcgatggagctgccaactttcgcgccgaattcactgcttgtcatcaatgctggatccgtggatcgtagtgaattatagtgagtaaaattaaaattatgaagcgaaaaattctccagtttcttcttgtactagaacgaaagcatatggaatgtggttcttctctgacatgataggcagctagcttgactttagggagatgtacagtcgatcagtgtactggtcagggttcgcaaatcacactttggtgggtcccggtagaattgtggctaattaagctaatctttgatttttcctttttagaaacatactataaacacaagatgcgcacacacactctctcatttgagaaaacgaaccgacataacttaaaattgacgaagtttcaatagacacctcacaatcaacgagtacgatgtcacgtacaaataaaattcgggtggattgattacactataaagaacataaccaattgagttatactcaccccataatctttgaatttagccaaaagttattacgagtaaatttagctaaaatatgttcaaatctcaatttcaaaaatattatttatttgcttcgaactttcaaaaattttgggatttggtccccccgaaattgccaactgtaccattggtgagactaattgatagcacaataatgacggatacgtacgtacgtatacatcagaagatcagtacaggtagattactttaattcgtctacacaaagaaatatttcttttatggcgaatgaaacctaatatctttagtaataaaaagggcgtaaattatgctcacgatataagatttaatagctacgtgcgatccatcaaaaacttttttaaaaaaagcgtactgatataataacttgactagtgcgatgataaaatgtggtacaaaattattttgcatacgtaagaattcaacctcggcaaggaagcacgtgcaatggttccctttggcagagctatacaggaatgcacaacttacctatcgaaataaatgtactcactagactggtccatatcatctctgacaggctcaaatggtcatttgtgatgggtactatcctcgttagagataagtggttagtggtaagtccacctcacctctgacaggtgaaggcccatcaccggtaactatctcctaaacagctcctaagttctggcccgtcattggatgctatctctcaaacgactcttttaagttctagcccgtatttggtaactatatctcaaacggctcctaagttctagccgatggccaccctgagcttgggggccgccggatctggctgcccaaagcacgggagccaccgcgaagatggagattatggcggatgttatgaaaataaatgcacaacggagacacgaattttacatggaaaaacccttgcgggagaaaaccacgggcgccgaccggcaatgatcactatagaggaattggatacaaacgcaggggatacattgcgctgtcacaccctctccgtgcagcttacaagggatatatataggagaaatctaggagtcctagtggggaaagacttagagtcatactaggaaactaatcctataaaggagagtcctattagataactaatccgaatatattgtgggtccaaaattcggatcacatatttaacaatctccaccttgatacgaatttcccttgttgcataaaaatcttcaatctccaaacaacctcatgatgataaaatcaatgtgcgccaaatagtcacttggactataatcataacacccttgatccagaagaggcattgggaatagatcctgaatctactagtataaaccggtgtgaacctagcagagacgcgaaactaatgcacaaacttcaaactcgccatgggaataacatcctgaatctgctggcattaatttatggaatcctagtagaaacgcgaaactgatgtgctcaaaacgaagtacttagatctccacatctccctataaccttctgatatactgggcaaacggacatagcaattccgccggaaatttgaccatctccacgtgatttggacagcaaccttgcagctccctctcgacgactttgcttgtgtgtcctgaaatatgtatgcgcagctgataaactggtcacgacagtattagctcctcctccatgaaagatgtgccaacttgcaacctcacttgccataacaagaatattacatctcaatccagaagcagtagatcaaacttcaaactcgccttaaaaataaaatcctgaatctgctggtacaatttgtcaaaccctagcagaaacgcgaaacactctgggtgcgtaaaacgaagttgatctccgtgcagaagctcctggtagactggcttgtgaatatagcaatctggaacgtgaatttgtgtccccctgaacagaaccaaaacaatgcaaggcttaaatccctggtgcgaagggcgtgtgcacgtaacaattccaacgtgaaatttaattcacatgaacagaaccgagaaggctgctgaaggcttggacttttctccttcctcgggatgcgtgcggaatagatcaatggcttcaaccctgctgctgcttctgattttctcctgcgttgcttgatggacgtgattcagatcgatgtgttggagcacctgcttaaatcgatctggtcgacaccgcttcgggtttgcttcaccggtgattcaatctcaccgaattgatttctgcgacgatgacgacgcgttgctgctgtggccgattctccgcgacgtgcgctgctgctccttccccggcggcatcgacgacgaggccaatcagatcgatactccgatccgaaaaatcacaccggtggctgtgtgattagtagatcgatccctaatgctataaaaatagatgcacaacggagacacgaattttatatggaaaaacccttgtgggaaaaaaccacgggcgccgaccagcaatgatcactatagaggaattggatacaaacgcaggggatacattgggttgtcgcaccctccccgtgcggcttacaagggatatatatatgagaaatctagaagtcctagtgggggaaagacttagagtcatactaggaaactaatcctataaaatagagtcctattagataactaatccaaatatattgtggatctaaaattcggatcacacatttaacagcggaggtggagaagacgaggtcggcgagctctcggccctccacccagcctcatccttcacccagtgcgcctccctcctcatctccccttctggtgatgatgagctaggcagatttggacttctcgccctccgcttcaatctttgtcttcccctccaccaccaagcagtgcagccttcaccccgagttcccgtaggtgccggcgcggcctccgaccctacgcacctgcaggctctggttttgtcccaaatctactgccgcctccaccttcgaccacgacctcccaccgatgccgacgccaatgccatcaccgccttcggctccgtgcacctgccggcaccgccttcgtaaacatcgtcatccgctaactccacaggatgatgacaggaagagagtgggctgagagttcgagagttcgagagagagatgagaggtcaagaaagagatcgaaagagaaagggtggagagagattaaaaatgaatttatcattggtggcttctattagtgacagggtgaaaaaaaacctttggagattgacttttcatctttaacgggttagatagacaacatgtatagagctgaaagttaaacttgccactaacggccatagtactaacctgtcacaggttacaggtcacttgtgacgagcctatatgcgggctcgtcagaggtgttgtctgtcgggcgcacatatagacccgtcacaaaaaccacttacctatgctgggctgcatgcatcctcactgtttttctttttgatgagggggggggggaggggattttagtcccggttcgcaacccaaaatattgggcccactgaatcttattgttttttaggttgactggattgtcacataagcgacatgtagattaaagtcgctctggattgagttagggggttatttgttcggtatgaaaagtttggggtgtagaatatttggttttgtagcttatggggtaattcatactagcttaatagttcaggaggtaattcatactttttccttgtataaaagcccaaataactaaataattaaataatgtctttataatgcaacataatttctgtgataaatatgaaaaatcgaattatgctcttatggttatgtaattaattaaggatttaaggaggtacggtttgtggtatctgtgggtcagtttatatatagatcgatcaggtcatattcttggatctattttctaccaaagtcatttatttgtacctttgtatttatatactctagttgtaacagccttttacatacctggtcaccttttcttgtggtggtcacatctccctagcctaaatcaataagctggcagacgcacaacgccacaagatcctcagtactatcacccacatgtatggatctactcctagcaaatggttttgaagttttttttacgcaatccatgcgtgtctgccgaaggaagatgagttctagccattaatcgatccctcaagggaatgatatgtgtattttctttctcaaatgtaatgcaaactgttacgatatttttttacaaaactagaaaggtagcccgcgcatatgcgcgggcattttatttaatatgcatgaaactttattacggatgtccatgtgtgggtggcttctatcaaaaatattcttttactttatcctaaactaaaattgaccttacttaatgtacttggaatgatggttatgatttttcttctaattaccctggcaacatataaattctgaactaaaattactttaaaccgtgtagtttttaattaataataaaattttgtgtcgaaacaatagatgtgtttactatgaatgtccatttttttttgttagattctgtttgaaattttagatatattcattttattagtcctatcaaaatgtttgaatatttctatttaagatgggttttgagcccagcaaaaaaatttagtattagataaattttgttcaattttcatttcatttcttttcatcttcatcttttattttttgtgggaaattccactctatgaggcatccttaaaatgctttgatatctacaatttgggatgaaaatataactgggtttatcctgcaacctggcacggggtaaagacatctgttctaaattatatctctctaattaagtaagaaaatttaaaatagaggtcgtagtattttttttggcaaattaccactaaattggagtgtcatgtaacaaaaacatgtttattgttctatgctagatgtcaggaattcacgatgtaccggagcaagttttacaaaaaaaaaagaaagaaatatacatgatcttttaattactatctaaaattgccctttatattcctatggaaacatcatggttgtttcgctgttaagattccaccaatgttcttagtacgatcggtatgttcaactgaccacgtgacttcatagagcacatatataatttagatgctatgattattttaagattatttatttatctctaaaaagatcatttattgataaaagcatcaacatcaaattgtatggatgaatagctcctatatacatgttgagcaaaaaatatttaagtcgatagaaagtcgttagatgtctaacgggatataggtaatgggtctaccagttttgtgaaaaattaaggtgcgatattttttatttttagtgagaaattttagtattttcttatacttagtggaggcctcaatatggatgcgggttgtagattgtaacttttttgttagcatttaaatatagtcaatatggttattaaattattgatttcacttaacaaataatgtgatagttcaaacatatcataagagacatatggtggctatacctaataggtggaggttcgtttgtggtcttctctttgcccactaagataattttaattttaattgtcaagaaataaaaaaaatatagaaaagtaacacaccgcacacgggggatgggaatggagagggagggttgggatgttttttttcttaaaaaaagattgatctaacaacctaaattaatgtgttccgatggtcgaatgttttatttttttctcggatttattaggattttctataatttaagcgggacaaatagtagcttagcatagcgtttatgtgctttaatgtctatagggatggagtggaagggaagaaagtttgggatgttgttttttcgaaaagaaaaaaaataataacgacgtaaaataatgtgtccattgatttaagtggataccagtgattgaatgtttctataatttagagtgccacacaacggtttagaaatatttataggatgtttaatggattttaatgcatatgatgtctatttgtgggtttttttcccatgaagataattttaattttaattgtgatatgctttcacatggaaaactgtatgtattataaataagatgaaaggatcagattaaattcatttagaaatggtagttttaatcttggcctgggtagttaatagccttaaattcattatttaagatgaggagatgaggagcaggaaccgcaggatggatggatgatatatatatatatatatatatatatatatatatatatatatatatatatatattgttgaaattgagtatatacccaattcaaatgagtatgaaactttttcaattacttaggtattaacattaactactttactaactagttcaaagcaattttgaactgaattttaacttgtttttgttagattttgattataggtatatagcatccatacatataattagatatgtatgtaatcatggactgtgaaataaagttaaatttgagttgttttgttgataggtataagtatgaatcgaattattataactaggtatatactcacaatttgaaaattttaaaaaaattgagtgattttgtgcattagatagcatggtgcccgggcactatggtgccccatatgagtgcgtatatatatatcaggttgaatgctccatcaagcgaccattgatgatcctattcattgttaatttttcttccagttatattctgatttgcattcttggtctgggctatgatcaagtaacggtagtagcgtattggccgctggtgccgaaggaaccgatatcacatgcgagattatttaattatctccgaggacgaacataccctttctaattgattttcaaactgttaagcaccttctaatcttagacttatctttaaaattcgtgcagtttttttagtgggagagcgaagcgcatctcgataagaaaacagagaaatggcataaaaatcattacgtgcggggacggtgggaggatctaacggtgttaaataatgggtccaccgatttaaatgaaaatcaatggttagatttctctattttattagagtgccacgtggcgacttgagagtatttatagagtgccatgtggcggcttgagagtgtttgtagaaagtttaatggacttttagtatataataaatagatttggtactccctccttccatttatatatgaaattggttatatgacgttgcttagttcaaaccaatatcatatataagggcatgtacaatggttatcaatagtgctctcttagcgttgctaattagtaatacttgttaacatagaagaaagagaaagagggagagacaaacatcgttgttatgcataacaacgtcttaacaacgactcttaattactataatatggaaatatggttgcatgagggtaaaaaaatggaaagaatattaacaaaaggaatattttctgagttaatgattaaagccttgtcgtcttaactactgtaaagacacggtctctaaataatcttatattgtttaagagaccatactcgtctttactattgaatatgccctaaatggaaggagggagtatataatatagagggtagttatcgatctatcgcttcaccaaaattcaagttaactttgtcagttatatatttagtattttgccggtttgtttatattttacatgacaaagaaaggttagtttcttatgaaagtaaatactttacaaaagtgtctaagtatgcattcggataaagtggttgggatctcctcctctgtgcacgtaaaaccgggtagcttattaacgtatgactaattaattattaactagaaaaacttgtaaaatagataatttcaatggattaatatactatttagcaattcgaaaagcgtgctattgaaaaaagacggaataaaggatgagaacaggcctagtttctactacttcctaaggcggcctaaagcagttttatcttgtgtacatcgcgatagatataaccatgcatgaaagaaaacataaattcgcatgaattaacacacaatatcttgtctgtcagattcgctgtccatgttcatgaatttattatccatcaagatgtagcagtgcgtttttgttgtccttgatttccagctttgggatcatcggttcaaattgcctctaccctgttagctaggctgtgagtatatatagttagatcttacttgtttcgaatgtcataggtggttcttacctgtttctaatgaaatatatatataacgaagagggatctatttagacctgtctctaataaatacagagtatatattgtagttaccattccaatgcaaattagtttgaatctcccactcatctctcgcaaaaatcatattttaattaaactgctagccaaaaaattatcattcctcttctttttcttcctatttttcgtctccttgtctcctcgtctctcaacacttacatcgctttagtgaacacgcacatacattctagtgatcacccaagtagacatatctcgtgtggtttttcaaatgcaggctagctctcctacaatcttgcctagtgagatttggtgctcacttcatcagcctatgtgttagactctccaatataataatgggaccgataagttagcctcactttggatgcatcccccctttctcttccggtggcgagtacccaccccatctatatcagccattgcatgcatgagagccggtaaggccaactctagagccatcgcatagaaatataggaagctaggaggagggcggggtggctgcctctgtcaccgccgtagcacggaagctaggagagccgtctccggtgccaccacacgggagcagaggcgaggagaggaggggtggggtggctatatttgtctcatcatgctcctgctcttgcacacctgatgcagccaagatgggcatgcaatgcttataaaacgattttcacatgccccatgctcttctcacagggcgccccaaaagtaagttcaattgtgaggatggcttaggccgcctcaggattatcaaccgctatctattttgaaagacggggcattttatttccaccagcggtttttctatggattaaaaaaatcatttttagaggtgataaaaatggggtaatatttacaggttgttctcttatgaaaagaagacaggtagatatcgcaataacaaaatcaattaatgtgctacaccaaggacatgccacaaaaattttagagcaaaattaattttcgctatgaacttccaggtcaaaaaaattgatggtggactttgtccatgatcagcttggatgcgcaatcaggagcagaagaaaccaagcttgttttacctcaatgaggagtaggagtgaaaatttttaagcacattggaacacatttgcatggattaaaatatgaaaaatttgtgggccttaatttctaggagccttttcggtcacctacttcacactgcctcaacgacgtgcttgtatatatagtatggtggaggacccctatcatgtcccgtctttagaaatggattatcagcggaggctaattcaaatcatccgttcttaaactaaactcatggggttggtggtttgaattttcatccgtcggacgtacttttaaattcgtgataggagtggtaaaatttttttgtgctctagcttagggtctgtttggcatagctccagctccagatccacctcttctagagctagagtctagcctagctagagctaggtggagctaggtggagctctctcacaaaatgaactagagatgtggaagctgggtttagctaggcagctccacaactccactccagacccaactcctagagttaaatttagggcctgtttggcacagctccaactccagctctaccccttctggagctggagctcagccaaacagtttcagctccaccaaaactgggagtggagttgggtggagctctctcacaaaataaactagaattgttaggcagctccacaactccactccagacccaactcctagagctaaatttaggagttggaactgtaccaaacagggccttaggagttgagctctacagctccaactcctaaatttaattccatgagttgagtctggagtggagttgtggagctgactaagggcctgtttggcacagctccagctccactcctcctggagctggagctcagccaaacagtttcagctccaccaaaactggtagtggagtcgggtggtgctctctcacaaaata

SEQ ID NO: 59193 - DNA, 1608 bp, Oryza sativa
ccagcccgcaagccatccagaaggctcgaaacggccaaggcccacctcagcgccaggtggactggcgctgagtgtcccacggtcagcgccattatggctggcgctgaggtcccagcccgcaagccatccagcaggcttgctggtctgggccttgggggttgcggccaagtcccacctcagcgccaggtgggctggcgctgagtgtcccacggtccgcgccattatggctagcgctgaggtccaagcccgcaagccatccagaaggcttgctggtttgggccttgggggttgcggccaagtcccacctcagcgccagtccggttggcgctgaggtagctgccacgtcaactggggatcggcctggccgccacggtggcacaatgtcagcgccagtcccgttggcgctgacacggccaacatcagcgccaatgtgtttggcgctgaggcgacgacctatttttggttgaagtttttggcaggggttagtttcgaaataagttttccaaaagggtcaatttgtcaaaaaaagggtaaaaatgctgaacatattagtaccgtctggagagaccaaccgatatatgtattgatctttagcactaattggtgacaccaactggtactaaagataatatttgcctttttatgccttctttcttctctagcccgagccattggtaccaagctagagaaggaagctaagagatgtgctgccaaaatttttgatgaaagtattttggtaatattacacaaatcaaaggaatctaaaaggctataaacttcatcctctattgatgtatggttaacttattgcatttctagccatgtttctatcgtcattctctctcaaaaatatatggaaaaagatgagagataataagcatacttcgtaattttggagacattggatacgaatgtaaaagaagaggcaacaaaggaaaattatattaaatgaaggaaaaaggaatagaaaaatagggaaaatagtagaaaataatagaaaatgaaggagatataatggaaaacatgaaggaaaaacaaatagatagtagaaaagttagtgtggcattgtatggaaaataggaaaaaaactatggcaatagtaaaaaaataaatgaaatctaactgtggttagcaatactcttcatccactcaacttttgagtttatgatattgtaacgtcctgccttccccaggccgggcccgcttacatctgatagctttcataggtcatagactgccctcacagactaacacatgtcttttctgcacactttgtcctcactcgtgtgcacccgggaagaattcccccaggccgggcccgcttacatctgatagctttcataggtcatagactgctctcacagactaacacatgtcttttctgcacactttgtcctcactcgtgtgcacccgggaaatgtcttttctgcacactttgtcctcactcgtgtgcacccgggaagaattcccggtcggtcacccatcccaaattgctccaggccaagcacgcttaaccctggagttctttggagattggctgccggaaaagaagttgcaacttgttgatatgaatattctattaatcctattaagccctacgccggaatg

SEQ ID NO: 59194 - DNA, 1188 bp, Oryza sativa
tcaagaacccatttttgtgctttgtttctgcttgttatagggagtttattagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatccacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggacacacacctccccctctattcaaaacccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtagg

SEQ ID NO: 59195 - DNA, 1408 bp, Oryza sativa
cattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtccttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcacattctcctccacattaacttcctcccttaacggcacattgtcctctacatgtacttcttcccttaacggcacattctcctctgcatgtacttcctcccttaccgggtcattctcttccctgatgtcacgtcctgataaattcatcccgaattaaaaatcattcgctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatgagtttataaaaagaaaaaccctaaaaagtctttttcccccccttcccctcttgggccggctcggcccacctccctccctctctctcctctcccccgcggcccaatcggcctcctccccgcgcgcgtgccgctgacgggcgggcccgcccgccaccctcgctgacgggtggggcccacctgtcatccctgtcctcccgccgctcccgccgcctcgcccgtgccctagcgccgccgccgccgcggattccgccgcatcccgccgcccccgcgcgcaataaagagggggaaatcactccccgtgattccctcaatctttccccccccacttttccctctctctctctttttcggattcgtctggaaatcctcccgcaaactttcgccggcgtcattgatggagccgaaatagccgcgccgggttgcttcccctccggccggcctctgttaatcccaac

SEQ ID NO: 59196 - DNA, 17014 bp, Oryza sativa
cgtgtacgagaattaaacgtgaaagaacgaacaaacgtgaacgaacgagcgtgaacgaacgtcaacgaacgtgaacgtgaacgaacgtgaactaatgaacgtgaacgtgaacgaacgtgaacgtgaaatgcaatataggcaggtgaatgaacgtgaacgaacgaacgtaggtgaatgaaacatgaccttaacgagaacacgaacgtgaacgaccgtgaacaaaacgtgaacgtcaaatgcaatatattttacttcgcgtttatcctaatacatctttttgtatcttgcagaaaagacgttgtcggagtcgtccctcaagccggagtggtagctagccctcgaaggaattcgcgcaggcaagtgacataattatatatatgattgttatatttgtaatgcaattaagactattagatttaatatacgacacttagacttagcatatatcactatttgagtttcagtataagattattagatttgtaattagactttgcatataagattgtgtagggttctaatatacgacagttacacttagcatacatgactatttgagttttagtataagattatttgagttttaatataagattattatatttgtaattagacttagtatataattattgactagctagggtcctataatatatgtctcctagacttagcatttatcactatttgagttttagtataagattatttgagttttaatataagattattatatttgtaattatacttagtatataattattgactagctagggtcctataatatacgtcacctaaacttagcatttatcactatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacagatggctgattgtgatgaggaacatatattgtacgatacaatcgcggagggaagcagccagtactggaacgaagaagaggggaacgaggatccaaaccagtatttgaacgaggaagggaacgtggagagggatgcggaggggaaccaggaggggcacgtgaaaagggatgtggaggggaaccaggaggaggaggctagtggaagtcaaccctccgttggacagaagagggcacgcgggcaacgaggtgccgcgaagaagcttgagggtcggcacatcataacggaagtgaatgaagacggccgacctagtgccccggcagaagccgccaagaactatgtacgtcacagcggttgggttgtgcgggataacgtgcctgtcagtacggtgtactggcgcagaacaagggcacgcggagatcatgagagctttgtcccagattcggagaaagagatgctgtggactacaatgctcgagacattcacccttcccgcgggtacagaggacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagtttgttgcatataagacaggtgaacaagggcaggcgatgatggaaagaaacaaagaaaatgccgccaagaagaagtaccatcaccacttggggtcaggcggctataccgtcgcgatgcctaagtgggaggagatggaggctagcttgcttgagaggggtatcgaaccggccaccagtaattggccggaacgatcgaagttctggtactatgctcacggtggaacgctcaacccagctgatggctccctggtcttcggtgatcagatacgcgaggctgcgcatcgactaacagacgcagtggaagcctcttctcagggcacgttccgaccggacagagagaagaacgagttgtcactcgccctgcagactccagagcatccaggacgaacacgagggaaaggggtgattccttggaagattgggttcaaggagggcatccacacgtacaggagtcagatgaggagcaagagagataccgaggcgaagattgcagatctagagttcagggtatcgagctacaagctcagcatgcaagaggaggtggcaaggaaggttgatgaacgcatggccgcacatcggtcccatgatcccaagctgaccattcctcctgcaatggtgagcccgtcaggaaaccatagcagctgcgcctcaacggggcaggtaggatcatagagcatggacgccatgcaaacccaggacgaatccacctgccccgttgatgacatcactcagcgaacaccatgtgagctgcatattcctttcaagaacttatcaataaaggtaagctcgtagtttatagattttagattttgccattccgctagttgctgcttatatatgttgattactaataaataacctctcacgacatgaaggtggcgtcgggcatggccatcccaacggacccttcaggtacttaccactgcaggccgattccagcaggatactccaaggtcgaagttaagttggtcgaaggtgcgtacgaggacctcgagctggattaccctggaggagatggtgagacgcatctacgagacacaagtcacgccattattctatggcgcaagcggtacatcatcctccctgggcgacaagcggcgtctcgtgcaccatctcctccggcttcgccatctcctcctcaggctcctccaccgtctcctcctcatgctccagcaccgtctccaccttaggctcctgcaccgactcctcctcaggctcctgcaccgactcctcctcaggctcctacaccaactcctccgcaagctcctcttccggcaccttccaagtcaagggccccccaagctccaccgcctgcccccacaagggcaacgaagaaggcgaaagttgacgccaccaagaacaaggacccggggtacgattgcacgcaagaggagcttgaagcttacgtggcatcagaagtcaagagacaattcaagcctcgaagtccagaaaagaagattcctatagacccgagtgtcaggaacttcttcaggggtatgtctgcacctgccaaggaggccataaagctatcggactatgagcgaacgctcaagaaagcatcttctggaaagtccaaaccagtccctcagcttggagagcaaccaaaccaggagatcgagccgttggtgaccggtaaagattttggaatacaagaatttattaatgacaccgggctaactacggatcaattgctaggagacgcaccaatcgaaaaggcggaagtgaaatacatgtacgaactcggtaaaccgcttgtcaagcctgagctgctgcagtccctacccacacaaatatacaagttccatcagctgtacatggagatgagcgccaccggtagagagatgatcggagcgagggtcagggacacggacttcttgcaaggagatgacattctctagatcaatttcaagggaatctacgaaatataccagctggacgccctcgacgtctctattatgagttgctggattttgtaagtatatcgttcagttagatttcttactacgtctcctttaagtaattaggtccttttatataagtagactatatataatatatactcccttttatcgttatagaatggagattcaaagggctcaacggcggggggttttcgatactggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattctcgtacgaacttgctaagtgtttcatatgtaatgcatcccacgcactttgcagattccactgggtgcttttactcttcgacctggaggcctgcaccgtcaacgtatatgactcaatggataaaaaagagtctacgtttgacaaggttttcgaacttatagacacgtactgtcataagttcctatgttaattaagaaaatcttgttatattaattgctactacgaatcatagctttaaactccatgtagggcttggtatcggttccgtcatttggtccgcggcaactggagagaaagacttaggcggaagttcaaattttctgtgagtacacatgctctatatttatatttctccgattcaaatacatacaagtgtatattaattagatctctcatcgtttgtcatttatttatagtgcgcaaagcaaaagcagggaactaactagtgtagctactacgtgtgcgagtattgccactgccttgcagaccaaatcatcaccacaagagagctcgatgtacgtataaataaattcaaaatttcattacgtatcgatttgttgttaaattactaatcaatttcatacattcatatagtttattcgcatgagggataacctgatcacacacaaggaatttatcgcggcggttcaagaacatctcataggattcatcaacgaacaaatccttgatcccaagggtgaattctactacgacggaaacacaattcataggtccttagtttctaagctagcgactactactacgtcgaaatcgtagctagctaggacatataatggattgtaattaatacatgactatgtttctatatgcatgtgtacacattttctataatgtaaatatatattttggtcatatatatatataatgcataacatatatatgtataaatacatatatattatgcatgtacatatgtattgaaacatatataaatataatattatatatatatatatatgcatatattattgacggagctggtggctcctcaccgggagaccgcgcaggcccccctttgccagttcggccgggggcttagggtgaaatctcaagctctcgctctctctctgtatgtggaaatatcgtccgccagccagaaacacgagacaccggcgatctatacaggttcgggccgctgagaagcgtaataccctactcctgtgttttggtggatctgtgtatgaatgggctacaagtgtgagctgacttctcccccgttctaagctcacaatctggaaaagaatcaagaaaaaaccccttctctatgggcaaggtcctccttttatacttcaaggggataccacacgcacccttctctttccaaactggactgttctttttctcttgaacgggcggagatcagcacggttgctgtccgaatgacgctccgatgggacagcccacgcctacctccacttccgccgggggtgagcgcgtcgtgggagcatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcctaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatatgtcgcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgacaggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggtcggtgttgaaccgctacatcccctgcgtcctccgcaagaagtgggacgactggaagagcgactggttctacacccccctcgccgacgaagcgcgcctccgccttccaagccagcccccggcgcaggtctccagctggcgggcgccggcagatctgggggaggagtacgacgccgtcctcgaccgcctggcgggcctgcgatcccaggggctcaccggggccatggtgtacggcgattacctccgtcgccggattgcgccgctccaacggcgcgcccggagcgcttgggagtacactgggcctgaagattacatgcggacccatcagggaaccagatgggattgggctcctgaggacttcaagatcgtagtccaaagggtgcttaatcttagctccgcggaggcgtctcgccttcctcaggagatcctccccctctgcatcgatcccgaccgcgtctccattctatccattatgctgggggttggggcctcagaggagagagcccctaagagccacgatggcgcgggcgagagccgccgggggaaacgatctgccccaggagggggtcgtgcttctgggccccgcgtcgggggctcggggagcagccgtcctgccgacgccccggggaagaggaagctgggaggaacacctcccccatctcctccccgagggggcggggcggtgcgtaccagcggtcagcgcccggagggggccgcgccgacgtcacagcccgagggggagcgcaagaagaagcgcctccgcaagatgggggagacggaaccagcccggggaaacttaatttcccctccaaggtggtcattcaaccgaccccctcgcaggttcgtctcactctcattgcaaccatctttctccaaaaagaagtttttttcttgctcattttgttcgccttctggttttttcttctgcttcagcgatgtcccgtcgcattcctcccgccaccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaagctgctcgggaggaggccgcccgggcccgccaagccgcagaagctgcccgggaggaggccgcccgggctcgccaggctgaggcgacagcgtcacttgggcccactccctcgggcggccctcaggcgacatcctccgaggcggctcgcgacgaggccgcgggcgcatcgcctgggcctacctcaccgggcgacgcccaggaccgaacgggcccgggggacatccccgagctcagcgtatcctccggggggccaagccgcgtcgccttttctccaaggcggcttttttcctcatcttccgtcgccccggtgagcgccgagcccattatgcaggccttggccgccgcaaacaccgcggtgctggatgggttcaacacccaggtggaggccctgcgtgcagaacgagcggagctcgaggccgcatgggcgcgcgtcgaggaggggcggcgctcggtggacgccatggtggaggtgggccgtaaggcccatcgccgccacatctcggagctcgaagcccgcaaggcggcgctggcggagatcgcccgagaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgccgcccgagagcggcgggcaacggaagccgaagcggcgtcccggcggcgcgaggaggcccttgaggcccgtgccatggcgctggaagaacatgccggcgccgtggagaggggcttgatggaccgcgaggccgccactgctctccgggaggcgacgctggtggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgtgccgagagagccgcgctggagcagcgggctgccaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccactggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgctccgcacctcaacaggatggcctgggttctcgaacgactccccgaggagcttgagaagaccattaaggcatcctcgagggacctcgcccggggggcggtcgaactcgtgctggcaagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggctcgcgttcgcccccagctccgacgaggaaggcgacaccagcagcgaggacggcggtggcgacgaggccggcgacccgggcgcatatgaatgagcccccaggcccccgccactcttaacttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagtacgagtgacattatttcaagtcaagattcttcaaaaggaaaaaaacggcacagacacaacctttaggaaattgaaactgcttttattgaaatgctgaaaggaatatatgtgcatgtgtggtagcccccggctaaccctgcacacccgagggggggtgcggggttagcccgagccgaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggtactccaaaacgggccgtgatacccttaatgaatttaagagcagagtgcttatcgatcttgacaaccggataagcctcgggccacttagtgaacttgtcgatcgcaacatacagatactcaaacccgcctggggcccgtttgaacggtcccaggatatcaagcccccagacagcaaatggccacgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctgaggggtcgggtcgcgccgacggctgggtaagcctttcttcaaaggcgcccggtggggtctgggctcgcgaggacgcgagccttgagagttcgtcggctatcatgttgtcccttctgggtacatgccgaagctctatcccgtcgaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcggaagttgagacggaccaaatatctgaggacgtctccgttcggagaggtcaacgtgacccctgcaccggcgccctgaagagacagagaaccgtcaaactgcatcacccagtgggcggtttgaggcagctgtgaggggttcgtgctggcctcgggtattgagacggtctctggagccggggtccactctgccacaaaatcggcgagggcctggctcttgatagcgtggcgtggttcaaagtgcagatcgaactcggaaagctcgattgcccattttaccactcgtcctgtaccctctcgattatgcaagatttgaccgagggggtaagacgtaaccacagcgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccgtcttctgtgccgatgacctcggggtcggaagacgacaggagcggccttcccacagtggcctcgggaccgtcctgggggttgggggctcctggtgtcatcggacaagcgggcaaagggccaactccggtcgtcaggggccttaggccaccgttcggctcgggggcctcttctccctgctctctcccgggtcgaatcggtacagggttagcctcggggtcagagggtgataggtgcggcctccccgcagtggcctcggggccttcctgagggtcgggggcacccgacaccgtctgacaagcgggcggagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaaataaagtagcaggggctcatttggctccggggcgactagaaccggaggagagctgagatatgcctttaactgagtaagggcatgttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttgcccgcaggtacaccaaacacacacttatcggggttcagttttatgcgggcggagcggagattctcaaaagtttccgctagatctgaaagtaaagtttcttggttgcacgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccggaacctcatcgcatgtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatccggaggtaggcgtagtggaccgccgccatgaacttcaccaacgcgggtctccccaggaccgcgttgtagggcagactgaggtccgccacatcaaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggagaccaccatcgcaacctgccctccccgggcaatgcacggtgggtggtcggtctggtcaaaagtgagagcaacctccgaccaccgcgcccgacgcatcacctcatgggtaggggccatggccagaagctctcgcttcatagccttgaagctccggcgagagacgtgagcacacgcccctccatcgacggtggcaatggtggccccaggttcttggaaacctaggtcatcatcaccatcatcaatgtcaacagcgggggccttctgcttggcctcacttcgccgtttgccggatgggaccgccggggacttgccctcgcggcgttcctgcctcctgtcctcctcccacttcctcgttcgctcagccaaatttttgactgcgcgacagtccgcgagatcgtggagggaggtgttgtggacggagcaccacctgccggcggggcgctccctgctgggtgtaccagccccgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcagattcattagccaaccccgcgcctgtccttttagggccatgggaaagaagttcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggtgtgctgccgtcgccgtagacgaggaggcgacgctccccatctcgccgttctcctgcatcacctgcggctggtgacgccgcggatttgtcgaccctctcaagcgcctccccctgcttagggctttggcgcggaggaggtggaggagtacgagctcgacggcgcggattcggctccccgtcgtcgccgctcacactcggcgagaggtcgtgtgtttttccttgctcggccattaggctgaacaagaaaaacttggggcacacggaagagtctgagagctcagaaagcacacgctgagccccctacctggcgcgccagatgacggagctggtggctcctcaccgggagaccgcgcaggcccccctttgccagttcggccgggggcttagggtgaaatctcaagctctcgctctctctctgtatgtggaaatatcgtccgccagccagaaacacgagacaccggcgatctatacaggttcgggccgctgagaagcgtaataccctactcctgtgttttggtggatctgtgtatgaatgggctacaagtgtgagctgacttctcccccgttctaagctcacaatctggaaaagaatcaagaaaaaaccccttctctatgggcaaggtcctcctt
